United States Patent 10,233,495 (METHODS AND COMPOSITIONS FOR SCREENING AND TREATING DEVELOPMENTAL DISORDERS) - sequence listing, part 143

SEQ ID NO: 719 - DNA, 256491 bp, Homo sapiens
aggttgtttaaaatttttatagagattgtaaatcagaactattttctatttgccctaaatatttagatgctacagggaaagcagatcaaattaaagggtactgtgcacatttttttactgggaactcccagggatataaatcatttcgcctgcagcatggaattcttcagtacacatgcttgtggaaacattccacgctccgccagcacgctcattaaagtgatgatttgggttgcaacaacagtgccaagtacttcctgtgttcaactggggaccatgtggcaagacccaaagcttccccagagatcctatgggaataagttttttgagccaccatattccattatttcagcctaaaataacaccatgggacaagaatcagaagacagaggagcagacaaatgtgtgtagacatgctggaaggaatctttctttttagaaacagggtcaatatctattaaactttaagatgtgtatctcttgacctggcagtttctgtatttgagttttaacctactgatatacccatgcatgtgaataaagtatcttcctgcatgtaacaggatatttaatgtaaccttgattatagttgcaaatgctgggaaacgatccaaatgtctttcaatatggcactgattaaataaattatggcacagtctcacaatgaaaaacaaatgtagccattaaacagaatgaaatgggtctagctaaattgaaataggactacctctaagatatgttgttaaaaagaaaaaaaagaaagtgcagaggaacaagtatgataccattttgtattttttaacatatgcaagcgtgattgtgcccacacagaatacctttgaaaataaactcagtatttgcctcagtggataaaaacaagaaccagccttattttcactgttatatcttttggtgccactttttgaactttttaccatatgtgcatatgtaactttctaaataaattttgtaaaaaagagaaatatggctcgttgcaataaatctaacaagataaaagatttgttgaagaaaataataaaactattcagacatgagcgttcttgaaaaatggagaaatacattatttccttgtatggtaaggaatggtaagtaagctgggtggtatggtaagctggatattgttcccgactcttcattccctctcttaacagaattatacatccttgcacctttgcaatcttcccactgtgagtggaacatacatcctgacccactgatatcagtcttgctaatgccaatagtgttagtaaatgtgatgcaagtcaaagctttatatgtgcctctgtggtctggtttggccccttgcacttctgccatccaccctgagaagtacaaatctttgggatccattggtcccagaataaaaagatacatagtgcagacccagaccaacccacagcctggagtcaagccgagccaacagagcccagcagaatcacagcctatgcacagacctgtgaaagaaaaaatatttttttgttgtaagcaagatttggggggatgcttgttatgcaaccttgttgtagcaatatctgacagatacatatgggaaaactacattatttcctttggctctattccacctccactaggaaaatattcctgattaacctcattccacaccagattgtgatctcttcaatgacaggaagtgtgtgttattcatccctgtgttcctagacttctgcacagggcctaacagaatttctagaaaacaaaaaattctgactactgtgcctaaagtagccatctctgcccaacagttaatctctgccacatcacagagtttatttagttcagaccatgcataacaatcaataatcatctttctattttgctatgtttccctcatacacagtgtaaacttcctagaagaaatgaatcaatgagtgggggaaaaatgaatatatgactttcttactctgatttgcataagtactcatacatttttgtctaccaccctcgccaaacttctcaggctgcctttcaaaagctggtcccaaatggttcccaatttgatcacccactgctccccttaggcatatgtagttattcaccattgcccacccattacccacactttttctttctctgcaacattagtgttatattccctatgtcatggatgctcttctttaccatccctgcttgtttaaatcctgaccatctgtattcttttgcaataggttcagctatgagtaactgcaaaactcaaaacaatgacctaagcaaaagtttattaatttctgttgtttagtaaatttagaagtaccagaatagaactggaaaggtaatcagtggttttagaggaacaagacactcccagcttattgctctgccaggagtgtcttccattcctaaacttacttcatgatccaagatggctgctggagctccagctattacatacccattccaggcaacataaaggaaaaaaagtggaagaagagcataccttctccctggaaggaaattccccagaaattacacacaccgtttttgtatgtagaaacttagtcacatggatacactcagctgcataggaaactgtactagctagttttgctaaatcacaaaccactattcggcagctttaaacaataagcattcatttagcacatgattctgcaggctggcaatgtgcgctgggtctatctgggcaaatgtagtgctcttgattgggcccatctcaggtaccagcagttagctgcctggttggtcgggtgctgactggtccttacctgggctgtctcctctccatgtggcatcccatcctcccaaaggctagctggggctggttcacatggtggttgggcaggattccaagagattgagtggaagtgtgcaagttatcttgagatataggctcggaactggcacactgtcacctccatcacactgtattagccaaagcaagtcacaagactggcctggattcaagggtggggaaatagactctaataggagaagctacaatgtcacattgcaaaggggtgtgcctatagagaggagaataattgtggccatttttgcaatcactatttcacagaactctagtcttaattctgagggacagcttgcattttctgtgacaccaacttttaaagcccagttcaaaatgaactttctcctccaggaagccttccttgactattgagctagaattctgaccaccaaatatttttacccatttgttctgtggcctttgcatagctacacatggagagacactgtcccatcagtgatggttcgggatgacagaaggtgagcccttcgccatcctcagaagccaccaagaacttagaccccatcttcaccaagatactaacatttctgttgaaacaagtgcccttatgatttaaaagtaatagaccccttgtttcaatggcaagagtatgaaattgttacttttgctttcagcaagcccacaagaggcacgaagaatccacgtgacccaaaagtaagaggtcaaatactgagatctggaaggaatcccttagcatccggagcctgaatagatatatacattcttcatcagagaagatgtcggaactagtccatgtgtacattggcatttttctttctccctttgtaatttttcctcctctcggtatgactgaaatataaatcagtagcctagagtccttctggttaacaaggttctcatttgggaggttgcagcctaggaggctattaaaaacagaaagaaaggcttcttctataaacatttcctgccagctgctgataactggggaggagggagagcacaggggtgacagcacaaaacaggacaattaggggaagaaatctgcaaaagaggaagaattcttggtccacgtccctggcagaaggatccatgaatagaagtccaaagtgcaaaagaaaacctctgggaagaaaggaggaggggcaggagagccttccactgatccaaacaggccagtgccatcggaagggagacaggaggacaaaatccctgcctgcagatgcttccaaatgtttaagacaaaataccaggacattaaaagttggaggaggggtggtcttggcatcttccctcaactcctacaagaataagagtttgcatttgttgagtgatcactgtgtgctggcccacattaatcatttttttaattttttaaaagttgtatatatttaggggatataggtgcagatttcttaaccgcatacatttcattatgatgagatctaggtttctactgtatccatcacccaaacagcgaacattgtacccaagaggtaatttttcaaccctcactcccctcctaccttcccaccttttgtagtctccagtgtctgttattttactctgtatgtctgtgtgtacccattgtttagctcccacttataaatgagcacatgcggtatttgacttcctgtttctgagttatttcacataggataatggccttcagttctatccatgttgctgcaaaagacatggtttcatttttatatgcattaattatctcaattaaggccataaggttggagctattattaaccccatcttcaccatgagcctggtgatgctcacaattttcccaaagccccttggttaataagtggaagaggtagagttcaaatcagtttctctgactgcataggccagactcctggacctctgcaccatcctggtctttgacaccatgatagagtaaaagaggagatgtttcagaacctaccatagaatcatctatcttcaagattacccatgggatgagactgttaatggacacagtgtctcattgaagagctcctgaactttgtgaagacagttgagtgtttacaaataagaatgaagcaacaacaacaataataaattgagtcattgtgttgtgttaggtactgtgctaactgtctagattctctcacttaatgcactgatgtaagaattattgtccccatttcacagatgagaaaatagaagctcagagaaggtaagtcacatggccaggatctcacagtcaaggagtagcagagttagaactcaaacccaggtgtgagaccaaagagcaggctctttgtttattgttctgaggtgcctccttaagtgggcaacttggtcactcattgcttcattcacccttcagatatagactactactcactgtgtttggaaaattttttaatttctaaaattgaggtgggggactagaaagaaacccattgcatttttgtttgactgagggacacaaaccttttatttgtaaaaaaatgtaataactgcaaagcacaataaagccaagtgcaataaaatgagatatacctgtaatcggtttttttataagctaatttcagaagtgacagcccatcaggacagccatattgcattcactacaagtgagtcagtaagtccagcccatgctaaggggagggtattacacaaaggcatgaataccaggagacagggatcactggggtccctcatagaggctgcctgccacattgtacctttcataagatcacaaatacctttcagtcatcctatcacctaatctcttaacatgcaacctgctttctcaatgaaaatcatggtgtaaattgagttctccatcattctcaagactatgaaatcaaggtagagccctggttttcaagctttttgatgacaaagatttcttcaaataaaatcttcctcaaggtgaatggacatactcattgttttgtactataaaacagaatacttctcaaggtgagaaaatagaaaaacatgactgatacacacaataaatagcacagatgaataaccaaagcattattctaagcaaaagaagccaggagcacatactgtatgatttcattcatatgaaactcctagaaagaaaaatctaatgtattgggatagaaagtagttcagtgggccaggcctggtgactcatgcctgtaatcccagaactttgggaggttgagccgggtggattgcttgaccccaggagttcgagaccagcctggacaacatggagaaaccccatctctttgaaaaatacaacaaattagccaggcatggtggtatgtgcctgtagtcccagctgctcaggaggctgaggtgggagaattgcttgagcccaggaggcagaggctgcagtgagcaaagaccatgccactgcactctagtctgggtaactgacagacacctcagggaggggaaggggaagaaggagaggaaggggaaggggaggttaagttcagtggttgcctggagttggggtcgagattaaggattaactgggaagaggagcaaggagccccacccaactcttacttaatccccactgttggaggtggggcctcctgggaggtattgggatcatgggggcggatctctcatgaatggtttagcactatccctttggtgctgttcttgtgatagtgagtgagtttacacgacacatgatcatttacaagtatgtggcacctccccacctactgatatgcctcctcccccttgccttccaccatgattacaagcttgaggcctccctagaagctgatgctggagctatgcttccagtacagcctgcagaaccgtaagccaaataaacctcttctcttataaattacccagtctcagctatttcattacagcaatgcaagaacagcctaatacatcatcacgaaagcttctttgcctaagacttgcagagatagatatgtcctatcaggccctcctcagcccaacctctaacacccacagaaaaccctgaaaagtgagaacccagtgaacatcctgaacatcctctgatggctgtgaaaagttagtgcacttctgctgttattgacacctgataactcattaaaaccagactaatcatcaacaagcagcaggtttctttcacactcaaagcataccagctccattctgaaatgatggctaaattaactgcagagaagcagccaataacctcctcctctcaccctgttcactctttgggctaataagtgtcttcttcatcagctgccttggataaaaaacaaatgactgggttatacattttcttgtacttgatacataagcctttctgcagaatatgataacaacgtaaataataaagatggccattgcttattgaatcatttactgtgtgttgtgtcttttgtacagcatataacactatatgctgtggcctctatatatgctagagttataaccctcaccctgagccgatttaactttatcaatatgaaaatggatacaaagaatgtaatctagtcacccaatgtcatgcagctaatgtggtgtctcaggtccctctattccaagccccaggtttagagtgagactaactggacctgaccgtcaggaaaaattaataaacaaataaggacttccctgctgagataccccaggataatttgtacaagtctccaaagcctagcacactgctggcacatagtaggtgctcaataaaatcttgtgatacgagaaaactggaactcctcatgcactgttttgtcggttacaaaatgtgaccccggacagagcatcatgatttgattagagtaagcggacttgttttcaactccacaggtagtcaaatggggagagtgggcatcagaaaatacataggtatatataagataatccatctttcaaaggaggctgaatggcagctcaaaggcatagagagaacctagggcaaggttatccaacctgtggcccaagacagctttgaatggggctcaacataaattcatcaactttcttagctcatcagctgtcgtcggtgttagcgtattctatgtgtggcccaagacaattcttcttcttccaatgtggcccaggaaagccaaaagactggacacctctgacctgggaaaaaagtacattttctccccagtgtcagaaagggatgtcataacaaaatattctaaaatcagaaaggaccaaaaaaaattgggtaactatccaaaatgaaataaattcatgaaattatgaaatattagtcatggtttgatttattctgcagctatataacatcactccatcaacaacacagaaacaaaaaattctctcaaaaatgaataatggatatgttcaatcaatcatggcataaccagggaatggaatgctttgaagctattaaaaaagtgtaattggccaggcgcaatggctcacgcctataatcccagcaacgtgggaggctgaggcacgtggatcacttgtgcctaggagttcgagaccagcctggccaacatggcaaaactctgtctctactaaaaatacaaaaagttagcgggcatggtggtacatgcctatggtctcagctactcaggagactgaaacgggaagatcacttgaacctgagaggcggaggttgcagtcagcgagattgcaccaccgcactccagcctgggcaacagagcaagaccttgtctaaaaaaaaaaaaagaaaaaaattaagtaaacaatgtaatcaacacatatttaaggagttttaataactaaatgaataaagtcagtaacaaaacagaagatgaagtataataccactttgcataagtataaactgataagaaaaataatctggaaggatgcggaatagagaaatgtacagttttttctagatggtcagcttatgggtgattttttaaattttaattggcatatctgtgttttgaatttttatatagtaaatgtgaattgattgctgaatttaaactaaataagggccgggcacagtggctcatgcctgtaatcctagcactttgggagaccgaggtggatggatctacaaggtcaagagatcaagaccatcctggccaacatggtgaaaacccatctctactaaaaatacaaaaattagccaggcgtggtggcgtgcacacgtagtcccagcttcttggaaggctgaggcaggataatcgctggaacccaggaggcagaggttgcagtgagtggagatcgcaccactgcactccaacctggcgaaagagtgagactccgtcttaaaaagaaaaaaaaaaaaaactaaataaaacccgttgtaatggtggtgtttaaacagagacctaaggagaagtcagtcagagcctaaaggggtcccaggaaaggaataaggaactggaaattcaaccaggcttggcaattagcaaaggatctgagacaatttaggtggaaattagaaacagctaaaaaatgaagaaggggctttttaagacctcacactactatggttcacaataatgcctctcaaaactctgtcataactatttttcaatatgtcaaagtaaatgtcatctctagttatctaaaaacatcttgatgcctgatacctactagaaaaaacagcccgagtttgtccacagttttcagttcctgtgtcatttcagttgcctggcgaggaacttttcttactatattggctctcaggtaactctctaactagaccattccatctccccaaaaactgtcatggaaaaagaacagtcttgaaagtcgagagaggcagcccagctctgctattcaggctgtgtgaccttgggcaagtctctccccatggtctcagtgggttgatctatggagcccaagcaataggattctctcccccaggaatttgaaacttggaatccgagattggaaagtgagacacattaatggtagaactcaagaaaggtaggggctgggggccgtggctcacacctctaatcccagaacttcgggaggccgaggtaggaggattgcttgaggccaagagctcaagaccagcttgggcaacagagcaagaccctgtctctacaaaaagcaaattaaaaattagccaggcatggtggcatagtggcattagctacttggaaggctgaggcagcaggattgcttgagcccaggaggtcaaggatacagagagctatgatggtgccactagattctggtctgggtgatggagtaaaaccgtgtctctaaaaaaatttttttaagagaggtagatcatgaattccatctgctgctaagcttccaaaactctattagtattttccttcctatgcaaactcctctctcattcagtgagagcacctgttatcctaacaatcacgaatttattttccttacattaatcagagtcagtttctattgcatggaaccaggcaacacttagctactgtggcttagatagaaggaagtccttcctgccagcatgaaaggaattggtcagtcaggcaaaggagtctgacccaaagggaaaagctgccacaaagagtgactttcatccttgggctaagaagcaggggcccaatggggcaacttgtcacattcaataaggattcttggtcagcccaaccatgctctccaagcatccaggcatgaatccccacagggcaaggcagcagagaggagcaacagtgagcatgatgggttatctattctcccagctccccacagcccactgactgcactcagctgagtgcaggcaccaacttcttgcatctgagtttttgcagctgctgttggaatctctctaacacagagcttctcaactgggaaccattttgctccccaaggagcatctgacaatgtctgtggacatttttggtgatcacaaattgggaatgggggctggaaagggtggctcatgcctgtaatcccagcactttgggaggccaaggcaggtggatcacttgaggtcaggagtttgagaccagcctggccaacatggcgaaattgcatctctacaaaaaatacaaaaattagtttggcagccaagatggccaaataggaacagctctggtctatagctcccagcatgagtgttgcagaagataggtgatttctgcatttccatctgaggtaccgggttcatctcactagggagtgccagacagtggatgcacgacagtgggtgcagcacaccgtgtgtgacccaaagcagggtgaggcattgcctcacacgggaagtgcaagggatcatggagttccctttcctagtcaaagaaaggggtgacacatggcacctggaaaatcgggtcactcccaccctaatactgcacttttccaatgggcttaaaaaacggcgcaccaggagattatatcccacacatggctcggagggtcctacgcccacagagtctcgctgattgctagcacagcagtctgagatcaaactgcaaggcagcagtgaggctgggggaggggcacccaccattgtccaggcttgcttaggtaaacaaagcagctgggaagctccaactgggtggagcccaccacagctcaaggaggcctgcctgcctctctaggctccacctctgggggcagggcacagacaaacaaaaagacagcagtaacctctgcagacttaaatgcccctgtctgacagctttgaagagagcagtggttctcccagcacgcagctggagatctgagaatgggcagactgcctcctcaagtaggtccctgacccctgacccccgagcaccctaactgggaggcaccccccaatagggccagactgacacctcacacagccaggtactcctctgagacaaaacttccagaggaacaatcagacagcagcattcgcagttcacgaaaatccgctgttctgcagccaccgctgctgatacccaggcaaacagggtctggagtggacctctagcaaactccaacagacctgcagctgagggtcctgtctgttagaaggaaagctaacaaacagaaaggacatccacaccaaaaacccatctgtacatcaccatcatcaaagaccaaaagtagataaaatcacaaagatggggaaaaaacagagcagaaaaactggaaactctaaaaacagagtgcctctcctcctccaaaggaatgcagttcctcaccagcaacagaacaaagcttgacggagaatgactttgacgagttgagagaagaaggcttcagacgatcaaactactccgagctacaggaggaaattcaaagcaaaggcaaaaaagttaaacactttgaaaaaaatttagacgaatgtataactagaatcaccaatagagagaagtgcttaaaggagctgatggagctgaaagccaaggctcgagaactacgtgaagaatgcagaagcctcaggagccaatgcgatcgactggaagaaagggtatcagtgatggaagatgaaatgaatgaaatgaagcgagaagggaagtttagagaaaaaggaataaaaagaaacgaacaaagcctccaagaaatatgggactatgtgaaaagaccaaatctacatctgattggtgtacctgaaagtgacagggagaatggaactaagttggaaaacactctgcaggatattatccaggagaacttccccaatctagcaaggcaggccaacattcagattcaggaaatacagagaatgccacaaagatactcctcgagaagagcaactccaagacacataattgttagatacaccaaagttgaaatgaaggaaaaaatgttaagggcagccagagagaaaggtcgagttacccacaaagggaagcccatcagactaacagctgatctcttggcagaaactctacaagccagaagagagtgggggccaatattcaacattcttaaagaaaagaattttcaacccagaatttcatatccagacaaactacgcttcataagtgaaggagaaataaaatactttacagacaagcaaatgctgagagattttgtcaccaccaggcctgccctaaaagagctcctgaagcactaaacatggaaaggaataaccggtaccagccactgcaaaatcatgccaaactgtaaagaccatcgaggctaggaagaaactgcatcaactaatgagcaaaataaccagctaacatcataatgataggatcaaattcacacataacaatattaactttaaatgtaaatgcactaaatgctacaagtaaaagacacagactggcaaattggataaagagtcaagacccatcagtgtgctgtattcaggaaaccatctcacatgcagagacacacataggctcaaaataaaaggacggaggaagatctaacaagcaaacggaaaacaaaaaaaggcaggggttgcaatcctagtctctgataaaacagactttaaaccaacaaagatcaaaagagacaaagaaggccattacataatggtcaagggatcaattcaacaagaacagctaactatcctaaatatatatgcacccaatacaggagcacccagattcataaagcaagtcctgagtgatctacaaagagacttagactcccacacaataataatgggagactttaacacccactgtcaacattagacagatcaacgagacagaaagtcaacaaggatacccaggaattgaactcagctctgcaccaagcggacctaatagacatctacagaactctccaccccaaatcaacagaatatacatttttttcagcaccacaccacacctattccaaaattgaccacatagttggaagtaaagctctcctcagcaaatgtaaaagaacagaaattataacaaactgtctctcagaccacagtgcaatcaaactagaactgaagattaagaaactcactcaaaatcgctcaactacatggaaactgaacaacctgctcctgaatgactactgggtacataacaaaatgaaggcagaaataaagatgttctttgaaaccaacgagaacaaagacaccacataccagaatctctgggacacattcaaagcagtgtgtagagggaaatttatagcactaaatgcccacaagagaaagcaggaaagatccaaaattgacaccctaacatcacaattaaaagaactagaaaagcaagagcaaacacattcaaaagctagcagaagacaagaaataactaaaatcagagcagaactgaaggaaatagagacacaaaaaacccttcaaaaaattaatgaatccaggagctggttttttgaaaggatcaacaaaattgatagaccactagcaagactaataaagaagaaaagagagaagaatcaaatagatgcaataaaaaatgataaagggaatatcaccaccgatcccacagaaatacaaactaccatcagagaacactacaaacacctctacacaaataaactagaaaatctagaagaaatggataaattcctcgacacatacaccctccaaagactaaaccaggaagaagttgaatatctgaatagaccaataacaggctctgaaattgtggcaataatcaataccttaccaaccaaaaagagtccaggaccagagggattcacagccgaattctaccagaggtacaaggaggaactggtaccattccttctgaaactattccaatcaatagaaaaagagggaatcctccctaactcattttatgaggccagcatcatcctgataccaaaacctggcagagacacaaccaaaaaagagaattttagaccaatatccttgatgaacattgatgcaaaaattctcaataaaatactggcaaacagaatccagcagcacatcaaaaagcttatccaccatgatcaagtgggcttcatccctgggatgcaaggctggttcaatatacgcaaatcaataaatggaatccagcatataaacagaaccaaagacaaaaaccacatgattatctcaacagatgcagaaaaagcctttgacaaaattcaacaacccttcatgctaaaaactctcaataaattaggtattgatgggacgtatctcaaagtaataagagctatctatgacaaacccacagccagtatcatactgaatggtcaaaaactggaagcattccctttgaaaacgggcacaagacagggatgccctctctcaccactcctattcaacataatgttggaagttctggccagggcaattaggcaggagaaggaaataaagggtattcaattaggaaaagaggaagtcaaattgtctctgtttgcagacgacatgattgtgtatctagaaaaccccattgtctcagcccaaaatctccttaagctgataagcaacttcagcaaagtctcgggatacaaaatcaatgtacaaaaatcacaagcattcttatacaccaataacagacaaacagagagccaaatcatgagtgaactcccattcacaattgcttcaaagagaataaaatacctaggaatccaacttacaagggacgtgaaggacctcttcaaggagaactacaaaccactgctcaatgaaataaaagaggatacaaagaaatggaagaacattccatgctcatgggtaggaagaatcaatatcgtgaaaatggccatactgcccaaggtaatttgtagattcaatgccatacccatcaagctaccaatgactttcttcacagaattggaaaaaactactttaaagttcatatggaaccaaaaaagagcccgcattgccaagtcaatcctaagccaaaacaaagctggaggcatcatgctacctgacttcaaactatactacaaggctacagtaaccaaaacagcatggtactgggaccaaaacagagatatagatcaatggaacagaacagagccctcagaaataatgccgcatatctacaaccatctgatctttgacaaacctgagaaaaacaagcaatggggaaaggattccctatttaatacatggtgctgggaaaactggctagccatatgtagaaagctgaaactggatcccttccttacaccttatacaaaaattaattcaagatggattaaagacttcaacgttagacctaaaaccataaaaaccctagaaggaaacctaggcattaccattcaggacataggcatgggaaaggacttcatgtctaaaacaccaaaagcaatggcaacaaaagccaaaattgacaaatgggatctaattaaactaaagagcttctgcacagcaaaagaaactaccatcagaatgaacaggcaacctacaacatgggagaaaatttttgcaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaaaacacatgaaaaaatgctcaccatcactggccatcagagaaatgcaaatcaaaaccacaatgagataccatctcacaccagttagaatggcaatcattgaaaagtcaggaaacaacaggtgctggagaggatgtggagaaataggaacacttttaactgttggtgggactgtaaactagttcaaccattgtggaagtcagtgtggcgattcctcagggatctagaactagaaataccatttgacccagccatcccattactgggtatatacccaaaggactataaatcatgctgttataaagacacatgcacacgtatgtttattgcggcactattcacaatagcaaagacttggaaccaacccaaatgtccaataatgatagactggattaagaaaatgtggcacatatacaccatggaatactatgcagccataaaaaatgatgagttcatgtcctttgtagggacatggatgaaattggaaatcatcattctcagtaaactatcgcaagaacaaaaaaccaaacaccacatattctcacttacaggtgggaattgaacaataagaacatatggacacaggaaggggaacatcacactctggggactgttgtggggtggggggaggggggagggatagcattaggagatatacctaatgctaaatgacgagttaatgggtgcagcacaccagcatggcacatgtatacatatgtaactaacctgcacattgtgcacatgtaccctaaaacttaaagtataataataataaaataaaaaataaaaattaaaaaaaatacaaaaattagccaggagtggtggtgggcacctgtaatcccagctacttgggagattgaggcaggagaattgcttgaactcgggaagcagaagttgcaatgggccgagaccacgccactgcactccagcctgggtgacagagggagactccatctcaaaaaaaaaaaaaaagaaaagaaaagaaaaaaagggggggtggggggaatgcggtgttactggcatccagtaggtagagaccaggtgtaaccatttcttattgtaactgtaaaaacttgccatgaatttagtggtttcatttttatttttttattttgagacagggtcttgccctgtcacccaggctgtagtgcagtggcaccatcatagctcactgtagccatgacctcctaggctcaggccatcctcccatcttagcctcctgagttgctacaactacagggcatgccaccatacccagctaattgttattttttggagagatggggcccaggctagtctctaactcctaggctcatgcaatactcctgcctcagcctcccaaagcactgggatcacaggcatgagccaccacacccagccaattaagtggttttaaacaactcaaatttgttcttataattctagaggtcagaagacaaaaatgagtccacagggctgcatgtcttctggaggctctaggggagaatctattccccacctttcccagcttctagaggttgcctgcattccttggctcatggctccttcctccatcttcaaagcaacagggtaacatcttctcttcccactcttattctatcatcatgtcacatcatcttctaaggacccttgcaattacctgagtctcacctgaataactcagaataatctcctcatctcaagatttttcattccaatcacatctgcgagagttttctcttgctttgttttcgtttggattttgccatcttaatgtaatgtattcacagattctaggagttgagatatgaacatctttgaggagagggggcattgttctgtctaccacaccaggtagacatcctgcagcccgcacaacaaaggatcatccagcttaaaatgtcaggagtacagaggttgagaagcctgcatgctctgatactaccagatttcccacagaccctaattcaatgccactgcttaatgtgcatgacaactgcagaccccctattccttgataccatccatccaaaacactccctacaatgttttttaaatatgtgtgagtgttattgagtccaagtaagtgacagaaatcctgtttccctaaaaagtttgataacaggaaaaaacagtcatttattaggcttgacatgattcttgtgacttctaagtttggggcttcaggtgtttgaaagttactcagaagccaggcacggtggctcacacctgtaatcccagcactttgggaggccaaggtgggcggatcacttgaggtcaggagttcgataccagcctgaccaacatgttgaaaccctgtctctactcaaaaaatacaaaaatcagctgggagtggtggtgcacgcctgtagtcccagctactagggaggctgaggcaggagactagcttgaacctgggaggcggagcttgcagtgagcctagaccatgccactgcactccagcctgggcaacagagcaagactctgtctcaaaaaaaaaaaaaaattttttttactcagaagggaaaaaatgaactcctcaaactttgggacagaaaatgggaagtaaaagcagagaaaagctatcaccaacccggtgcctcatacctgcccattttctgcttccacttcctgggagtaaaagtctttaggaagggaaggtgaattagtattgattatacatgcaccaaaagacaaacaccaggctgtatgccttacgtatgtgactcttccaggttggtgtcatcattcccacgttaacataagtggtaaagtgaatggagacaccaaagaggtgtaatataacttctttaatgaaataaaccaggaggcagcaaacgttttctgtaaaccatcagttagtaaatatttgaggctcttttgaccatgtgggctctgttgcaatcacttaactctgcccttgtagggccaaagcaatcattgatgctatgtaaatgaacgggtgtatgaggctgttccaataaaactttatttacaaaaataggcagagaccagatttggccctggagctatagtttgctgccccctgaaatacatttttttaattcccaaaatagccttcatcagcaaatatttcccaagcacctactatatgtcgatatacaactgaacagcccagaaactacaaagatgaataaagaagccaataaaagtccaggtgcagtggctcactcctgtaatcccagcactttgggagaccaaggcagtggatcacctgaggtcaggagttcgagaccagcctgtccaatgcagtgaaaccccatctctactaaaattacaaaaatcagccaggcatggtggcgggtgcctgtaatcccagctactcaggaggctgaggcaggagaatcgcttgaacccaggagacagaagtcgcagtgagcctagatcacaccgctgcactccagccggggtgacagagcaagactccatctcaattaaaaaaaaaaaaaagccaattaaaaataaaacagttcaaatgccaccacccagaaataaccactataaacatttggtatttatcatgaatgatttttttaaactctatgaacatatattttcaagacaaaaataagatgattgcatacataatttttatgacctaatttcaaaataaatccaagactgctttctctgtcaccaactgtaaatgtagatttaacatttaatatttcatgactatgcaacgatttgcatgtagcaggatttgctgagtgacctccctattgatagacagtgagactgtctcctttttatcaccaatagcatttacccagtttcctcctccgcccccttctcctcccactcccaacctcccgccctctttctggcataccttacattgctcgtgggaatataagtcagcacaatcttcctaaaaacagtttaacaatgtgacccagaaattctaggtctaagacaagagggcaaagatagagatgtaaagatgttcttggtagcattgcttagaatggtggaagagggaggatagtctcactgtccatccacaaggagtcatttcacaaaccctgctacatgtaaatcattgccatagttaaatgttaaatctacatttacagttagtaacagagaaagaagtcttggatatattttgaaatcaggtcagaaaaattatgtgtacaataatcttatttttatcttaaaaatatgtgcttatggagttttttattaaaaaaattcatgataataccaagtgtttatggtggttacttctgggtagtggaatttgaacttttactggcttcttagtctttgtagcttctgtgctgttcagttctacactgacacataggaggtgctggggaaatatttgccgataaggtgaacacaacactccagcatcaggggtttcatgtggctataaggaaggtatttctaccatgatgcttggcaaacacaggaaaggatcattaaagtcgcatctggaatccccttttctgaaggtgtttttttaaagaatagaattatcttatgatcttgaaatgacaaaggtttttcttagtatgtcacaaacccgggagacccccccgcaaaaaaaaatttgattacatagaagttttttaaaaaacagagctgcggaaccaaaaccaccctaagcaaagtcaaaatacaaaagaaaacccaggaaataatgtttgtgaagcaaggcgtggaaaatggctaattcccctaatgtataaaatcaataagcaaaagagcagattcatagaaaaatggacaaaagataagaacagtttgtaagaaaagaaacacaagtgattcttgggcaaatgaaaacatgctctgtgttattcagagtaagataaatgcaaattaaaactatgctgagatatcaattttcacctatcagattggcaaaattaaaaagaactcaataatacatggtgcttgatgccactatgggaactcaaacattccttgagggatgggtgtaaattttttacaacctctatggagaaaagtgtgtcatttgacccaactattacacttttagaaatttatcccacagacatttgcacaggagcaaattgcaccggtatcagattatcgattatagtttttttaaataatagcagaagagtagaaataacccaaacatccatcagtaggaggttgcttaaacaaattatagggtactacatggtgtactctgccactcagaaaagaaaataagaaagttaactgtgtactcataaggaaggatctccaagatatgtatttaagagaaaggtgaaaaaagcaaataacggagaagcatttttcatattaaaaaataaaaggagatgatatgtgaatatcatatatatactatatatagtgtggatatgtatatacataaactatacacactatatatacacatatacatatacacactatatatagtatatatgtgtgtatatatacacatatacatatacacactatatgtagtatatatatacacatatacatatacacactatatgtagtatatatatacacatatacacactatatatagtatatatacatatacacactatatatagtgtatatatgtatatacaccatacacacatacattttgcttatgtatgcacaggatatttctagaagaataccaaagaaattggttcatttgttgcttcagggatagaggtagggggaaggtggtaaatggaaaaagggagacatttcactgtttatccttttgtattttttggaatttggaccatgcaaaagtattacctattcaaaacattaatgggtcaggcatggtggctcacacttgtaatcccagcactttgggaggctgaggcaggcagatcacttgaggccaggagtttgagaaaccctatctctattaagaatacaaaattattggggcatggtggtgcatacctgtaatcccagctactcaggaggctgaagtacgagaattgcttgaacctgggaggcagaggttgcagtgagctgagactgtgccactgcattccagcctgggcaacagactgagactctgtctcgaagagggaaaacaacaaaaaaaaaaccattaacagaggatccttcctacttcagagcttcctatacactgtttccactgctggaggtgttctgatgttgactgacttacacacacacacacactcctcctggaagtattttatctttcagatctctgttcaaatgttacttcctccaggaagtcttacctatcacctccacctcctccgcagaaagggagctgttatacccattcatggtaccttgtgagatttatcacaatgggtatcaattaataattaacatctgtcttccttgctggaggtaccagagggactagtctgccaatgaaccccaggcaccaagtccagcatatgccacataagacacgcatctcagagactttcttctgttggaagggagggaagaaaataggaagaaataaccacagttacactcctagcatgagccagacagtggtctatgcgctttatgcagattagcacattaaattctcacaagagagttgtgattcttgcacagatgaaaaaaacaggctcagagagaccaagcaacctgcccaagatccccaggcagaggcatgattcaaaccaggcaggctggttccagagcctatgctcttggctcctagaagggaaaacagaagaaagggaagaagaggagagagggaagaagagaggaggttgctcacaatatcaggaggatgcatttttctgctgtctccagttcagtatctcacaagaccagcaagccttccagtctgggaagttataagaacatcattgtattactccattttcatactgctgtaaagaactgcctgagaccgtgtaatttataaaggaaagaggtttaactgacttacagttcagcatggctggggaggcctcaggaaacttacaattgtggcagaaagtgaagaggaaaacaatgcatcttcttcacaaggcagcaggaaggagaaatgccaagcaaagagggaagcgttccttataaaaccatcagatctcgtgagaacgcactgtcatgaaaacagcgtgggggaaactgcccccatgatttaattatctccacctggtctctcccttgacatgtggggattatagggaatgtaattcaagatgagatttgggtggggacacaaagcctaatcatatcaaccattaatggggattctgtaatgtatatgaaacacttgcagactgacactactggacctcaacaaagagacagcagacttgaagtatgacagctgtcttatctagaggagcaggtaacatgcattgtagataaatacactatctgatgtgggttaataggcttcattgaattaatgatgacagaataattacagcgacaagcaacagcagcagggactctaattgaggataattcaagcacacggcaagatcggaagttttgactttaggactatggaaacttccctgagattggagatttattatttctattattttaaatcaacaatatccaccactggcaaggtgcagtgtctcacacctataatcccagcacgttgggaggctgaggtgggcagatcacttgaagtcaggagttcaagacgagcctagtctgtttagtaaagatggttaaaccttgtctctactaaaaatacaaaaattagctgggtgtggtggcatctgcttgtaatcccagctactcgggaggctgagtcaggagaatcacttgaacctgggaggcggagtttgcagtgggctgagatcatgccactgcactccagcctgggtgactgagcaagactccatctcaaaaaacaaaaacaaaacagtatccatatctaccatagcatgtctgagctctctgcaagtcaatgggaagttatccacaggacaggatttccttacttttatttgttaataagagaaatggaagggaatgggaaatcagaaaagcagaggcataccaatttttgccatttctcctcacatagaatttgttcctcatcttaaaggcttggacaggatgctgaaaagtataagagaatggggattacattcaggtaatcacaacagcaataataatagttatcatttattgaacctttacctccaaacagcatctaaagtaagcactatttataccttagcccactgaattcccaaactaattttgtagagtgggaacaaatgtgtttgcccattttatgggtaagacaactgaggctctgagaagtaaagtgatttgcctaagctaggaaaatgcagaagttaagaaatgaaagcattagaataatacccaagaaggggtcatttctgaaggaggagatggattcatgaacaaacaagcaggcaggccaatatgtaatttgttgataagcatgaatatatttaattaaataaggatctactggatacctgtcacaagcccagtgcaaggtccttgtggcagatggtttttttccaaaggtggccatagtgatatctcccataccacatgctgtcataatgtgaccttttatttctcttgttgagtgatgaagtccatgatccctccccttttaaccttagaaactgcctcaatcattaagattacagcagaaaatatgctatttgatttccagggctagaacataaaaagcatatgcacttcctccttgttttcttgagctactcgctgttggaccccagctactatgttgtgaggaagtccagttagcccacctgaagagaccacctagggaggccacatgcagacgttttggctaactggctagctgaggtctcagctaacagtgagtatgaaatacaggcatgtgacagaagattcctctagatgcctttagtccccagccatcaagtcaccctcaacttttgagttttcccagctgggtccccagacatcatgaggcagagcaagccactctctctggtctgattcttgacctacaggatctgtgagtgtaataaaattgtggcttatagcactaaaaattggtgtgatttgttacccagtaatagcaactggaagagccctcatatatttttaatacaaaaaaaaagtgtgtgaaacaggacctgcccttctgtttaatttggaaaacaagacttctataacaatgttatttacaaaatgtatcttataatagccaaaaggtggaaataatccaaatgtctgtaaacagataaataaacaaaatggggtctatccatacaatggaaagttatttagccataaaaagaaatgaagtactgatatattctacgacagaaatgtagaaattagaaattagaaaacactgtgtttcgtgaaagaaccaagacacaaaaggccacatattgtatgactccatgtgtatcaaatactcagaatgggcaaatccacagagacagaaagtaaattagtggttgccagaggctgggggacaggagtgaaagagtggctgcttaatggtagaggtctggggttggagggtgatgaaaacatcctagaattagacagtggtgatagttgaaaaatcttgagaatacactaagaccactaaattatacacttttaaatggtgagttttataagacatgaattatatcccaatgtaaaaaaaagcaatgtgccatattaggaccttctgtgagggtggaaactcatcagctttggggtcaagtagatctgggttgttgtccagggactaccagtgcctaattgtatggacttgagcaagtttctcagtacccaagggctcagattatccatctgtgaaatgggaataataagactcactttgcaaggctgctgtcaggattaatgattgtctttatcaaagatggtaacagaaactcactcgagcagcataagccaaaataagcattttatgaaaggaatcagggacattttacagaagcccaggtcactaagaacaatttggccacataagaaacttgaaccaggaatttaaaatatatcaaaagccaaggttgatattctttctggcgtatatgtagtgaacagagaaatttctttcaaattattcattcgtggaaaatcaagatttggcattgcattttaaagttaatccattagagtcacttagttatttgcaaaataacattttggtaaaggagaatttatttgaatatcaaataagaaaaggttcaataccctacctggtagagctggaaaacagttaatgatcacaggcttggaacacaaaatcaacctcctgtaacaaatttagtttatgactttaaaaggaaaaatggacttttctacaataaacattcaaacaaacatggttcaaacaaacatggtttccaataataaatgtttttaaatctcaaggtcataataaatcagtcctgggactcttaaagcaaacttttttatagtataggaaagtgctttcctattttataatcaaaattagaaggaaactagactctatgttgacaagagacaaacttacacatagactttaagttaattctttagggtagttgccttaatagccattgaccttctttattagtctgaaggagtgattctcagctctagctacacattgaaatcactgagtacctttttaaaaataccaatgtcaccggccgggcccagtggctcacatctgcaatcccagcactttgggaggccaaggcgggtggatcacttgagcccaggaattcaagaccaacctgggcaacatagtgagactctgtctctccaaaaaattcaaaaaattagccaggcatggtggcacatgcttgtagtcccagctacttgggaggctgaggacaggtggttgtaagcttctatttctcatgttgagtgatgaagtctatgatcccttccacttgaaccttagcaactgcctcaatcattaagattaagattacagcagaaaagatgctatttgacttccagggctagagcataaaaaatcataggcatgtcctccttgctttctggagccactcactcttgcacaccagccaccatgtagtgaggaagtccaactagcccatgtgaagagaacacctggggaggccacatgcatacattttggctaactggctggctgaggtcccagctaacggtgagtattagaaggatcgcatgagcctgggaggtcgaggctgcagcgagccgtgttcgtgccactgcactccagcctgggcaacagagtgaccctgtctcaaaacataaaattaaattaaaaacaaataaaatactaatgtcctgatcccactcaaaaagtctgatttaatccgtatgaagtagggcctggcacgtttgacgaacaagcaaggaggcaggaatggctgcagcggagtaagcaatggcgagagggacgggagatgaggccattgaggctagggcaggtgtgtcctggcatgccaacgtgagggcttgggattttcatctaaagaaatggggagccatcacggggaccacttggctaaagtagcaaaaaaccaactcaaatcagtccaagaaaagtgggaagttattggcttttctaagtctagatagagctgatttaaagctcaacattatattatgtctctctctttctctcccccacttcaatgtccctctccctctccctctcaatgactttccatcttttggctcgttctccctatagacgagatttctcctcatggtataggagacagcccctggcagtccctgactcacttctttcagccccattattcaaaagccaagaccctgtctctcacagctctgtattaaagaacaaaaaacattctgaataggtgattggcttagctaaggtcacgtgcccatagctggaccaatccacatggccaggatattggggaactctgattggcctggtcacttgcccagtccttctacgggagtgagggagaaggcaggatgctgggactggaaattatcaggactgatgtgggtaaaagaaagtgaggccgggtgcagtggcttacgtctgtaatcccagcattttggaaggctgaggtgggtggattatctgaggtcaggggttcgagaccagcctgaccaacatggtgaaaccccatctctgctaaaaatacaaaattagctgggtgtggtagcacacacctgtagtcccagctacttgggaggctaaggcaggataatcgcttgaacccgggaggtggaggtttcagtaagccgagattgcgccactgcactccagcctgggcaacaagagtgaaactccgtctcaaaagaaaagaaaagaagagagagagggagagagagagagagagagagaaagaaagagagaaagaaagagaaagcgagaaagaaagagagagagagagagaaagaaagaaagaaagaaagaaagaaagaaagaaggaaagaaagaaagaaagagaaagaaaaagaatagaaaagagagaggagatgctcaacagtcaaaacaatccaggtttacggcatggtggtgtaaaattctactcttgctttgcccatttgattcacccatgtgtgtgatgggccgtagaggaatagtaacattttttttctttattcttatccctctactaactcgggcagaccagatagaacacttagagctccatagaaccttctcttcctctctcttctctcttcttttctcctttcttcactccttctctctctcaccccagtttattctcctgtctttgaatattgcctttctgagctaaaagaagaactaccatcaacccagcaatcccattactgggtgtatacccagacgaatataaagcattttaccataaagacacatacacgtgaatggtcactgcagcactgttcacgatagcaaagacatggaatcaacctaaatgcctgtcaatgacagactggataaagaaaatgtggtacatatacaccatggaatattatgcagccataaaaaagaacaagatcatggcttttgtgggaacatggatggagctggagcctatcatcctcagcaaactaacgcaggaacagaaaaccaaacaccacatgttcttacatataagtgggagctaaatgataagagcttacgaacagaaagaaggaaataacagacactggagtctacttgagtggggagggtgggaggaggaagaggagcagaaaagataactattggggactgagcttaatacctgggtgatgtaatgatatgtacaacaaacctctgtgacaaatctttatgtaacaaactttcacatgtatcctcaaacctaaaataaaaaaaaaatttaataataaaaaattaagaattaaaaaagatcacctttctctacttttctgcttttctttccaacaaacattcaaacaaatatggtttcctataacatttttttaacctcaaggttctaagtcaacagagcagaaagtggtcactcaaggacgcttgacatcacttcccagtctacatatccaaccctgaatgacaaatattggtgtccaatttcaaaattccaggagaaataatacaattgtcctggcttggttcagggaaccaaggtcccaaggtcttacggtccaccgtttttttcatcacaggtacaaaggcaaactctgataaactaagcagagaaacatatagttctattgaatcattggtagtcaatagcataccaactgctggccagataccaggctaaaagttttttcatgcttttttttttttttttttttttttgagacagagtcttgctctgtcgctcaggctagagtgcagtggcgcgatctcggctcactgcaatctccgcctcccaggttcaagcgattctcctgcctcagcctcctgagtagctgggattacaggcatgcaccaccacacctggctaatttttttatttttagtagagatggggtttaaccatgttggtcaggctggtctcaaactcctgacctcagataatccacccacctcggcctcccaaagtgctgggattacaggtgtgagccaccgcacccggcctcatgcattatttcattggtgcatcataattgccctataagttaggcactattattacccccattttacagatgagggagtcgaggctagggtggtcaagtgaacttgctcaaggtcacacaactaaaatgattttctgaataaagagcacttgttcttttttttaagagacagggtctcgctatgttgcccaggctggtctcgaactctcggactcaagcaatactcctgcctcggcttcccaaagtgctgggtttactggcgtgagccaccacgcctgacctcaagatcatttgttcttaaccaccatactctactgccacttaccacaccatggtgctgtgattatccccgcaaaagataggaggctaatgtaataaatgctctcaattgtgtgaacacactggactaccttactttacatgagaaaagtactggaaggagcaaatccaaagctagtgataaagaggaaagcagcccctgacagcagggaactggcctggtactgacaggtcaatctcggtgttttcctaaacataaacaatttcacagagcatcaatgttagacaaagccactctgtagtcatgatgaatcaggacagaaagaagactccgtaatcacacgtgaacacagacaaaacaggaacattgttcaagccacaaaatgccaaacatgaccttctcctggtgaatgcgagtaactagtgttcttcaccaatcatagttttagcctcgctctagtctgctttccctcccttccttatagataaaatttattgagagagtcaatggtaacattgcctctttcaggctgcacccatgccagtgcacatcccagcttgcttggactctccccaaaatcacacaaccaaagtccaattccataatgagtcctttccaacaccttccatggttccccatgtgtgtgtcctctcttgctgcaatgaacatgaaacacaacttgttcaatatgggtgtgttcctggaggtctttggctggagggcatcaatactgttcacttgtcaggggcctgttctgacagactcaagactgctctctctcccttgaccaaagagcttgaaaaccagtccttggtcctagaaggcagcgcaatgcaaacagaattccagtaaccagagacatccactaaacctcccctccacacatacacacataaggaaagtagagagggccatttctgcatcttgctctacagcagagtgaccccaacaccatagaatggatggaacccagtgagatgcacccaaggtgccacaccgcgttcctgcttgaagttgctccaattctttcccaaccccaaagttcttctctgtcactctgagctatacaattgtaggcccataacagttggacagctgagaaaaaaactcaaggctcaatttcatgcttcctgtaagactgtggtgaagttcaagttttccataaatgtaacaaaccttcacagattgaaaaggaaatggtttcccttatcctcttgtcctcaatctagttgcatgggactgactcagcatctcacgggggtgaaaatcaaggatcagtgtttcttaaagcacccccgagtgactctcctgtgcagccagggttgagaatcactactctagtcattcaactgatcgttgctgggcacgcactgggttccatgaactgtgttgtatgctggagacgctctggcaaataacacagatgcaattcctgtccttgagactctacactctagggggagagaaaagcaacaaataaacaaagaaacgtctaattatacattgtggtaagtgcaataaagaaaatttacagtgtgttagggtagagaacaacaggcagaactctttaggtaagaaaggaattaaaagcttcactaaaggggtgaaatgaggctgagagtggaggaataagagggaatgagcattgaggaagggaagtaagactgttctagaggctggttgtggtggctcatgcctgtaatcccagcactttgggaagccaaggtaggaggatctcctgagcccaggaatttgagaccagcccgagcaacatagcaagaccctgtctctacaaaaaaagttagctgggaggccgaggcaggtggatcacgaggtcaggagatggataccatcctggctaatatggtgaaacccatctctactaaaaatacaaaaaattagccaggcgtagtggcacatgcctgtagtcccagctactcaggaggctgacgcaggagaatagcttgaacccaggaggcagaggttacagtgagcagagatcacgccactgcactccagcctgggcaacaaagcaagactccgtctcaaaaaaaaaaaaaaaaaattagctgggagtggtggcacatgcctgtagtcctagctcgtcaggaggctgaggtaggagaatcacttgagcccagggaggttgaggctgcagtgagctatgatcacgtcactgcactccagcgtgagtgacagagtaagactctgtctcaaaacaagaagaaaaaaatgttctaggcagaaaaaaaacacacatgcaaaggccctaagatggaagagtatttgcaaagaagtgaaaggaggctgccatggcttaggtgagccaggagcaagtggcaggcatctgcttcctcgagctgccacacaaagtgccgctggcagggtggcttaaagtgactgaaatgtattttcttgcagttcaaaggctagaagttgaagatcaaggtgtcagcagggttggttccttctgagggctgtgagacaaggatctgttctgggctgctctctttggtttgtagaatgctgacttttccctatgtcttcacgtggtctgccttctgcttgtgtcggtgtatgcctttcttataaggatgccagtcatatcggattaaggcccagtcaaatgaaatcattttaacataagtacctccacagaggccctaactctaaagaaggtaggatttggaaggaaacaatgagggttaggacttagaatttggagggggttagggtgagggatacataattcagcccacagcatcatagtagggggatttggaacttatttaaagtggaataggattggagggttttaaatgagatggcatgtctgatttaaatgaatgctctgggccaggtgcagtggctcatgcctgtaaccccagcactttgggaggccaaggtgggtggatcacttgaggccaggagttcgagaccagcctaaccaacatggtgaaaccctgtctccactaaatatacaaaaattagctgggtgtggtggcacacacctgtaatcccagctactaaggaggctggggcatgagaatagtttgaacctgggaggcggaggttgcagtgggctgagatcacaccactgcactccagcctgggtgacagagcaaatgctctggctattgtgttggtagcagattggaggaaaacaagagtgggagggtgagacctctgagcgagttacttatgttcagatagcagtcctgtcctttacttgttatgtgaccctgggcacattacttgacctttctgagactcggtctccccgtctgtaaaattggaataattataatacctcacacacacatttgttgagagaattaatgaatcatccgtgtttagtatatactaactgcaaatgctagataaatgttaaatattattatattttagccatcttaggaagagacagcagtgcccgtgataggcagcctctaagtggcttccaaccctctcattctcgtatttatgcccttgtggaacctcctccctagagtgtgggctgaacctgatgacttgcttctaaggaatagaactggcaaaagtggtgagatgtcacttccaagatcaggttatcatattaggcagctcaggctgccaaaacaaaatatcacagactgggagattaaacaacaggcacttattttctcacagttctggagggtagaagtccaagatcaaggtaggacagcagggttggtttctggtgagggctctcttcctgccttgcagacggccaccttctcactgtgttctcacatggtctttcctatcatgtttcttcctcttcttgtaaggacacaggtcctatcagattagggccccacccttataacctggcttattttaagtatctctgaaagggccctgtctccaaatacaggcacattgggagtgagaacttcaacatgtggatttgggagattgggagagggctgcaattctgtccataaccgttaaaaaaaaaaaaaaaaaaaaaaaaaacctgtgagttctgtcttctttctctatgtagatatagacatatagatagataaaggcagagatagagatattttctcacaagcttgctttgatggaacaagcttccctgttgtcagggagaaccatctagcaggaaacagggcagcttctggccagcagccagcaatgaaaggaggccctcagcccaacaactctcaaggaactgaattctgccaatgaccacatgagcctggaagcagagcctctccaagttgaatcttgagataactgcagccttgtgggcaccgtgattgcagcctgtgagagcctctgagtagaggtcccagttaagctgtacctggatgcctgacccctagaaactgcgtgttgttttaagctactaagtttttgggtgctttgttatgccataatcaaaaacaaatacattagctagacatggtggcatgcacctgtagtcccagctatttgggaagctgaggaaggagaatcacttgagtccaggagttcagggtaagcctggacagcaaagtgagaccccatctctattgaaaagaaagagagaggaaaggtaggcagggaggcacaaagggaggggaggggaggggagggaagggaagggaagggaagggaagggaagggaagggaagggaaggggagaaaaaattttaaaaagtgagtaattcgcccaaattcacacagtaaatggcagagccaagaaaaataaaataaaaaaatgataacaggtcaggcatgttggctctcgcctgtagctccagtacttcgggaggccaaggaaggaggatctcttgtgcccaaaagttcgagaccaacctgggcaacatagggagatctccatgtctacaaaaaattttaaaaattagcaaggcatggtggcatgcacctgtagtcccggctacttgggaggctgaagtgggaggatcgcttgagcctgggaggtcaaggttgcaatgagctatgattatgccacttgcactccagcctgggcaacagagcgggacactgtctcaaatgaagaaaaaaaaagaaaaaaaatgatgataataatattaaggaaagacaaaaacaaagaatcctaccaagtctcttggattccagaaccaatgttaaaaaaatcatgaaaccaaagtaaactactgctatcctgaaacaatgataaataatccacagatcataaaaccagggactctggagcatgtacattaatataattgtatgtcccttagactgaagttctatcaaagcttaatgaccaaacaaattagctattggcattattttgcctccactaaaacctaagcagtagcagaagtacagatccacaattctaaaaacttcatcatgcgggctccttttataatagcaggtggttgtgattttcttgtttctcgtttccttttctctatcctttgggggagccatctgtaagtgtttggtttcaagtttcaaaaacaatctccatgaccttgaacaatgggttaaaagggttgtccacatgtgaactgaaaaaggaacaagttatagaaaaacattccaggccgggcatggtggctcacgcctgtaatcccagcactttgggaggctgaggcgggtggatcacccgaggtcaggagttcgagaccagcctggccaacgtggtgaaacccccgcctctactaaaaatacaaaaaattagctggacatggtggtgggtgcctgtaatcctagctactaggagggctgagacaggggaatcacttgaacccgggaggcggaggttgcagtgagctgagatcgcaccattgccctccggcctgggtgacaagagggaaactctgtctcagaaaaaaacaaaaacaaacaacaaaaaagaaaaaacaaagaacattccaaaagaaatttcttctgaccattttcttaggaaacatcagtgctgcaaattaatccttccatccaaagtcctgtcttctaacattttacatctgtatatgtgctttacatagttgttgaattgctctcatattcagtatgtcttggtatttcaatgcctccatttccttctctataaaaaaattttaaaaaagaagcaataaagtgcttattccagtacctgggctgcttgaatgatagcactgttgttaatcatattcaacattcattcattcaacaaacacctaggtagcagcatgagagccagttttctatcaattcatggtcctaaaatggaggatccagaatttccatgtatagcagcagcaacctagctagaaatagaagacaaggctgtcatctggaagtggtgatggggaagggcagctgacagatgcttaagaaggcttaaaccatcctgctgctgctgttgcttggtcttttcagaaaaggaaagcattggttgggtgccctggcttacatttgtaatcccaacacttcaagaggccgaggcaggaggatccactgaggccagagttcgagatcagcctgagcaaaatagtaaaaccttgggtctaaaaaaaaattttttttttcttaaattagccaggtatggtagaatgtacctatagtcccagctactccagaggctgaggtcagaggatcacttgagcctaggagttcaaggctgcagtatggtggaatcatgccagtgcactccagcctgggtgacagtgcaagactaaaaaatagaaggaaaaaagtaaagacaagcactgttaccaccattcgattgataagaaatttgaggctcgcatagctccagcgacttctcaaaattacaagactaggggccgggtgtggtggctcatgcttgtaatcccagcactttaggaggccaaggcaggtggatcacaaggtcaggagatcgagaccatcctggctaacacagtgaaaccccgtctctgctaaaaaaaatacaaaaaattagccgggcatggtggcatgcagctgtagtcccagctactcgggaggctgaggcaggagaatcgcttgaacccgggaggcagaggttgcagtgagttgagatcacgccactgcactccagcctgggtggcagagcaagactccgtctcagaaaaagaaaaaagaaaaaacaaattacaagactaggatatggaaaatcagaccccctagaaggcactgagctgccttggggcagagactttgctcgaagggtttaacactctatctccaaggcatagacacagtgcccaacacacagcaggtcttaggcaggttctgcaggagcaaagcctgaaacagggacttatgccctgctttattgagggagtgttcttgttaccggaaaggggtcccaatctagaccccaagagagcattcttggatctcatgcaagaaagaattcagggcgagtccacagagtaaagtaaaagcaagtttatttaaaaagaaaaggaataaaagaatggctgctccatgggcagagcagccccaagggctgctagttggctatttttatggttatttcttaatcatatgctaaaccagggatggattattcatgagtttgctaggaaaggggccaggaattcctggaactgagggttcctcttcctcttagagcatatagggtaatttctggacgttgccatggcatttgtaaactgtcatggcactagtgggagtgtcttttagcatgctaatgcattataattagcatataattagcagcaaggataacaagaggtcactatcgtcaccatgttggtttgggtgggttttgactggcttctttattgaatcccgttttatcagcagggtcttttatttatttatttttgagacagagtctcactctgtcgcccgggctggagtgcagtggcatgatctctgctcactgcaacctccgcctccctcgttcaagtgattctcttgcctcagcctcccaaagagctgggattacaggcgctcgccaccacgcccagctgatttttgtatttttagtagagatggggtttcaccatgttggtcacgctagtattgaactagctggtcttgacctgctgacctcaggtgatacacccacctcagcctcccaaagtgctgggattacaggtggaagccgcagcgcccggccatcggcagggtctttatgacttgtatcttgtcctgctgacctccaacctcttcctgtgactaaggatacctaacttcctgggaatgcggcccagcaaatctcagcttcatttcacccagctcatattaagatggagtcactctcgtttgaatacttctgacaccctcaggagaaagagagtgagggaagtgagatagaaaaggaaagtatatagattcagcaggagcctattctcagaccaactccacaaggagctctggggcatgaagccatcacagaattatccagcctgtatcaaggggccagctttacatatggcctctccattggcagggggctgcccctggggagggtgcaaaatgtaacctcccaggcattcctcagcaccatcagctgagcacaattccctggcagctgccttagactcctaagtgggatccaggtgggaaaccaatcgtatccgggacaatgctcaataaatatttgttggatgaatgactcataactagaacacaattctctactctctctatatcttttctctatacccaagagaggactttcaacccacaaacattttacagtcatcatctctaattcagagaccttgcccagcacaactaaacagcctggcaagagtcacatctgaccgtgtttaattaccactttggaggaggaaggacacgctgttgaggttttaagctacagactaatactttcacccatcatccaaggccaccacaaattaacagttgcattgggtttttgtctgacggctggacaaagccaattcatgtcaagggacctgagacataacataaaaagtcccctagaattttatctcctggagagagtatttgcttctcacattcttgtaccgcccctgggcggagaactcagcctagggactaatatacctttcacagaaaatcggtgttaaagcgggaatgtgtagtacaatcattcctggcaagagaaatcaagccaggtctttccaccttttttcttttaattacacccattctccattcagctctcaaatgtcctgccattctggtagagctgctagcagccctcatctaccactactctgttcttgctcttcatctcacaaacaaaagcagcccatatgagggaaagagaatttggcaagagaagggttacaatgtgatcctttccaaaaaaggagagatccatcccctctccaccctgctgccagagtgagctcctgctaatatgctaatattaacatcctgtttaaaacccttcaatctttggacaacatgtgcaatctttcatagggctcacaaggtttgatgtaggagggtttgcacctgctctccctccagccacattgactttctttcagttcctccagcctgccacaggatctttgcatatgctgaatgcactcacctccagctacttcttcagatcagagcttaaatgttatatcttgagctccctgtcccactcagatctgctctggttgtcacagcacattttcttcacggcacgtcacagttactatcgttttatgtgggtgttctccagcgcaggtgcaccagaagaaagctcttagtttgatgattatcaaatagctagctctacttctcagttagttcctggcatggagggaataaaggatacactctctcattttagagatgaggaaattgagctggataggaaacaatatttatctgaggtcacatggtttgttggttaattggctgatttttttaaagacaagattagctattttctcctgaaatattcaacccttttgcaaacatcctgtgttaccacctcagctctaaggactgctgtcttcctgatttactgctggccagggaagagtgtcctggaactcagtgaagaaccacatagaaacctcataaggaggtggggcgtggtggctcacgcctgtaatcccagcactttaggaggctgaggcaggtggatcacatgaggtcaggagctcgagactagcctggccaacatggcgaaaccccgtctctactaaaaatacaaaaaaattagccggcatgatggcgtgcgcctgtagtcccagctacttgggaggcagtggcacgagaatcgcttgaacctgggtggcaaaggttgcagtgagccgagatcacgccactgcactccagcctgggcgacacagcgagactccatctcagttaaaaaaaaagaagaaagaaagaaaaagaaacctccataagagctctgtagaccttgctgttttcatcaccaatctcttctagaagtgccttcttcaaactcctgaaactatcaaatttcccatccacgctctcccccggcatcacctcaaagcttatctttaaatcatataaaataaaacaatttatcaacatcatattaatgcctagcctttattcagcactgactgtaatgtgccaagccccatgctgagcatgttacacatcttaatccatgagctcctgtgctcaccaaggcaggccgggcagaggccattctctgggggaaggggagggcacagcatcctccctgaggtgacacagctgctgagtggcagctcctggctttacacccagcttggtctgacgtgaaagtccatggactaccccatcatgttactctgaggtgatcagttccagactgggacagagtcctttatcctctcagccacaggacttggtccccggctccatgaccgtcttccagaatgtacatgggccttcatgagccaagacatctgcatagagcaagcatcaaactagtatacaggaaatggggcaatgcaaagtctgacagactccatgtccttgttgaatatctctccacattgacacaaaatcacataaagagaatgtgttctgtgccaggcacggtggcttgcgcctgtaatctggcactttggaaggccgaggcaggcggatcacttgaggtcaggagtttgagaccagcctggccaacatggtgaaacccagtgtctactaaaaatacaaaaattagttgggcatagtggtgggcacttgtaatcccagctactcgggaggctgagccaggagaatggcatgaaccagggaggcagaggttgcagtgagccaagatcacaccactgcactccagcctgggcaacagagtgagactccatctcaaaaaaaaaaaacaaaaacaaaaaaacaaaaaaaaagatgagttccactgcttgtgattgtagatgattttgttctttgcttcttgtgtttttcagtttccgataatgcacatattaactttttttaaatgaaggttatttaaaaagaaaagaaaatgagccccaaacaaagggtacacatggacatatagagcggaataatagactagacactggagactccaaaaggtaggagagcgggaggggaatgagaagtgaaaaattacctattggatacaatgttcactattcgggtgatgtttaccctaaaatcccagaataggcatgtaagaaatcttcgcttgtaccccctaaatctataattttttttttttttgagacagtctcactctgttgcccaggctggagtgcagtggtacgacctcggctcactgcaacctctgcctcccgggttccagcgattctcctggctcagcctcccgagtagctgggattacaggcacctgccaccacgcccagctaatttttgtatttttggcagagacagggtttcactatgttggccagaatggtctaaaactcctgacctcaggtgatctgcccatctcggccttataaaacatttttaaatatatttttaaaaaagaaaatgagctccctctgtaaccagcactccaatcatcaaaaacagttggctttttgactgcctggcatacaatccagcttctcctttccatggcagtgcccattttcttttttgaagcttaaaaaaatatataatgggtgcagtggctcatgcctgtaatcccaacactttgggaggcagaggcgagtggatcacgtgaggtaggagttcgagaccagcctggccaacatggtgaaaccccctctctactaaaaatacaacaattcgccgggcacagtggcacaggcctgtaatcccagctactctggaggctgaggcatgagaatagcttgaacctgggaggcagaggttgcagtgagccaagatcatgccattgcactccagcccggccaacaagagtgaaacttcgtctcaaaaaaaaaaaattagctgggcatgtcagctcgggaggctgacgtgggaggattgcttgagcccaggagttcgaggttgcagtgcgccatgattgcaccccagaattccagcctggatgacagagtgaaaccctgcctcaaaaaaaaaaaaattcaaaacaaaagacaaaaacaaaaatcaaaatgcagatttggattctgtaggtccctgagggggacctgagcctctgcttttcttatgagctcccaggctggtgctgatgctgctggcccaggcactacactttgagtagcaagtgtctagcaaggcatacagtggttccagggctctctaagcacaaaagccgctcgtgcatcaccctcacagggccaggcccccatgcaggacagatgctgctttgggtcagtttgctcagaacatctgggccttcctacaatcacaagtcaccccctgtctccccactcagatggcaagaggtgttcccaggggcacagaaggaaacatactgtcactcagggccaccccagatgctccctcagcctcagatcgagtcagtctgagaccccctgagccaagttgctcccattcacccctccttgtccaatgcccaacccctgtgcactgagcctcctctcaaaataaactcacagagccccccacccccactttccattgcacctgaggcaattattacttgtcaaaaacaagaactgccagctgtgcgtagcattcagcttgctgttcttaaaatcccttataatcatttccctcggagaagaattctccagccccacaatggttctgcacagccaatcacagtgtagtcccggacccgtgttttgataagacaatctgacactgtcagtcagagggattcaagactcttgctgcagggaggagggagagaggaagaaaagaggagagagagagagagaaagcgtatgcctcttctccctctggaagtgcagctgactgcagagtctcccaggagcctgtccctgcagaggccttgacaaatgtcaacagacaggacgagatttctgcctctccaatacctgtaggccccatcccaccccagctatactcacactcatttcttgtttgtttgtcttcaagctccattcagagagaatggagatgtcttcttggtctaaattaaagttgaagcccggctgggtgcggtggctcatgcctgtaatctcaaaactttgggaggctgaggtgggcagatcacaaggtcaggagatcgagaccatcctggctaacacggtgaaaccccatctctattaaaaatacaaaaaattagcccaacatggtgtggcgggcgcctgtagtcccagctactcgggaggctgaggcaggagaatcccttgatctcgggaggtggaagttgcagtgagccgagatcacaccactgcactgcagcctgggtgacagagtgagactctgtctcaaaaacaaacaaacaaacaaaaaaaaaagttgaagccaagagggaaaagttggagggcacttggaggaacagggaggccctctatggcccaacctgcaagatggtcccaattattcttgcctccaggtattcatccccttgtgtggcatcccccaccatgcacagaccagggctagtctgcatcatgaatagaatagggttgtgcttgctctctccctctctctctctctctctctctctctctctctctctctcgggaaccagctgccatgttgcagagacattcaggccatcaatggcgaggttcgcatggggaggcacagcccccatgtgaaggaacttcggagcagagtctcctctggttgagtcccagtgtgacagcagctctagccaacagcctgacttgcagcctcatgagagatcctgagtcagaaccacccagctaagctgctcctgggttcctgacccgtagaagctgtgagataataggtatttattgttttcagctactgcatttggggtaactttttacacaacaatagatgatgaatacactatcccaaatcaatccacaaatttggtgtccccacaagtgtggggtgtgtctttcaattttttgagacagggtctcgctctgtcacacagactggagtgtagtggcacagttacagctcactgaaacctcaacttcctgggctcaagcaatcttcccacctcaccctccccagtagctgggaccacagatttgcaccaccgcagctggctgattttttaatttttgtagagactagatctcattgtgttgcccaggttggtctcaacctcctgggctcaagtaatactcccgcctaggcctctaaacacgctggaattacaggcatgagccaatgtgcccagcaagtatggggtctttctatggcaagatgtggtgcccatcactgtgagggacaaagataatattattaataataataggcctgtaatggtgcctcacacctgtactcccacctactcaggaggctaaagtgggaggattgcttgaccccaggaggttgaggctacagtgagccatgatcacaccactgcactccagcctgggcaacacagcaagacgctattccgaataataataacaataataataatatctaacattttaatagaccttacttggagccaggcatcattctaagcatattgcatgcatgaactcatttaaacctatagccatctattattattcctgtcatgctcatcagccagaagccaccagaaacacacctgtagttgaacagaaatgggtttagtaacctgttgcaacaaggaagaccacacaccatggggagtgggagctgtgtcccagtaagagtgtgttggggcgcttctggttagctggcagaaagcagtgttaattccatggctgggcatcatcataatttttatgtaggaggcaggaggaatagagtggggctaaagctgtcattggaaaaccagcagtaactgcatgtgtcagtcagaaggagaggatgcgtttggccatttttttgtggtttgcccactgctcatactttcatgctcagataggattcattacagactgtcttgtttttgtcttgtttcatcatggtcagcatgacatcttccagtgtgaccatcctatgaaattgcttaagtagggaacaccacagcctagcagtagtaccaggccagctactagctgacaacgatcaagactgggctcccggccgggcacagtggctcacgcctgtaatcccagcactttgggagctccaggtgggcggatcacttgaggtcaggagttcaagaccagcctggccaacatggtgaaaccacatctctactaaaagtgcaaaaattagccgggcatgatggcacaagactgtaatcccagctactcaggaggctgaggcacgagaatcgcttgaacccaggaggtggaggtggtagtgagccaagatcgcgccactgcatgatccaccctgagcaacagagccagactctgtctcaaaaataaaataaaatgaagactgagctttccttttcttatcctcattttatagatggaaaatctgaggccaaaataagttcagtagttatgttgccaagcctgggcggaactgtagagcttctcagactgtcagggctgcagggccagctttgctttgtcttcttttgtttgccaatccatcgtgggccaatacgttcataaaatacaataaaagcaaattactagaataacgatcatgcattcagatgttttaggaatgttaaattgctatccttctaaacaggtaccctcaagttctgtcttatctggtctcagacaaggaacagttctcaggccattactgaccacagaccacactttgggcagctttagaagttgtctgatcaagagttttccaggttgggcatgatagctcacacctctaatcccatcacttttgggaggccgaggcgggcagatcacttgaggtcaggagttcgagaccagcctggccaacaatgtgaaaccacatctctactaaaaatgcaaaaattagctggacatggtggcaggtgtccgtaatcccagctacttgggaggctggagaatcgcttgaacctgggaggcagaggttgcagtgagccaagatcgtgccactgcactccagcctgagtgacagagactgtccaaaaaaaaaaaaaaaagaggtttccaaacttcatgcattggtacatcttcatttttgccatttctattgaacacctctactattatttacttaatattatcttgaaatatcctcatctcatatcacctcacacccattatgatggccacaattaaaaaaaaacagaaaataacaagtgttggcgaggacgtgaagaattggaacttctgtgcacagttggtgggaatgaaaatggtgcagttgctacaggaaaacggtatggaaactcctcaaaaagttaaaaatagaaataccatatgatccagaaattccatttctgggtatatatcccaaaaatttgaaagcaggatttcaaagaaatatttgcacacccatgttcattgcagggttattcacaataatcaagaggtgaaagcaacccaaatgcccattggcaaatgaagggataacgaaaatctgatatctacgtacgatggaatgttattcagcctttaaaaagagggatatttggccaggcacagtggctcacgcctgtaatcccagcactttgggaggctgaggcgggccaattgctggagctcaggagtttgagaccagcctgggcaacatggcgagaccatgtgttgcatcatttagaaacatttatagctacaaaagcttcagagatcttgtatttcaatgtacaaacaaactgccaaatgccaaaaaaaaaaaaaaagccaggcatggtggtgtgtgcctatagtaccagctactcaggaggctgaggtgggagtatcacttgagtcgagggagcagaagttgcagtgaaccgagatgatgccactgcactccagcctgggtgacagcgtgagaccctgtctttaaaaaaaaaaaaaaaaaaagagagagagagggaaatcttgtggggtgctgcaccatagacaaacctcgacgactttatgtgataagccagtcacaaaaggacaaataccgaacaattccactccaatgaggtatctcaagtagtcaaactcctagaaacagaaagtagaatcatggttgccaagggctggaggtatttagtgtttaatgggtctagagtttccgttttgcaagatgaaatacttctacagatctattgcacaacgtgaatacacttaacacaactgaactgtacattataaaatggtgaagatggtaagtacaatgtcatgtccttttcagcacagttataaaaagaagaaaagtcctcatcctaggcaataataacccatattatgtattaagatggctagttctatatgttttcttttatttttttaagagatagggtcttgctatattgcccaggctggtccggaacacctggactcaagcaattctcccacctcggcctcccaaagtgctaagattacaggtgtgagccatcacacccagctgagttctatatattttcttatctgcattaacataaatgtttaactgttaaataataaaatgtttttttccatgaacgaccgaaaatcgttttgtgtaaacattgatctttgaacctcctgtttcttcaatgcctatcatctgaggcctgacaagagaagggacttagaaccactcccagccttcaaggagtttgcaattacactgaagggtgaagacactctccccccagaaggaaggcgggaaaatcttaaaagaaatctatctgttccttgaaggccagctctgtgtgttcagtgctctctcccaagtccctagcacatgccttgcccacagtggggtctcaacaggtatttgctagagtctatcaaattaagagaaacacgaaacaggcccggtgcagtggctcacacctggaatcctagcactttgagaggccgaggcgggtggactgcttgagctcaggagtttgagactagcctgggcaacatggtgaaaccccatctctacaaaaaattacaaaaattagttgggcgtggtgactcatgcctgtagtccctgccacttagtgggctgaggtgggaggattgcttgagcccgggaagcagaggttgcagccagctctgatcgtgccactgcacttcagcctgggtgacagagtgagactttgtctccaaaaaaaaaaaaaaaaaaaaagagagagagagagagagaaatactaaataagcagcacaaaccaatggggtactaggccagggctcccaacttgaggtttgtgggtagaattcagagggtccataaacctgcctcattttctctgattgctaactaaaatttagcatttccttctattataaatggaagcaacaaaccacagtagtatttgcaatatctgtgatttttgtcaccgatataaatcacgatattttcatatctcattacaatcatagcagacatctcattatattgtacgtgtgcatcactaattggaattacatagttattagactcaccactaaatcttgttatttgatgcattagtaaagattcacatattactatgacacaaatttggtgagtttttttatattttgataaccatattttagtataattggtttcctttgtaattccatgcactttattttttgcatagataaataatttaaacaatattacaaagaacaatcaatcaaatctagtatagaatatttcatagcctaaataacattttcccaaaactgaatggaccaaaaataaaaagtgctaatggttaaatattgttttggagttagaaagatttatatatataaaaaaggaaatatgtgaattttgggccttaatttaaacaaacaaactgccaaagggaatctttaaggcaatagggaaaatttgagtataactagtatgatgatacttaagctatagttgtctaatatgaagattactaagtagaagaagttatataatatgtttactagcagatttataattgtaaacatatttacctataggttgagataaacgtctgacaccaagaagatctcagtttaaataaaataagggcatgcaataatactttaaaaaaagtaagttatattgagaacaagttatgttattcagtttgagttgaatagaagatcaatattagtaggcatatttaggtttgttgcccagaaagctaatgtaatcatccattaataaacatatcttctccaaaaaaaaaaaaaaaaaaaaaggatattgttctcagaaggaggtcatagactccgccagatgccaaaagggtacatggtaccaaaaagaggtcagggtccagcgtggggttaattcagtgggtaactgactgggcctaagaagaaacagactgaaccaaggacaagcccactgttaccaccttttaggagggaaacactaacttaccatcggaaagaacggtgaattcaccggctaacatttgtgtgcagaaatcccctgacaaccgcaggattcaatgttcctaaaaacatatgttcattggcaagatcgaggtctcagaggaaattcagtgttgagcactaagtgatctcacatctgctgggttcaaagcatggactctggagccagactctctctgtttgtatccaagctccaccagttaggacctgtgtgaatttggatgagttatttcccctcgatgtatctcagtttccttgtctgtaaaacaggaaccaaagagcctagtggtggctggcagaataatgtcccttcagagatgtctgtgtcctaattcctggaacctatgaatatgttagattctacagcaaaagggaatcaaagttgcagatggaatcaatgttgaccttaaaaccaggaggttgtgcaggtagaaccgatgtaatcaaaagggtccttaagtgtggaagagggaggaagaagagaatcagagagagatttaaagatgttatgctagtagctctgaatatggagaaagaggccacaagccaaggactgcaggtggtctctagaatttggaagaggcaaaggttctccccagagcctccagaaataatgcagccctgtcaatgccttgatattaaccaagtgagacctctttgggacttctgacctccaacactgtaagataataatttggattgttccaagccactaagtttgtggcaatttgttacagcagcaataggaaatgaatacacagttttaaagatttttgtgaggatcaataaatgcattcatttatgtaaagcccttagaacagttcctggcacataattggtgcaatataccattaattttatagaaatggtgaataaaaattagagaattaatcacttccaaaataaactggatccactcaagtcaaagccttgctctgttttgcaacccttaatgaattcatggatctaggcattatcatacagcagatagataacatcacaaatgaggctgggcatggtagctcatgcctgtagtcccagcaaattaggaggccaaagtgggaggatcacttgagcccaggagttccagaccagcctaggcaacacagtgagaccccatcactacaaattagttttgtaaaaaactaaccgggtatgttagtgcatgcctgtggtgccagctactcaggaggctgaggtaagatgactacttgagcctgcaaggtcaaagctgcagtgagccatgatcatgccactgcactccagcctgggcaactgagcaagacaccatctcaaaaattaaataaataaataataaaaataattttaaaaaataaaaacacaatgggagataaccagacatcagttacctcctcatggaaaaacataacaatctaaaaagtggtcttgctaaaaaaaaaaaaaaaagaaaaagaaaaaatcagacctaaatctgataaaaatgtatagatacaacttatcaacttacagaaatgtggacaatgggccaggcacggtggctcccacctgtaatcccagcacttcgggaggctgaggtgggtggatcacaaggtcaggagtttgaaaccagcttggctaagagaccagcctggccaataaggtgaaaccccgtctctactaaaaatacaaaaattagcggggcgtggtggtgggtgcctgtaatcccagctacttgggaggctgaggcaggagaattgcttgaacccgggaggcagcggttgcagtgagccgaagatcacaccattgcactccagcatgggtgacagagtgagactccaactcaaacaaaaaagaaagaaagagagaggaaaaaaggaaggaaggaaggaaggaaggaaggaaggaaggaaggaaggaaggaagggagggagggagggagggagggagggagggtaggggagggagggagggaaggaaggaagggaggaaggagggaaggaaggaaggaaaagaaagaaggaaggagggaaggaaggaagggagggagggagggagggagggaggaatgaaagaaagaaagacagaaaggaaggaagagaaaaagaaagaaagaaagaaagaaaaagaaagaaagaaaagaaagaaaagtggaagatgaaggaatgcactaaaggacaccacagagatgcaactggcaatgtctagactgcgggggactctacagcagtgcttctcaaacttaattgtgcatacaaaacacccagggaccttgtgaaaatgtagtttctaacccaggaggtctgggatgggatctgagatgctgcatttctaccgagttcccaggtgatgctgatgatcctggttcactgaccacattttgaattacacaagatgaataacctatttttccagcaataaaagaactgaaggggaaacctatagattaaaagacacatgagccaatcactatgtgtaggactttagttggattctgattcaaagaaattattattaaaatgtattaggcagagccgggagtggtggcttatgcctgtaatcccagcactttgggaggccaaggcgggcggcagatcacttgaggccaagagttcaagaccatcctgaccatatggcaaaaccttgtctttactaaaaatacaaaaactagactagccaggtgtggcggcatgcacctgtaatcccagctactggggaggctgaggcacgagaatgacttgaacccaggggaaagaggttgcagtgagccgagattgtgccactgcacttcagcctgggtgagagagcttactgcagcactatttacaatagcaaagacttggaaccaacctaaatgcccatcaatgatagactagttaaagaaaatgtggcacatatacactatgaaatactatgcagacataaaaaagaatgagttcgtgtcctttgcagggacatggatgaagctggaaaccatcattctcagcaaactaacacaggaacagaaaaccaaacaccacatattctcactcataagtgggagttgaacaatgaaaacacatggacgcagggaggggaacatcacataccggggcctgttggggggtgggggtcaaggggagggagagcattaggacaaatatctaatgcatgctgggcttaaaacctagatgacgggttgataggtgcagcaaaccaccacggcacttgcatacctacgtaacaaacccgcacattctgcacatgtacccaagaacttaaagtaaaataaaaataaaaaagaaagaaaaaattgtattaggcagtaagtaacctgaacggtgactggatagttgatgttctaaggaatcattgttaatgttttgggtgcactgatggtattgtgcctatgtttttaagagtttatcttttcaagatacacattgtaatatttacagatgaaatggtagtgactggaattggcttcaaaataatgtatgtggggaaaacaggtagaggtataagcaaaactgggcatgagttgtccattgttgaagccaggtagtgagtcctgagaattcattgtgctattcttctactttcatatacctttggaatttcccatcataaaattatttttaagacatatttcttaaaatcttctctgctagctaatccttctcttgaaccacattcttcaaaggttctcctgcggcccataagttataaagagctcataagttataaagagtctgtgacttttagcagttacagacttgaaatctcatgtttttcatgctggcattccctctggtttcctttttgcaagtctcagcaaaatactttgtgtacccacctaattatcacagtccttaaggcacgtaccccttgacccagtcttctgtctgttaccgggatgtttctggcacctgaaatgcttttctgcagaactgctcatggcagctcctccctccccttctgttcaattggccctgctcagaggggcctccactgaccactcaatataagcagacatcccagtgtctctctgtggcaatgcctcagggcactctcagcatctgagatgatcttgttcatttattcatccgctttattttctccttcttcacacaacactccctcattctccccttataatgtattcaacaggaagacagggaccttgcctgttcattgctgcagactcagaatgtaacacactagcaggcacagcacagaatgagtgagtaaatgaatgctatagctgtgtgcatagctccatagacctagaaaatcaactgcattcttgctaagaggcatatacacatccatatatctggatcacacgtttgcagtctttctcatcaaatcatggaccaatggagctgcacatcccaggccaatagagctctatagcccatttctttcaagagaagagtagctccctgcgaactttcattggacacctgagctcttgactcacaataattggtcacaagaaggtctctgtgcaaatcagagatggtgggactcaaaatgtctgtggtcacagatccaaatgcactactccattatttagaaggccctcaatacccacctaacaaaccctatgccagggtctaatcaaagaaccgggtactgcattgaaagttgggatttggactggtctattggaaaagaagggttttcagatagaggcttcactctgtatttcagcttcatcagctatgggctggaaaatggttatagtgtcctggagactaatgaacgtggatttgaatctctgcttctcctttattagctgtgtgaccttagctaagtgatatcacttctatgatcctcggtggcatttatataatgggaataacaataatgatatctaccttgtagatttgttgtgaaaattaaatgagatgatagaaataaatatttcatctagtgcctggcatagagcaaatgtaataaaatttatctattactactactgctgctgctactgctaccactatcttctgatcttggaagagtcacttaattcctccaattctcagtagactcttctctaagaagaaataacaatgtcctagatccacagaaagtctggtgcttctctcccttattttctttagttctctgctcagataccacttttgcaaagagagcttccctgaccagtgtccccctcccacataaaatagtccacactctctccatctcattactcagcttggtttttcctcctaggacatatccgcctgatttgtacttacctgtttaatgtctgtcttgtcttccttgtcagaaagtcagccccaagagagaagaggctttgtccattgtgttcaatgcttattcctggggcccagaacaatgtctggcatataaagacactcaatgaatatttcttgtggaatgaatgaatgaatgaatgaatgaatgaaattaggtaacttgggaccataactatccagtccctgcattgctgttcaatagatattagcttccttccttccctccttccttccttccttccatccttccaaggccagaaaaaagaacaataagtgagagaaaaacgcctatcggcctcttttttccctgcttctcctccaagcatcatgcaaacaatcaaaacaaaaatgcagcagcaggtgccaagaagtcaggtgcatccttcatccccagtcagtctttcctggctctgaaatgtttgcaggagcaaggtgcccccgaggcacactgctttaaatgagtccaggcaggatttagacagctgctctgtaaccccaataaacgatgtctgtctaactttacgcaggggcactgagggttagggttgtatggctcttggggtctctgaagtagaaaatcaatgggtttgatgtatggccccatttatggcacctgaaacagaacatccactaccaggtcggctaccatcaaacctctcctaatataacaatacaagccatctctgagccttgaaaacctctttacaaagccagtggtcaaagagtagaaccgtctttttcaacagcaatcagtgaagatgatcatgtcactctcctgtggccaaccctcccctggcttctgatcgcactaggaatgaagtgcaaactcttctcccaggatctcaccaggtcagcacagcctggcctcacgtgtctcttcaccatctcagaccattctcctgtcttgctccactccaactgcattcatctctgtgttcccaggcacgtgccaccacacctggctaatttttttttttttttcttggtggaaacagattctcaacatgctgctcaggctgatctcaaattcctggtctcaagtgatcctcctgcctcagcctcccaaagtgcaaggattaaaggcatgagccactgtgcccagctgcattttattttatttgattttattattattattatttttgagatggagtttcactcttgttgcccatgctgtggtacaatctcggctcaccacaacctccacctcccgagttcaagtgattctcctgcctcagcctcctgagtagctgggattacaggcatgcgccaccacacccggctaattttttatttttaatagagacagggtttctccatgttggtcaggctggtctcaaacttccaatctcaggtgatctgcccacctcggcctcccaaaatgctgagattataggcatgagccgccatgcccagcctgcatttcatttttctaagacaaaaatattctggagatggatggtggtgatggttgcccaacaatatgaatgcacttaataccactgaactgtacgcttaaaagtggttccaatggtaaatattatattatttgtgttttaccacaataaaaatgtgttttaaaaaaggaagaaattctgaaacatgttacaacatggatgaaacttaaagatattatgctgagtgaaataagccagttacaaaaagacaaatatcatatgattccacttatatgaggtatctagagcagctgaattcatagagaaagagaatagaacagtggttgcccagggatggggaaatggaggcatagggaattggtgtttaataaggacagagtttcagtttgagatgatgagaagcgtctgaagatggatggtggtgatggttgcccaacaatgtgaatgtacttaatgccacttaattgtacacttaaaattgtacacttcaaaatggttaaaatgggcctggcgcagtggctcacgcctgtaatgccagcactttgggaggccgaggtggacggatcatgaggtcaggagattgtgaccatcctggccaacatgctgaaaccccgtctctactaaaaatacaaaaattagctgggcatggtggcgcatgcctgtaatccaagctactcaggaggctgaggcaggagaattgcttgaaaccgggaggtggagtttgcagtgagtcaagatggcaccactgcactccagcctggcaacagagtgagactccatctcaaaaaaaaaaaaaaaaaaaaaggttaaaatggtaagttttatattaccctatatttttatcacgattaaaaaaaaaaatcacactatcccaggctggacacagtggctcatgcctgtaatcccagcactttgggaggtttgggaggtcaagacagatgggtcatttaaggccaggagttcaagaccagcctgaccaacataacaaaaccccatctctactaaaaatcttttaaaaagctagtcagatgtggtggtgcacacctgtagtcccagctattcaggaggatgaagcacgagaattgcttgaacctaggaggcagaggttacagtgagctgagattgtaccactgcactccaaccgggacaacacagcaagagactctgtctcaaaaaaaaatttttttaatcatgctacctagcccaggcaacacagtgagacctgtctctacagaaaaataaaacaattcgctaaatgtatgctactctcagctactcaggagtttgaagtgagaggattgctggagcatgggaggcagaggtggcagtgagccaagtacctctgcactccagcctgggcgacagagatcctacctcaaaaataaaaatcgcagtacaaaaacaattttaagaggaggggtgtagagtattttatccaaaggcatgagataaactagctcattgatccattttctttctttgtcctgggtgatctctgagcctcacctagtaagagttaatatttatgccaggcaccattataagcacttcgccagtgtttccttcatttaatcctctctaccgtcctacaagatggggagcctaatcatctccatttaaaggatgagaaaacagaggcccagagaggtttcgtgacttaacctacaaagtctgactccagagtctaggcaattttccagaccacttttcccacaagacttgacctcaccctttgatattcaaaataggctcctcagatctacataaaatattctaaagtatcaggaatgtataagtcaggttaaggagaataaacttttttttctgtattcaccccatctttgttgaaaaagtgctgttactggcttcaaggcctgcaggctacattgcttaacacaggtgtactaagttaaagttcagcaaacttctgtaaaactccataaaaattaatctttgaggctttaggggcagatggcgtatgttgcaactacttgactctgccgttgtcgcacagaagcagtcatagacgagaagtaaatgaatggccttgaccgtgtgccaataaaactttatttacaacaacaggcactgggtttggtggctcctgaaagggttaaacacagaattgccatatgacccggcaactcccctcttaggcatgggccgaaaataattacaaataggagttcaaacaaaaacttgtacacaaatgttcacagcagccctatttatagtagctaaaaggtggagacaatccaaagatcaatcaactgaaaaatggatgcacaaaatgtggcatatgcatccaatggaatagtattcagccatgaataggaagtatggacgcatactgccaggtggataaacctggagaacaatatgctaaatgaaagaagcagacacaaaaggcaacgtaggccgggcatggtggctcacgcctgtgatcccagcactttgggaggttgagtcgggtggatcacctgaggtcaggagttcaagaccagcctgaccaacatggcaaaaccctgcctctactaaaaatacaaaaattagctaggtgtggtggcgcatgcctgtaatccccactactggggaggctaaggcaggagaatcacttaacccaggaggcagaggttgcagtgagccgagatcgcaccactgcactccagcctgggcgacggagcgagactccgtctcaaaaaataaataaatgaataaaagaccatgcaatgcatgactctccattgatataaattgtccagaataggcaaatccacagacacagaaggtagcttggtggttgccgaggactgaggagaagaaaattgagaacacctgctcaacagttatgggctttctttttggagtgatgaaaatgttctggaactaagcagatgtgatggttacagaatattggaaatgtggccaggcatggtggcgcacacctacaatcccagcattttgggaggccgaagcaggtggattgcttgagcccaggagttcaagaccagcctgggccacatggtaaaaccctgactctacaaaatactctactaaaaggtggagacaatccacctttgttcaaaataaaataaaatataaattaataatacaaaaattagttgggagtggtgacacatgcctataggcccagctactcaggaggctaaggtgggaggatcgcttgagcccaggatgtcgaggctgtagtgagccaagatcacattactgcattccaatctgggcgacagagtcaaattgtctcaaaaaaaaaaaaaaagtgaatgtcctaaatgccactgaattgtatgtttttaaatggttaactttacgttgtgtgaattttctctcaattttaaaaaatgttttaaaaaaacaggtggctgattgcttttggcacacagaccaaagtttgttgccccctattctaagccaaacagccaagaaggggagaaacagaagcatactatgacctatatgcaaaatattcaaagccattcatttaccagtgcttggggaagaagcgcgtatcgtatgcagtcttatacctccctgaaattaacatcaggcaccacccttggacctgagaagataggaaagctcctaggactcggtgcccacactgaagcctgaatcagggaggagagggcatttcatttacagcacatgctatagcttgaggtgaggtggcacagtctctctgcaaaaccaaaacaagtttaatacgatcagactgcagaaggagatggagtgaggagagataaagccagatgaggaaataagggtcatggcattaagacatgataagaaatctggattttatcctgagcgcaatgggaagcctatcaaggtttttcagcaaaggaggtggaaagccagacttgctttttagaaacatgattctcagtgtatccagataatggattgggagagagagatgctagaaaccaggagaggttttgcagaaaatcttgagtggcttacggtgcacaaataaagcttcaagacaactcaggaaagttggcctaaggcaggaggctcgcttgaacccagaagtctgaggcagcagtgagccatgatagtaccaatgcactccagcctggatgtcagagcaagacgctgcctctaaaaaaactttaaaaattaaaaattaaaaaagttggcctattgaaggttttccacctctgacagactcctctttcaaacaggagaataaagaaacttctttatttttccaaaaaaaaaaaaaaaatccaataaggacctcataaggggtccagctgccaagcataggagttgagcagagcaaaaatgacagggaaataaaacataaaatgagaatctatttcgcacttttaaccgaggccaatagatagaaaagagcttgcagttttccatgaataacaactgatgcaggcaataatgctaattattattattacgtatgttaataatgatattcaattgaactgcttaaacagaggatgcctcggagggcaaagatagtctaaggaattccattatgaaaatttcattttcagcccatagcctccttaatatcactaattaatattctttccctaaacaaatgcgggtggaggaggttggcaaagtacagaagtagcacttatcacaggaaacggtagagaataaacaggataaaaggactgaggtcacatttgtgattattatcataataaaatgcttcggaggaacgacttggcaaagcttacctgcaccatatgcctggcagactagcagcttcaaaacaatcgcaaaattaaaacaagtcttagggtcagttgctgagtttaaacattaggaaaacacttattttcctccagtaaccaacacatggcaggtttttgtattctgggttttggggattcggttttggttttgttttttcattagcttggttttgattgtatgtttgctttacatgctggcatttaattctgtaaccaggtttcctctgtctcgttcacaatctttttcaaatatacacctgagagcagcggattcctggtgccgctgaggcagtgactcacaggagttaaaagtgtgagctctagagtctgtggaatgtgttcaacttctgattctgctctttaaccagctatggccttaatcgctccatgcttccatttcctcatctataaaatgggtatgacaggaccatctaaccttgtaggattttaaaggataattgtgctgagacaatttagcctggcacttgacatacatttcagtaagtggtagttattatggaattattatgctgcatcccttcccctgcccacattgacaaataacccacactaaatcagatcctacacctagaccactggctttcaacaaatgtgttttttgtatatgaaagaatacatgatcctggcaactattctggtcacttcaaatcctcacccagcttttggaaccatcttactttcactagtgtaaataataagtgggtggtcctgtgtgtcaatcatataagtcccatgtcacagagagagagagagagagagagagattaaatctctggaaagggacaaagatggaacagagcctcagaccattaacctagagagcaggggtcagagggaagggaaaatgtcaatcatttcttaagtgtgctctgggaagaaagtttaaaatatagatagtaaaggattctttggggctttagggcaacagtaaatgttgccattcattactaataataaccattataataaccaccacccatcacgtgtttactatgtgccaggtatttctttggcttagtgctttaaatacattatctcatttaatcgtcatgacagtactatcaggtctagatttattatattctctatcttattttaaggaaattggaagcctagagatgatgagtaattttcccagattatccgcctgggtgtctggttctaaaaacccaagtatttaaccactatgctatatcacctctcaagtaaatagagacctttagacaaacatcgtgagagtatcacctatattagtttcctaggacttctataaaaacaaagaccacaaattaggtgacttgaacaacagaaatgtattgtttcacagttctagaggctaggagtctgagatcaaagtactggcagggtaggttccttttttttttttttttttttttttttttgagacggagtctcattctgtcacccaggctggagtgcaatggtgtgatctcactgcaacctccacctcccaggttcaagcgattctcctgcctcagcctcccaagtagctgggattacaggtgcgtgccaccatgcccggctaattttgtatttttagtagagacatggtttcaccatgttggccaggctggtcttgagctgacctcaggtgatccgcccgccttggcctcccaaagtgctgagattacaggcgcgagccacagcgcccggccggatagtttccttctgtgggctgtgagaaagaatccgtcccgtgcctctctcatagctttggtggtttgttggcaatttggggcatttcttggcttctagacctctgccttaatctccatgtggagttcttttgtgtgcgtctgtctccaaattccctcttttaatgaagacaacaatcatattgaattagggccccagcctactccagtacaacctcatcttcactaattatatccccaagaaacctattttcaaagaaggtcacattctgaggtactgggggatagaatttccacatacaaatttgggtagatataattcaacccataacctcactcataagcatttgtctctgctgattattccttcatcttccaacccaggggcacaggggagggggcagggaggagcccagggtctccacacacgcacttgctgcaagacataactcttcatttcaaaccccacagtgccgtttgtcctacatgagaaaggagagttgaaaagggatacagtgcaaaagatgtcaaacccaagataaatgtttcctcagatgcaatgacttccagagatttggagtcgtaagtttttgaaaaatggacacatgaggaacaaaggttgagttttctgaaatcattgataacccccaagacaacacccagctttctcccatgattataaatggggggatttgaaatggaacttctattgtgtggctttcaaagcccacgatggcccaggagtagtgaatcatttctaaggtaaagcacttcctctgaactcaggggaagcagaagtaggcagataagaaatggtaatgcaggaggcagatttatgaacaacctgaaatgtgaacattttttttcatattccataagatggaccagtcctgtggcccatgtgggagtataagattaaacaccaaaaataaaatgtcttagcatttcccaaattcacacaggcaatgtcacataggcccctccccagtaaacaatagacatgatgtaaaatgcagattcttttgtctggcaatgaacataagcagatgaacatttgttcattctttcaacaattgcttcctgagtgactgtcatatgctgggctctgtcccaggtgctgaaaataaatatctcgagtagggtttacagattaggtggataccaaactctgaataattaaatcatagctctacaaaggaattcagggcagtcatttatgcagacagaagaatggaaagggagatagaggaaagtgcatcttgtgtatttctatcaggtgttatctaatgaattcctcacagcatcctttcaagatggtgtctttcctgcaaaccattattattaatctcattgttaccattctgtggcaaccctcagtgactgaatttctcctcttttggtctagcatatataccactaggaactatcattttgcttttgagctcctcctatctagctgaagacaaagttattcaaggaagaagctagctccctgccttggagaaacagtcttgaagaaaccatagatgtatgaaaagactatttccattaacaaagggaataagatcaggaaatatttttgatcttactatatgacctaagcatatatcccagagaaattttttaaaaagtactcaaacaaatacttgtacatgaatgatcctggtagctctattcacaatagccaaaagatggaaagagctcaaatgtccataaatggaagactggataaatacattgtggtataatacatacatacaattaactattacttagccataagaaactaatatatgctacaatggggatgaacctcaaaagtattataagtgtaagaagacataaaaggtgtataattccatgtatatgaaatatccagaataggtatatccacaaatgcagaaagcaggttggtagtacccctttctggggaaagagaaaaatgaagagtaactgtttaatgggtacaggtttttatttgggggtgatgaagctattttggaaaaaggcagaggtggtcatataacactgtgaaggtactaaatgccactaatttgttcaccttaaaatgatcaattttgtcatgtgaatttaacctctataacacagggtacttcaaaaaatagaccttcaataaatgtttgtagaatgaatgaacaataaacaaaggaatgtatgtggtcttggcaaacggctcatactgaaaggtggtctatgaaaagagactttgtaagtggagatggtgttgaccagcagagtctaaaatgattcttagtggccttggctcggttttattattctgttcatggagaacaggaatcagagcctagggttctatccaggaggaaaaaaatcttcctgtcttggaattttcagaacctagtgtcttcctacatagcaaaagacatttctggctgccaggagggagtaaagccagtgggagttagtcccatctgcctgcagagaggcagaaacattatctgtctaaattcttcttcatcagaaagtcttatggctgggggcgcttcccagctctcattgtgacctagccttaggaccacattaaagagcactaccatgccgcagagagggggttggagggaggagactggctgccagactgaaactaaattaaaaataaagctccccttattaaattcataattattgtgaagctgtgaaatcttattttaaacctctggctcctttctttgtccagagtagaggctgcctgcttctgaatccctattttgctttatggacaatttctttttagcattctgagcatttaaccttgaaaaatagtgttgttttgctgctgtattttctgattgttagtctccaggcatctccatggcatctttataaatctgcaggagctggtaaatatttcttgccgaccagccgctgaaatctgaaaataccagctcactttttagctgtcaggcaattaatgtaattcaaaggaaatgaaaggtgtgggcaactgggactgcttttaataacaggagggttcctggctcaggcttagaaacacaagagagaagaatcaataaaagactaacagaaagggtagaagagggcgtggagttctctagaaacattttgtcagcatcctggcaatgctgcaaatctgtgccaagagaaactgataaatgcagctactgatgatcgacttggagatgagtcaaacttcgaggcctgggccagggcatccactggcctaaagggtgcctttgtgtaaaatgggaaacgataccccatctgggtagctgaattaggagaaagtgctccctgagtatagatgcagccccacgccaaggcacacagcttggtgggcagagtgctactggatttcagccttcttcctccaaatttattcttatggccagcagccttcgtgcagcgtacaaactgaacatcgctatccagatcaattcccacttccctgtttcttggataatattggttttccattcttccctgctaagtcaggaatcaactacattggctttggaccccaaaggtgatttaagtgtagttggattcataggaggagatagactatggagaaggaggaggagctctcacatatggcaatgctattttgtttctcaaagacaacaggctagaagaggaaaaagtctttccttctagtgaggtatagactagtcactaaagaaatacaattttccaagcatgggaatgataattctatcaatatctgccacctttcatatacttctttttttttaatatacatggagtctcactctgtttcccaggctggagtgcactggcacaatcttggctcactgcaacctctgcctcctgagttcaagtgattctcctgcctcagcctcccaagtagctgggattacaggcgtgcgccaccatacccggctaatttttgtatttttagtagagacggggtttcaccatgttagccaggttggtctcaaacttctgaccttgggtgatccgcctgcctcagcctcccaaagtcctgggattgaaggcatgagccaccgtgcccagctcatatacttcttacatggcagtcaaggttacacaatgcatagagcacaaatcatattctactgtatataaataatgcctctcctgactacatggattacaatgtcattgctgcccccggagttgtgcaatatggcaaccttgagtcccataggcagtgcatcgggggaggcctacagagtatattagggtacatggatgaacctacttcccaagagaaagcaagatttcaaaacccagttgatcaaaataaatacaaaatcatcaaatgtattttgatatatcaataaatgtttagcaaacaaaaagtccatctataatcatatttttaaatcaaatatccaggagtaaatctagcaaaatatgtgcaagactgcttcatggaaaactctaagatatttttgataaaaatgtttaaacacctaagtaaatgaagggataaaccaaggtcctggactgggggactccgactccatgctgtagtagcactgtagtaatattaattgtctgcaaactgatctacagatttaatacaactccagtcaaattcccagcctgtgctgtttgtttgttttggaaattagaagccgatttttaaatttatatgtaaaggcagagtcaagactagccaagacaatcttagagaatgacaacgtagaaggaaacgctctaccaggtattaagacttattacaatgatagacattaagaaagtggtactggtggctgggcatggtggctcatgcctgtaatcccagcactttgggaagccgaggcaggcagatcacctgaggccaggagttcgagaccagcctggccaacatggtgagaccctgtctctactaaaaatgcaaaaattagctgggcgtggtggcgtgcgcctgtaatcccagctactcaggaggctgaagcaggggaatcacttgaacccaaaagacggaggttgcagtgagcggagatcgtgccactgcactctaacctgggcaacagggcgagattccgactcaaaaaaaaaaaaaagaaagaaagaaagaaaagaaaaagaaagtggtgttggcttgaaaacaaacaatggaagataattgagtccagaaatagacctttgcatctattaacatgtgatttatgataaaatggcagaacagtgaagaaataagtcttttcaataaaatggtgctgggtcaactggataaaacatggtaaaaaaacaaaacttgagcccttcttcacatcatacctaaaaacaaatcccaaatggtatgtaggtttagatgtagaaggtaaaacaagcttccagatgataacatcagagtgtatctatcttcattactttaaggaggaaaagatttcttggacaagccacagagagtactaatcataaagcaaacaactgataaacttttaattttaaaattaaacttttgaaattaagaacatttgtgtattaaaaaaaaaaaccacactattacaaaagtgaaaagggccgggcatggtgactcacgcctgtaatcccagctacttgggaggctgaagcaagagtattgtttgaggccaggagtttaaggccagcctaggaaacatagcaagacccccatctctacaaaaataaaaattaaaaactagccaggtgcggtggcacatacctgtagtcccagctactcaggaggctgagttgggaggattgcttgagcccaggagttcaaggttgcagtaagctataatcacaccactgcattctggcctagatgacaaagcaagacccccttctcttatttaaaaaaaaaaaaaaagtgaaaaggtaagccttatagtgggaagagataattgcaacatgtaaatgaaaagggattcataccagattacaaaataatttctaaatcaaaacaaaaaactacagaaaaatgaaaaaaagacttgaacagacaacagatacttcacaaaacaaggatacctaaattgccagtaggcagataaaaaggtgttcaacctcattagtctttggcaaatgcaagataaaatcattatcagatgccactacatacccactagaatggctaaaattttaaaaagactaacactatcaagcactgagagcaatgtagaggaactagaactcccattatgcttctagtgggagtttaacacaagcactttagaaaactgtttagcagcatctactacatttgaacatatgctaattctatgactcagaaatttatattctagatgtatgtccaactatatttacatatagccaaaaattaaatataaattttttcatagcaacactttaaataatagtcaaaacactggaaataacataaatatacaacaataaaatgaataaataaatggtagtatagtcacatgatggaatactacacagcaatgaaaactgactatggctacatgcaaatacctggacgaatctcataaccatgtacaaaataagcaaagacaagttgattcatatttcttgattccatttatattgtttttaaagtggtaaaaactagtatctgtgttaaaactcagcatagaagttactttttgagaaaagaggacactatggcatttttgagatgctggttatgcaagcatgttcacattgtgataatatattgagccatatccttatagcttgtgcacttttctttaaatagattatattttacttaagtattttttaaaaagatttttaaacccatttcaaaggccatatctgggaagccttcccagaacatgcagatagatttaattactccctcattgatatcttggacttatttaggttgttatacttcgaacagtctattataatttgtgttcttccatgcagttcttccctgttacacatgaaattcttgagttaagagcaatatggatatttattgggatgtttggttgccattgtttgtttgcattgttttttgcccacagcatcatatgttttcccattctaacagagccctagtttttctttgagaattcattcttctacatataaggtctgtgtgatttgagtgaggctccattcctagtcacacaggtagaggaggtgacccaggtccaagacaatcactgtgtatcacatgatatattagtctattctcacactgctacaaatgaatacctgagactagctaatttataaagaaaagaagtttaattggctcacagttctgcaggctgtacaggaagcatagcagcttctgcttcttgggaaacctcaggaaacattcaatcatggcggaaggggaaggggaagctggtatgtcttatgtggctagatatagagaaaagatgggaaggtgccacacaattttaaatgaccagatctcataataactcactcactctcatgagagaagcaccaaggagatggtactaaatgattatgaaggaccatccccatgatcccatccccttacacttggccccacctccaacattgggattacaattgaacatgagatttgggtggcgcacagatccaaaccatatcacatgacctaaactgatctaatcagactgaaattcattctggattagaatcaatttcaggatttttgtggaaaataccaagccacagatgctcatcttttactgagcatgaaactgaaaaatgaggtttcaggagctactgtcagacaccttgaaaccatgagaaagagtcttcctgaaaatggagccaacactgaggaaaagtcaggatagaaagccccgaaggaaacccatgcttgtttggtcaaccgtgtttcagaaatgtgtgaggtggccagacgcagtggttcacacctgtaatcccagcactttgggaggccaaggcaggcagatcacttgaggccaggagttcgataccagcctgaccaacaaggcaaaaccccatctctactaaaaatacaaaaatcagccaaatgtggtggtatgcacctgtagtcccagctatttgggaggctgaggtgggaggattgcttgaacctgggaggcggaggttgcagtgaactgaaacaatgccactgcactccagcctgggtgacagagcaagactctgtctcaaaacaaaaacaaatgtgtgaggcaatttagtagagaaaggattgtcttttcaaaaatggtgatgaattggataactatttgcaaaaaaaaataaagaactaaacctcaacaaacaccttatataaaaattaaactctaagtggattaaaaagctaaatgtaaaatctaaatctataaaatttctagaagaaaacatagaataaaatttttatgaccatgatttaggcaaagatttattagttagaacatgaaaagcatcatccataaaagagagaatggataagttggacttcatcaacattttacacttctgctcctcaaaagacactgttaacatattaaaaggcaagccacgttttaaaaatgcaagccactgggataaaagtatttgcaaaatacatatctgataaaggatttacatctggaatatatttttaaaactctcaaagcccaataatgaaacaataatacaatttttatctaatgttatgttattttatgtctctggagctctatgttcatttacatgttttagattttttttaacaagttcgacttttattttagattcagggggtatatgtgcaagtttgttacatgggtatcttgtttaatgctgaggtttagggtacagctgatcccgtcaccaaggtagtaagcatagtacccaatagtttttcaacactcaccttcctccctcccccacccagtagtccccagtgtttattgttgccatctttatgtccatgactacccaatgtttagttcttacatatgagtgagaacatgtggtatttggtcttctgttcctgcattaatttgcttagagtaatggccttcagccacatccacgttgttgcaaaggacatgatttcattcttttttatggctgtgtaggtttttttaaaataagcctcagtttctagttattgttgtttctacttgctcaaacaacttatgagggttctatctaagaataacatttatcccctgttagatttttcctgctttctcttgcgggcatttagtggtataaatttccctctacatgctgcttttaatgtgtcccagagattctggtacattgtgtctttgttctcattggtttcaaagaacatctttatttctgccttcatttagttatttacccagtagtcattcaggagcaggttgttcagtttccaggtagttgtgcggttctgagtgagtttcttaatcctaacttctaatttgattgcactgtgtccgagagatagtttgtggtgatttctgttcttttacatttgctgaggagtgctttacttccaattatgtggtcaattttagaataagtgggatgtgatactgagaaggatgtatattctgttgatttggggtggagagttctggagatgtctattaggtctgcttggtgcagagctgagttaaagtcctggatatccttgttaaccttctgtctcgttgatgtgtctaatattgacagcggggtgttaaagtctcccgtgacaccctaacatcacaactaaaagaactagagaagcaagagcaaacaaattcaaaagctagcagaaggcaagaaataactaagatcagagcagaactgaaagagatagagacacaaaaaaacccttcaaaaaaatcaatgattccaggagctggttttttgaaaagatcaacaaaattgatagaccactagcaagactaataaagaagaaaagagagaagaattaaatagacacaataaaaagtgataaaggggatatcaccaccgatcccacagaaatacaaactaccatcagagaatactataaacacccccacgcaaataaactagaaaatctagaagaaatggataaattcctggacacatacacccttccaaggctaaaccaggaagaagctgaatatctgaatagaccaataacaggttctgaaattgaggcaataattaatagcttaccaaccaaaaacagtccaggaccagacagattcacagccaatttctaccagaggtacaaagaggaactggtaccattccttctgaaactattccaatcaatagaaaaagagggaatcctccctaactcattttatgaagccagcatcaacctgataccaaagcctggcagagacacaacaaaaaaaagagaattttagaccaatatccctgatgaacattgatgcgaaaatcctcaataaaatactggcaaaccgaatccagcagcacatcaaaaagcttatccaccatgatcaagttggcttcaaccctgggacgcaaggctggttcaacatacgcaaatcaataaacgtaatccatcacataaacagaaccaatgacaaaaaccacatgattatctcaatagatgcagaaaaggcctttgacaaaattcaacagcgcttcatgctaaaacctctcaataaactaggtgttgatgggacatatctcaaaataatgagagctatttatgacaaacccacagccaatatcataatgaatgggcaaaaactggaagcattccctttgaaaactggcacaagacagggatgccctctctcaccactcctattcaacacagtattggaagttctggccagggcaatcaggcaacagaaagaaagaaagggtattcaattaggaaaagaggaagtcaaattgaccctgtttgcagatgacatgattgtatatttaaaaaaccccatcgtctcagcccaaaatctccttaagctgataagcaacttcagcaaaatctcaggatacaaagtcaatgtgcaaaaatcacaagcattcctgtacaccaagaacagaaagagagccaagtcatgagtgaactcccattcacaattgcttcaaagagaataaaatacctaggaatccaacttacaagggatgtgaaggacctcttcaaggagaactacaaaccactgctcaacgaaataaaagaggacacaaacaaatgaaagaacattccatgctcatggataggaagaatcaatatcgtgaaaatggccatactgccaaaggtaatttatagattcaatgccatccccatcaagctacaaatgactttcttcatagaagtggaaaaaactactttaaagttcatatggaaccaaaaaagagcctttagagccaagacaatcctaagcaaaaagaacaaagctgaaggcatcacacacctgactttacactacaaggttatagtaaccaaaacagcatggtactggtaccaaaacagagatacagaccaatggaacagaacagagtcctcagaaataacaccacacatctataaccatctgatctttgacaaacctgacaaaaacaagaaatggggaaaggattccctatttaatacatggtgctgggaaaactggctagccatgttcggaaagctgaaactggatcccttccttacgccttatacaaaaattaattcaagatggattaaagacttaaatgttagacctaaaaccatgaaaaccctagaagaaaacctagacaataccattcaggacataggcatgggcaaggactttatgactaaaacaccaaaagcaatggcaacaaaagccaaaatagacaaacgggatctaattaaagagcttctgcacagcaaaagaaactaccatcagagtgaacagacaacctacagagtgggagaaaatttttgccatctacccatctgacaaagggctaatatccagaatctacaaagaactcacacaaatttacaagaaaaaaacaaacaaccctatcaaaaagtaggcaaaggatatgaacagacacttctcaaaggaaaacatttatgcagccaacagacacatgaaaaaatgctcatcttcactggccatcagagaaatgtaaatcaaaaccacaatgaaataccatctcatgccagttaaaatggtgatcattaaaatgtcaggaaacaacagatgctggagaggatgtggaaaaataggaatgcttttacactgttggtgggagtgcaaactagttcaaccattgtggaagacagtgtggcgattcctcaaggatctagaactagaaataccatttgacccagcaatcccattacagggtatatacccaaaggactataaatcatgctgctataaagacacatgcacacgtatgtttattgcggcactactcacaatagcaaagacttggaaccaacccaaatgtccatcagtcttgactggattaagaaaatgtggcacatatacaccatggaacactttgcagccataaaaaaggatgagttcatgtcctttgcagggacatggatgaagctggaaaccatcattctcagcaaactatcacaaagacagaaaaccaaacactgcatgttctcactcataggtgggaaccagacaatgagaacacttggacacagggcgaggaacatcacacaccgggacctgtcggggggtgggggactgggggagggatagcattaggagaaatacctaatgtaaatgatgagttcatgggtgcagcaaaccaacatggcacatatatacctatgtatcaaacctgcacattgtgcacatgtaccctagaacttaaagtataataataattttaaaaaagaataacatttatcctcaaaataggtaagtacacaattattaaaatgggaaaagatttgcatggacacttccccaaggaggacatacagatagcacataaacacattaggatgactgacatcattagttatcaggaaaatgtaacttaaaagtaccttgagatagcactgcacacctattagaatagctaaaataaaccttaaaaggtgagtgagaacaagtactggtgagaataggaagtaacttttattttattttattttattttattatttttagtagagatggggtttcactgttttgaccaggctagtctcaaactcctggccacaggtgatccacccacctctacctcccaaagtgctgggattacaggggtgagccactgtgcccagcactggtacaacccattttggaaaacaaattggtagtttcttgtaaaattaaatacagatttactgtatcactaagcaacttccctactaggtgtttaccagaacaatgaaaacttacattcacacacacacaaataaaaaacatatgcacaaacgtttctagtagttttattcacagttgccaaaaatggtaacaaatcaaatgtcctgcaattggttaataggttttaaaaatcactgtacatctgtacaatgggctactcagtgataaaaagaaatcagaggtgtgattacacagatgactcctacacaaaggcaggatagtgagtaacagaggccagacacataatcttacgagtacatctagactacttaattccatttaaaagatattctgaaaaaggcaaaactataggtactgaaaagagatgagtggttgtcaggggctgagggtagcaggagaagttgactacaaagggacaagaaaaaaattagggaggggggattgtggaaatgttctatatcccgattatgttggtgagtacacaactgcacgtttatcaaaactcactaaactgtgtacgaaaagggtaccatacccaagttacgtctcaataaccttaaccaaaaaagtaaacaaataaaatattttgctgaagccctgaacccagctacacctgaagtgaaatttactcttggagttttcagctgtataagctaatacattctctctttccttaaccacttgagttggattttctgttgcttgtcactaaaagagacccaactgttacacgggctcggtttacccaatgttataggccagcatctagatttaatgaggataaatggtctccctacagtttaaacttctcagaaaccagagtttgtagttaggaatagcaacggtatgatatatgcacacgttatccctcctctttggcccatgatactcaatgatcacaacatccttcagagtaaattcagcttcagagatcttcttatcaagacagtgtactttctctcattactacttcactgaaatcattacttctctcttcctgtagcaggtagactctaagatgtcccccgatcatcctctcctcttcaccttcgtatctttgcatggttcctttttttttggtatggacaggacctgtgacctacttctaatcaatagaatatgtcaacaatgatgggctgtcacttctataattaagttatgtaagattgtaacttccagccgggcacagtgcctcacgcttgtaatcccagcactttgggaggccagggcgggtggatcatgaggtcaggagatggagaccatcctggctaacacgatgaaaccctgtctctactaaaaatacaaaaataaaattagctgggcgtggtggcgggcccctgtattcccagctacttgggaggctgaggcaggagaatggcatgaacccaggaagtggagcttgcactccacttgccgagattgggccactgcactccagcctgggcgacagagcaagactccgtctccagaggaaaaaaaaaagattgtaacttccatcttgctagcagactctattgtcttcttggcttgcatggtttgatgaagcaagctgacatactagagaggcctccatgccaaggaactgagggtagcctctagacaacagccagctaagaactgagggcctcagtacaacaacccttgaggaactgaaccctactaacagccatgggaacttggaagggagttcatccccagtagaaccttcaaattaaacctcagccaggttgacaaccttaattgcagccttatccaaagactcttgacacagaacacctaactaaattgtgcctacatttttgatcatggaaattgtgagacaacaaatgtgttttgtgttaagctgataagtttgggtgtgattatcgtgtagcaacagataactaatacacatccccatcataaacaattccaaaagatgtaggtaactatgcacctcacagagagaatgtttcatggtgttttcttgactgtacacttatctgacaatgattaaatctcactctgctaacctccctgcagcctctaagttttgccctaattaactgtggactgattttctcaaatgaaagcaagtcatcttcaagcacattttcttttctttctgcttattttttgataccctaataaagcaagctaatcttggaagctaagtggataattctcatcttatagattaaaattaattgagttgcagggagagataaaagcttgtccttttatttggatgttctggcaagttgtaccaggaatgccatggtaaccaaaactacattacagaattttttctcttaatcccactgtttaggtagaaaaatttccatctctattttccctcttttagaaaattataaataaaaagaaactgagttagctgggatggaaaagtaaagctggtttttgcctaatcatcctcattacttcacacaccacagctctttcctctggctacttcttcacattaagcatttggctaatggcttctgtttcatgtagaagagcatttattgctctggtatttccctttaacacttcagctggggatatcatagagcagagatttgcaaccacaacccatgggccaaatctggcccaccacatattttataaataaaattttattaaaacacagtcacatccattcatttgcacgctgtctatggctgctttcagactgtaatgggagagttgagtggtggtaacagacagatggccaacaaaacccagaataatttactatcaggccttttgcagaaagcatttgctgacccttatcattaaaaaaaaatttgagaagcttcagagagtgaacatcctttggctacagggcattgcaaggaacatgaacagggatcaggagaagtatattctaggtctagccctatataaccctgcattagtcagttctctgtgcttccgtttacccatcaaaatttcagtaagtggactagatcaagtttcttctggttttgagtaatatatcaactcaaacaacctggggtattttgttcatgtgaatagcccaactattttcatctgaaatcttattattttgtttttcttttcttggtttaccgtgctagacagcttaaacatgatattaccaacttagagtctaaattcaccatgtcttcaaagaaaataagaactaattcctatttgattgggctttgagactaaatgggacattaccatttagtacaaatgaaccagaagaaagaagggagtttgtgtagagtaactttaattatcacaatcatcatcgtcacatatattgcacgtaagatgttccaggtactgttctaagtgctttaaatattttaattcctttatactctcacaaaaaccttatgaaataggtactattattaatcccattttacagatagggaagctgaggtacagagatgttaagtaacttatccaaggtcaagaagctggtaagtagcagagccgggattcaaaccccatgcagtctggctccagagtcctttctattaactgacatcccatataaaagaaagaacattcctagccttgacaacatgtcttcagcaaaagcaaaagaaagagaacagtttctccatctgccccaccccttccagtctaaaacagtattccccaggtctatgggcaggagagcagatgagaaagagatccaagagttaggaattatggctgaactaaaagcaacttcccttagatttttgtttcttgagctcagacttccatctgctgggggcagttttcacataccccagagctgtgtagcctacagacggtctcagtcaagacactccatcagctgtctatccagcaattgtccatctatgtccaaaattttgctcagtctgtctgaaccaaatgtagaaacagtccctggacatttaaagggtagaagtgggggaggaagcctctgaactgtatttctgaaaggctgaatggagacagtttgagggcacactcttccaagttgggccacgggtctatgcaagccagaacctcagcaaaaatgagaatttactgaagaatactgaggaacacaagaaactcgggtcctgagttgaattacaagttttggggactttagcggcaggaatgcattcttacaatattcagtgagcatctactgtgtactgagcactgtgtgaacaccggaaatcctgagatgactaatacttttataattccctaaatagcaatgctccctcacccctaagcctttgcatagccttgtctctcttcctggagttccttcccctgactccttcatctggccaaatcctcacagtcatgacattgctgggccttgcctcctccaggggggccacgttgaggctggaattgtgaacacttggtagccttatgttctttcatgagttatagtttctccttagctcaggcttttcaatggtaaaatgggaatcctcacagatgcatctaaggtcatttggaagactaaacgaaagcattatgtaaggttttacctcagtgcctcgttctttaattgctcccacattgtcttgagatctcccttccagaccaggggctgtgtctaattcatttctgtatccacagatcctatcacagggtctgacgcttaatacatgtttgatgaaggaagagagggagagatgctactcttgactcaaagttttcccagtataaagggaaagacggatatgtacacaaagaatgagagcccagtatgaaaaatgctataaaagaaacattaaaaagagcctcacagaatcaaagaagaaagggccatcgaggctggtgatcttgagaaatactttgcaaaggtaatagctggttgaggactaagagcttgccaagcatagcagcaggcagattagagcattctaggcaaggagaattgtacacttcattcccaagcacaaggattaaattcttacagggaatggtaggttggaacaaaaataagtgaaagagatagaataaggaatatatatccttaacataaaaatgagttacaaggacaaagataatgtatgtaaatgtgtgactattttacctttagtaaataacagagaaaaaagtggagaacaaaaagaggccatcagtgatttttatatgtcttaaattagcagcaatcagtactatacaacccattttctatttactgcctcaagacggcaggaaatttttcaggctctccctctgcttcatctgcaataagaagctcacaaatttgttttgctttgttgcaaataacatgtatgctgagaggcatttttcctctctataactgtacagccatctaaatgggtcttttctggttttacaacttgaatatgttaacatgcacccctcagggtcccccttgtatcccagaaacagcacgcttgtaaaaccttattcatgtgatatccttaatagctgctgacatttattaagtgtttaagatgtgccaggcatggtgctaagtgtcttagaactcttccagcctgtaatccccgagcctccctgtgaaaatacaagcatcttaagaatgccccctactctggcatttaccttcagatgaccgatgaggaaagtgaggatcagaaacatgaacttatcctaggccagcccactagcaagtgatggaggcagcatttggactcagggctgcctgattccagacaaaaagcctccaaccataaagctatgctgccaattccacttggcccgggtgagtagctctgtctccagtctcctcaatactcagattctagagccttagctgtccaggtgataacttcaggccggttaatacctggggcactcagcacctgtgacacacagagttcaggaacctccttctatagacaggggtttcagtgccaaagctctctcaggcatcagtttgttttccgcctccaaggctcattgcagaaatatctgcttctgcttcactatcctccttaccactcttttccactcaaaacctccaatttcctcttctccaattacacccaacagagggggctcacatttacctagaaccaaaattcctcttcttccaagaaaatgttcagtgcctttgttattttacaacatggatattcatgtctgctgtggcctaagagaagcagagttgcaataatctctgggtggtgtcatgtagttgaccctcttaataacagcatttttaagcagttactgtgtctgaactgtgcttagtgctttgttggcattagcacctggaactctcccaactactgtaggctgtaggtattcttagagccccatcttacaggtgaggaaactaaggcacagtcatacagcaagcaaaaagcaaggagtgaaaagtagcagagtaattggagaatacgaataaaacaatgctattctcccctgcaagtcggtgctgagcagatagcctctacttgagcaggtcttcaaaacatgagccagccttggggaaacaggcactctcgtttattgctagtggaatcgcaaaaggctactatcaccatggaggataatttggcaacatctatcagaattacatatgcatgaaaagttgacccagaaattccatttctagaaatttatcctaaatatatgtaaaagtatatgcacgtgcctcatgcaagtacaagtttattccttacaatgtgtttggcctaagaaatagttggaaaaaatccaatgtccctctatagcagattggttaaataaagtatggtacaacctacaacaggtagtatggggctggaaataaagaatgagggagctctctatgtgctgatttggaataatctccaggatatattggaaaataagaaacaaaagcaaaagacccacggctcaaaactgtgtgaaatgagtcaaaattagtatttgctgatatatacaaagaaaccctgaacaggtacataaaaatgatcatgacgtcagtgattacttctggggacggagcactgtaggccaaaaaagacagagaaagaaggaagggttttcgctgtattttttttttttttactttttactttttgagccatatgaatgtattatctatattccaaaaatatagaccaggtgcagtggctcatgccttgtaatcccaacactttaggaggccaaggcaggagggttgcttcaggccaggagtttgagaccagcctgggcaatagagcaagaccccatctctacaaaaaaaattaaaaactagccagtcatggtggtatgtgtctgtcgtcctagctactcaggaggctgaggtgggagaattgcttgagctcaagagttcgaggctgcagtaagtgataattgcaccactaaactcctgcctggatcacgagcaagaccctggctcttttaaatgaatgaatgaatgaatgaatgaatgaatgaatgaatgaaaatgtgttcacaaaaggaagtcatcctgagtttcaccaattaaaaaaaggtatccagagatcagatatttctacatcagattttacacctctcccaatcacaacacccattcttaagtggaaaattagagctagatcctctaaaaaattttagcaaagggaacatggttaaattcctattttgtacatcagatgcttttaagtagctttacaaccccctccaaatgctgatattactgaaatgtaaatgattatgttaatagcagctgcatcttaataattgatgatctgtttgcttaacattcagttattacttgatgtaagaagtctctagtgcaaaatattctctgctaatggcccaaataaaattgatcacgtgaggtgaatggtttgtttttcacttttcctattcaaacaccaccgtgtgtgctgagttctttatctgtagataagaatatttcagaatatgtacctgtgacaatgcttttggcccacagatgaaaactgtctgttaggaaaataatgcttgcatcctcaaataaaatggaaaagcctatcaccacttaactcataaaagtttcaacccttaggattattcacagaatggtcaaatcagaagttgagaaaacaccatttagataagaaatatggagagaagtttccacaggcatccaaagggatggtttatgcattccgagatgctatccaggtgtttcagtcctgaagttcttctctgaacctctgtctccccacatacatctgcaaggccacccttagacctgagcaacaggggctcctgtcctgggccactcagtcacctgggacctggacctagccctgacaaaacgcattgattactccaaacacccaccctaatacataacaccattcaggccccagagaagcactgcctcccagatcttgatctctgtcctcaaaacaaaaggcaactgtgcccaaacaccttgaaggttcatgtgcagtactacagcctaaaggagagatgggtactgctctggtgtgcaggggtcacaaaagcacttaggaaagaaaaggacaaattaacttgtcaaatatttcctctcaaatagagtgggtaatagattcttgcagagcagaacataatttccccatagtgctgactgcctgtttcttgcttctctttgtgttctaatttgtggttctagaatcagtatggcatttttgacagttgcatattacggccacggaaaatgttgcagtagaaagaattcatggccaggtgcggtggctcacacctgtaatcccagcaatttgggaggccgaggctggaggattgtttgagcccaggagttcaagaacagtttgggcaacatgatgaaattccatctctacaaaaatgcaaaaattaaccaggcgtggtggtgcacacctgtagtctcagctactcaggaggctaaggcagaaggattgatagagctcagagggtcaaggctgcaacgagccatgattgtgccactgcacttcagccttggcaacagaatgatgccctgtttcaaaaaaaatgtactcttaattatgtatattcataaatctggccataatactgaatgactcttgaaactgacaactgaacagacatagaaaactagaattatgaatagtttttaaataaaaatatgtaataagatctaaatcaaatttcaaaaattaaatttcaactttcatttttttaattgtttaatatttaattgttaatactaacataattttcattgtaccttttaattgtaataaataatttcaaatacctaaagaaaaaataatgttttgaaaacatatacgaaaaataactttaatttttccattttatctttactatgatatactttcttggtgaaaatatatccaaatagttttaatccaataatattttattttgtaatgactaaatcattgctgtcaatagaagcaaattggtagaactcttgattataaaaacattattggctgggcacagtggctcatgcctgtagtcccagcaacttgggaggccaaggcgggtggatcactggaggtcaggagtttgagaccagcctggccaacatggcgaaatgccgtatctactcaaaatacaaaaactagccaggcatggtggcttgcacctgtaattccagctactctgaaggctgaggcaggagaatcacttgaacgcaagaggcagaggttgcagtgagccgagatcatgccagcctgggcgacagagtgagactcggtctcaaaagcaacattattagtgactttgataaaattaaagccagagaaagaaattttatgaaatatctaatttgtgaattatatgtgtcttttttcttttattcatccaaacattgccagccagtccaccaacagaatatccaaaaataacaggggtttaattgagtgatgtttgatattgtgtcaacttccagtaacattagagctaaaccttagctctattgtatgttttaatcttatcattatggagttttgccaaggtaagaggatatgacatatattggtttatgcttaaatgtgtaaacatacagtacacaagcctccattttttttgttgttgttgttgtttgtttctttgtttgtttgtttgagatagggtcccgctctgtcgtataggctggagtgcagtggtgcaattcggctcagtgtagcctcaacctcccaggctcaagagatcttcccacctcaacctcccaagtagctgggaccacgggcatgtgccacaacgcccagctaattttgtttattttttgtagagccaaggtctcactttgttgcccaggctggtcttgaactcctgggctcaagcaatcctcccacctcaacctcccaaagtgctgggattacgggcatgagacaccgtgcctggacagattgtacactttaaatgagtaaattgcatggtatgtgaattacatcgcaatgctgtaggaaaaaagagagagagagaaagaaacaaacatccgcaggagaagcaaggataatcaaatgattttgtctttgttgtaggtcggggggccgcccaactttgtccttggcctgattccccgctggctgtctgcctcctgatgtcagaactccccaccctgggaagaggggaaaaaactccactctaacctcaccacaatttaacagaaaattaaactgaaatatgtgtgtgagcattaaacctagcccagcacatcatctcccgcagattaaaaagagccagcgaaaatgaaatattgttctctaagctaatatgtaatcttcatagacaccatcttattaaagtttgagaagccatgccttgagggtaagcccacctatcgatttacgggcctggctggaattcctgctattaggtctctcatatttgttttgctccctgtcttgatgccagcactgtctacctccacctccccactcccaaagctggccccctgtaactctctaaaatctccctccttggactaggggtggggaccactttccctgccaacgtcaggcctgtgcgtattaacggggccgtgcgcttggatttgatggaagtggcagcttagacacataagctcctcatatacagatgaataatcacagataaaaactactttcaaatatgattaggctctaacagagacagacagaggccagagggaacgcagctctcaaagagcaaggagctaccggcatccgaagcccagaataggagattaaggcctctacaagaacccctgggactttcctagggaaaatattacagtgattcgcagcatcctctgctcctcctctctttcctcgggacaccgtctccccgtcctgaagctttgtgctatttctttccgtgggctgtcatttgcctctgggaacaggacagctcttcccgctgtgacttctcgactctttaatccaggccgcctgtcacggaaacgcacgtggaaatccagcagggtttttatttaccatgctttcttctcacagatgataacatgtttctttactgacaggcgtgcttgttgcctgtgtccccactgtatcccaaccccatgataacagctaaaacacgagaactatgtaccagctacttcaagccctttcaaaatattagcttagtaaaccttcatcataatgatatgagctacaaactatcattatcccattttacagatggggaaattaagccacagagagggtaaggaatttgcccagtgccacacagctagggagtagcaaagttgggatttgaacccagacatcctggcactaggaggcccaatccttaaccatgaagccatagagtctctcaataatgactatgtctcgtatgtcaactacatgttaggccctgttctgagagatttgttgcattaacacattgaatcctctcaaaaagttgatgaggtagatatatttattatccccatttcacagatgaggatactgaggctcccccagaagagcaggaattttgtattgtctgcctctattctgtttctggactgatgaatagcagttccttaaataccagagtgaatgtcctcccatcaaccactacccttttcccaggagcttctcaggacatttatttatagctaacctattttgggaaaagatttgaggcatgtagggttctaattctggctctgtcacttatgagctgtgtgactttgggcaagtcactcaacctctctgggcctcactttgctcagtttagaccagggataataataaagcccacatcaaggagctggagtgaggattcaatgagatagagcaggtaaggtgtttagcatctgtgtggcacagaacaggtataaatgctggctgcctttactgttactactgtcagagctattgtttaccactgctacaggccaaaatgagttttaaaggggtgaaaaaatacaataaggggaaataagggaactaagttcttgaaattctttctgaactggtgctagggttcccatcctcctggttttcctacctaaccagctgccccttctgtgtcccctaatgcctttcccaatcctaggtctcctctatctaagggatcttatcccctcttgtgatttaatcagctatagaccaataactctcaactatctccaggctcgtacctcctacacctgcctactccatgtcactgagatgtctaacaggcatctcacacagggcatgtatccatcataatacagttgttgaggcttctttcataaaccgaggcctctgagggtcttcccccaacatggctcccacccacagattattcagcctcgagaccttggagtcatcctcaactcctctctttccttcccatccacatataattcaaaccctgggagttctaccttcaaatgtatatgccagctgcaaccactcctcaccccttctgctgacaccacatcatttcttgcatcagatgactttggaagtccccttgctggtctccctcttccactgtgaccaccccattgccaacctactcctgccacagtagcaggcagaatcatgttaaaatagaaaccatcttacctcctttccattccaaagactgtcatggtttccccccacacttaggataaaatcctagctcctccttaggacctacaaagcccaacatgccctgggtctgtcatctctgaccattctcctcctctgtccagcaaccgagatcttcttgctgtctctgaagcaagccacagggactgcactgtcccctccctctgcctgcaacacccttccccacgctttcttcctggtggcttcatctcatcattcttctcttgctcaattgtactttcttggggaagatgattcttacatgaatcaattattattagtattagtatcatttgaaacaaagtcttaccctgtcacccaggctggagtacagcagcacgatcttggatcactgcaacctccaccacctgggcttgagcgatccttctgcctcagcctcctgagtagctggaaccacaggtgtgcaccaccatgcctacctaattttttttatttttagtaaagacgggtttcaccatgttgcccaggctggtcatgaatcaattattacaatggggcttgaaacatgatttttattttattatttttttttagagacagggtctctctctgttgcccaagccagaatgcagtagcacgatcacagctcactgcagcctcagcctccccaggttcaagcgatcctccctcctcagcctcccaaatagctgggactataggtgtgtgctactatgcctggataatattttttattagtagtagtaatgagggtctcactatgtttcctaggctggtcttgaacttctaggatcaagtgatccatccacttcagtctcccaaagtgctgggattacaggcacgagccaccactcctggccatgatttttaattctaccgatccttttacaaggattagttagctccctaactaagagctttcctccttcacttctccctttctctttagacacactattgactcatgggtttttatttctccagtgtgcgacattcagttacatcctttttaccaatgctcaaattgcccctaatttaacctgaccattctatttaaaagagcagcccctaggcttcaactcagtcattcagcattccagcacccagtttaattatttttcatggaacacatcatcatgtgtgaaatgatattattcatttacttctttattgtctgtctctagtcaaatattcattcatttatagtaagcttcatgtggccaaagatattgtcagtctcactcactgtgatattcccagaatccagaatcatgcctgttacagagcaggaattcaataaatatgaagcaaaattaagatgaaaccaggaataatgcccctagatcagggactggccaactccatcccacagccccaatctggctcgcctcctattgtaattttttttttttttttttgagatgaagtctcgctctgtcacccagactgggatgcagtggtgtgacctaagttcactgcaacctccatctcctggattcaagcgattctcctgcctccgccttctgaatagttgggattacaggtgcatgctaccatgcccggctaatttttgtattgttagtagagatggggtttcaccatgttggccaggctggtcttgaactcctgacctcaactgatctgccctcctcagcctcccaaagtgctgggattacaggcatgagccactgcacctggcctgttgtaaataaatttttattggaacaaagctctgtccattcacttaggtatttcccctggctgctttcactaccacaaccaacttgaataattccgtgagagaatgtatggcccacaaagctaaaaatatttactatctggccatttccagaaaaagcttgccaattcctggtctagatcattccaagtgctaaatagggctgacccttcaggatcctattagcatagggtcccattggagccattcaacaagtcattattcatacatttattcaacagatatttattgagcacctactatgtgctgggcactgtgctaggtgttttggatatttacagggatgaacaaaattaggcaggcttcttgcccttatggagctcagcttctagggagggtaggggagactaatataataaccacattaaaaatgaaaaatttccgttgtgatgagcccttacaaaaagaaccttatgtggtactttgagaacatttgacagcagtattttgtccaaactgggatggggaggacagtctaggaagacacccttcaggataggaccccctagtgaataccagaagtgtgagaaggggttagccgggtgaggcagagagtgatgtgctccaggcaaggataggacagagggagcacggtgcactccatgcagtgaaagatggccagcatggctgacctgcaacaggaaagaggagaatgtccaagatgactccagggaggtggccagggccacagcatgcagggccttgagagcacctaagagcagttgcataatgtcctgctctcagggcagctgatgcttgagtgggggctcaaatgatgagaaagagccacgcaaaggaagaccacagagaggcgtgttccagacagagggagaagcctgcatattatgcactaattccagaggggaaatgtacctttgcaatggagaggtctggtgttatgtccctagccaagggctcaaacttggcatcaccaagtggggagcaaagaaatacatgtttcctggcatgatgcaatgtgaaagatatggcatcaccttgaaggattcttgccagaaatgtttcaccccaatcaaatcaagcctctgaaactaatcttcaggacagaagaaatataggggagagaggaacaagttcaataacacccagaggaaacttcggacaaatccaaatgtgggacattctacaagacatctggctgagatttttcaaaagtcaatgccacatgctgcaactttaaaaggaaggattttaagccaatttcatttaaaaggggaagtgagtttggtgttatcctgtggaccaaatctggcccactacctgtttttgtaaataatgttttattggaatacagccatgttcacttgtttacttactgtccatggctgcttttgtatgaaaagagcagagttaagtgactgcaacagagatgatatggcctgcaaagccaaaaatatttgctacccggccctttctagaaaatgattaccaaactttgttatagatttagactaaaaacacctagtgaccaaatgcagtgtgtaagccttgattatatctgggttcaagaagaaagctataaaaatatttttgggccaatgaggaaagcatgaatatggactatatattaaataatatcaggctctattgttcattttctcaggtgtgaaatggtattatgattatgtagtagaagttcctgttcttagacaacgcacactattatttaagagtgaagtaccatgtaatctactttcaggtggttatatacatacacatgcatgcacacatggcaggtggcatcctcagttacccctcaactcatgccaatatttccaaaatatgacatgcacactgctggtacttcctgggctgtttttaggtggcagaagacaggttttattttatttttatttttttcatttactaaaaccaaagaaaactttaatattaggctgggcacgatggctcacacctgtaatcccagtactttgagaggccaaagcaggcagatcatttgaggtcaggtgttcgagactagcctggccaacatggtgaaaccccgtctctactaaaaacacgaaaaaaatagccaggcatggtggcacacacctgtaatcccagcactttaggaggccgaggcaggcggatcatgaggtcaggagttcaagaccagtctggccaacatagtgaaaccccatctctactaaaaatacaaaaaattagccaggtgtggtggtgtgggactgtaatcccagctactcgggaggctgaggcaggagaatcgcgtgaacccagaaggcagaggttgtagcgagccaagatcacactattgcacttcagcccaggcaacagtgtgagactccctctcaaaaaaaaaaaaaaaaacaaaaacaaaaacaaaaaaaaaacctttattattaattgctaaaagagtagattttaaatgtcttcaaccctccaaaactaagtatgtgaggtaatgaatttttttaacttttactttaaattcaggggtataagtgcaggtttgttacataggtaaacttgtgtcacgggtgtttgactatttcatcacccagtacctagtactcattagttatttctcctgatcctctccctcctcccaccctccaccctctgaaagggtgtgttgttcccttctatgtgtccatgtgttctcatcatttagctcccacgtataaatgagaacatgtgacagctttcattttaatagttatgtatttattcttctgattagtttccatttctgataagtgatactggcttcccacttattgtaggaatataaggtcttcatttcaaataaatatatttaagtttaaagcaatatgagccaactaaaaaggaaatatgaagcagacactattataaggcaaggcaacaaccaagaaaggctgaatttggataaccactttgccttcaaagcattgatcatagtccatgattactttgttttttgtttttttgtttcttagatacaggatctcactctgtcacccaggctggagtgcagtggcgtaatcatagttcactgcagcctcaacctcctgggctcaagctattttcccaccccagcctcccaaatagctgggacttcagggatatgccaccaccatgcctggctaattttttctgttaggtagagacggggtctctctatgtttcccaggctggtctcaaactcctggccttgagccatcctcccacctccacctcccaaagtgctgggattacaagcacgagccatcgcacccagccaaagattaccttgttttaataaacaaaaacaacacctgtttactgtccattcttctctcattggattgcaagctaaacaggctccttgatgctctcatgtgatgtcacataccagcatagtgcccagcatacaacaggcaatcaatacatgtctgaaggcagagtgatgaaagtaccatccccaaccagaatccctaccatctgaccaagaaacaactatttgcaggtagggtaagaattactcatttccctccaatcacaggatacataatgacagttgattcctgaaacacaagataatcctaataactatgcacattttaacatttctaaataaaagttcaagctggctgggtagggcggctcatgcctgtaatcctagcattttgggaggctgatcgcttgagctcaggagttcaagaccagcctggacaacatggtgaagcttcgtctttattaaaaatacaaaaaacttagcaggatatggtggcacatgcccgtagtaccagctactcaggaggctgaggtaggaggatcgcttcagcctgggaggctgaggttgcgatgagttgagattgcgccactgcactccagcctgggtgacggagttagaccctatctccaaaaaaaaaaaaaaaaaaaaaaaatctgacaaattactgaataagacatatgaggactctgtgagactttctacatagagacatttgcagatccaaaaaaagcattttgtctaaggctacctggctgcatttctgaatgagaggttaccattcctgcatttttctttcaggacatataatctctgcatatataaaggacccatccctggccccatgctcctggggcagccaagattccaggggggagctaaaacacatctactgctgacttcgaggtcaaactctcccaggtaaatgcagaccactaggaaagatgaggaccactaggaaatgcctctggatttcatttttttccggcatcatcatgagcctagagatccagactgcttccgacactccattcttttatgtttagtttcctcttctattttctttaccaatgcaaacttttgaagaagatattgctttggggaggtttataagagctgcaaagatctctattaaccatcctttaacagtgagataaagaccagctgtttcactaattgcccttaactgcttgggcttggttattaatgaatgccctcgccttgagttcaaacagcttaattagctaaagttaagtgtttccaataaatttactaacctatgataagctttcctttaataggaaatgtgcagttcttaattaaatagaataatttacaactccacgtctattataagtaatggttgcccagttaccatgttacctaattaggtgatagtgaagtttctccaaaggggaacggagggttacagttgaacatgcccttggacaaaccaatttgttagcagctcaacagtagcggagctatgggcagcctctggcactggcatctgggttggaatgtcctctctgccatgcagaagggtccggctgcctcatctgtaaaatggaaactaactccctgaggggcctctcgggagtagattggatagcatttgcaatcatttaaatgaagaataaaaagacaagttaatacccccatttaatacctctaggggctaggcctggtatatcatgcctgtaatcccagcactttggaaggctgaggcaggaggatcactcgaagccaggagtttcagcctgcacaacatagtgaaaccacacgtctagaaaaaaaaagaattatctagcagtggtggtgcacacctgtagtcctagctactcgggaggctgaggcaggaggattgcttgataccacgagatcaaggttgcagtgagctatgattgcaccactgtactccagcctggggacagagacagaccctgcctcttatacacacacacacacacacacacacacacactctctctctctctctctctctcactcacacacaactctagggtcacatttcttttattttatcttatttttttagagacagggtcttactctgtcactcaggctgaagtgcagtggcatgatctcagctcactgcagcctcaaactcccagagtcaagccatcctccacctcagccccccaagtagctgggactacaggtgtgcgccaccgcgcccagctaattttttgtattttcttagagacggggttttgccatgttgcccaggctggtctcgaactcctgagtccaggcaattaacctgcctcagcctcccaaagtgctgggatacaggtgtgatccaccacgcccggcgggtcacatttatataggcaaaattattccaagaggagattagtctggataacacacacaaaaacaaactgctccagcataatctggagaaggcatccagcaaacccagatcggggaactttctacaggatacctggccagcacatctcgaccatcaaagccataaaacgtaggccgggcgcggtggctcatgcctgtaatcccagcactttgggaggccaaagcaggcagatcacctgaggtcaggagttcaagactagcctggccaacatggcaaaaccctgtctctactaaaaaaatatataaaaattagccatgcatggtgatgcatgcctgtaatcccagctactcaggaggccaaggcaggagaattgcttgaacccgggaggcggaggttgcagcgagccgagatcacaccactgcactccagcctgggtgacagaacaagacaccatctcaaaaaaaaaaaaagctataaaaaataatgaaaaactgtcacagacaagaaatgactgaggattcatgccaacaaaatgcagtgtggcaccctggattggatcgtaaaacagaaacagaacatgaatggaaaagtgaaagccatataaactctggaggttagttacaagcaatgcgccagttcccatctctgagtttagacaaaagtaccatggcgatgtaaggtgttagcagaggggaaactgtggtgggggtcaggggaggatttagcagtcaggttaagcaggtcatactttgaattttgccatggttgaggactacatttaatccaggcagagtgatttcaatagttcatctgaaaggatatcagctattaatgaggttggttattattatctgtctaatggataaaaccttattagacctagaagaataaaaaattatttgctcaaagtcacatcactggccacgtgcagtggctcacatctgtaatcccagcactttgggaggctaagacaggaggatcacctgagcccatgaattcaagaccagcctggtcaacatggacccagtcactacaaaaaatacaaaaaaaaaaaaaaaatagccgggtgtgttggtgcatgcctgtagtcccagttgctcaagaggctgaggtgggaggatcaattgagcccaggaggttgagactgcagtgagctgtgatcgcaccactgcactccatcctgagagacagagtgagaccctgtctcaaaaaaaataaaaaaaaaataaataaataaaatcacatcactattataagtatcatttgcatatcataataaattccaccatcacatatttgggcagagccttgaacattttcaaaaaagctttcacatcatccagtgaaattatcacacaagctgtattagtccattttcatactgctataaagaatggcccgagactgggtaatttataaaggaaagaggtttaattgactcacagttcagcatggctggggaggcctcaggaaacttacaatcatgacggaaagcaaaaaggaagcaaagcaccttcttcacaaggtggcaggaaggagaagtcctgagcgaagaggggaaaagagccccttataaagccatcagatctcgtgagaactcactcactatcatgagaacagcaaggaggaaaccacccccatgattcaataacctccacctggtctctcccttgatatgtggggattatggggattacaattcaagatgagatttgatttaggtggggacacaaagcctaaccatattacaagccctggaacaacaataagatggaattttgatctccatttatctgatgaagcccaggtaatttgggtttttttcttcttctcttttggcttaatccattctccctccacatcagaccacccttcctctttctgttaatcctcattgacaatttagaatacatccttccaaatttgtctctatactcataaatcacacacaaatatatgtattcacacacagtatataatacataggcatttgtcattttatgcacgcttccgcagctcccatttcctcattctgcaatatgccatggaaatccctccaaggcatctggtattgctctaattcatcgttttttaatagctgcagaaaattccatggtgtggatgtcctgtaatttgttcaatcattaatgggcattcactcgtttctccctctttggctactacaaacagtgctgcaataaacatcctttctacaaacatccttatgtaccatggcctttatgtctacgagatagaggcccaggatggggattacggggtcaaagagtatatgtatttctctttaactatttttaaaagagcaaagcaagagaacagggtagtagatacctctagagaaaggcggagaaggcagagaaagtggactagagagaagcttgcaggtggcttcaacagtattggtgacgactgcattcttaggttggaaatgggttcattttatcattattctatataatttatgtgtcttattacctatattatttgctatatatccagtcctatataatttccaaaaatctatatattttatgttaataaatgtggccaaaacacagctgaaataattctcattcccatcaacaatataggtgagattggtcttttccattttttttcccagcctgagagggatatctcactgttactttaatttacatatctctgacactggtgagtttgaacatctttaataaatgtatcattcatttcaatgaaataagtgacattttaaatcatctacaaaccctttcccattaagtaaaaaggggaaggctgatcttcactccttttcatcttacccctctaaaagataaagctcagagtttttaaatgccacaacaacaaaaaatcaacatgaattggttctcttttatctaaagttcaagatgccatgacgtcaaaatgcatgatgacatgcgctctcctcagggaaatccccaactggaacctcaaatcccctaaaactctgggcacaaatgtttctttcctatgagaatcaatgagactagcaggtcatggccgttggcaaggtgactgtgtctttttcagaataagaggctacctggacgcattgtgggagaacatgcaaccttgtccctatctagcctggctggtctcctaccctcccgttttctcttccctcccttacaggtccttaccctgacctgtaagttgacattttgacaaaactagaatcaagctcaactcctgtctctgctccttccttttctcactttacagcccaccacagacatgtctttggaaaaatagccagagatctaatttgtttttaatagccacataacatcacatagtatagctatatcaaattttatccagtcatttgctgttgacagacagtcaggtcgcttccaaaatgctctggttttcatttttgcaaacagcgtggtaatatattttcttgtatgtgcatcttttatcattctagaccagattcttcccccttcaactatatatatttaaccttttcaccataccttcttcgataccaaatgtatcgactttttttttagttggttggttggttggttgagtttctttggaccaaatttaaggggttgagaatgaaagggggaacttcactgtagtactagcttccctatctatcctctacataacagtcacttgtaattttatagccagaacataatttgtatagtttcccctccttctgatcaactgatttagttgttctttttcctccattctgaaattagctattacagagccataatataattttttaaatttcaaatcctctttaaacaattgatttcttgttgctatttgtaggcaagaagttgaatctgatatgagccctgccagaaattaatttacagtgttagagaaggattatgacatatataaatgagtacaattttaaaaaggtaaatatcacagtgtaaatacaaactcatgggattcagagataagggagatctcattttagacagagagatataaaggcaactggaaagacttggctttggagttagttaggccttgggacactggtccaattttgacatatggaaatagatggaaggaaaagaattagaaaagaacagagcaacaatgtatctttatgtgacattatgatttataataagaaatatatatatctttatctccagttcctggcagatagtgcctaaatcccttgcaatttcctgggcaatagagatgttaggagcatcttttgttccaatatttggtctttaaccctggttcctgccacagagttcctaatcccttgcaattttctgagtgatgggagcatctcttgttctaatatgggaactctcaatggggcttctgggtgggggctggtcaccagaaagaccaagccaagaatagaagcttggaactttcatccccactcccatcctctgagaaggatggagagaggctggaaattgacttaataatcaatcatacctatgtgataaagcctccataaaaatcaaggggtttgaggagcttctaggtttctgaacacatggagggtgtcttacccatacaggatgtattagttcatttttacactgctaataaagacatacccaaaactgggtaatttataaaggaaagaggtttagttgattcacaattccacatggctggggaggcatcacactcatgacggaaggcaaaggaagagcaaaggcacattcttacatggcggcaggcaagaaagcaggtgcgggggaactgtcttttacaaaaccatcagatctcatgagacttattccctatcacaaaaacagcatgggaaaaacctgcccccatggttcaattacctcccaccaggtccttcccacaacacgtggggattacgggagctacaattcatgatgagatttgggtggggacacaaccacactatatcagaagacatggaatctccacagcccctctccccataccttgccctgtgcctcatctttttcatctggctgttcatctgtatcctttgtaatatcccttataataaatgggtaaacattaagtatggtgatttcctgagttctgtgagccactctagcaaatcattagggagagggtggtgggaacccctaatttatagccagttggtcagttccagaggcccagacttgctattggcatctgaggtggaagcagacttgtgggactgagtccttatcttgtgggatctgactccaagtatataatgtcagaattgaactgaattagaggatacccagttggtacccatgggagtactgacatgtaaggaaaaccccacccatatggtcacagaagtgcatggagttgagtaagtgtagtaggaaaaaacagtcaatttgcttttttttttttttcctactacacactttcctttttaaatttctggccaggaataaaatcaaataaccaagaattacaaatattcattgattatgggtgactactgttgaaatgcatgcagggtaggacatactccatgaatacattacaaatgcattcatgtcttcattttctgagatatcagtcatttcataatgacagggagataaaataaggcatgactctgctgggtgtggtggctcatacctgtaatcccagcactttgggaggctgaggcaggaggatcacttgagtccgagagttcaagaccagccttagcaacatggcgaaaccctgtctctacaaaaacacaaaaattagtcaggcgtggtggcacacgcctgtagtctcaactactctggaggctgtggtgggagaatcgcttgagctcgggaggtggaggttgtagtgagccaagattgcgccactgcactccagcctgggtgacagagtgagaccccacatcaaacaataataataataataaggcatgactcattttcttggtctagctagattacggcgttacacaaaagtaaaattagtgtaatattaaaagaatcaagaaaaaagctaaaacttgtttcaatgaacttcattcattcaataaatactagatattgtatgtacaagaggcaacatggtgagagagacagcaaaaccaccacgcagaatgaggtttatagcccaatggggagcttgggaaagcttacagagcaataaaattaaagtttgtcaccacatcccagtcttcatttctcactattattctccaggaaccatggctccttggagaaatggctgtttgtggtctgggacagagaaaatacaagatgagcctgcagcatcttgtagtgatgaaaagtaaagacgtgctttaaaaaaacaaggggacgggccaggcacagtggctcacgcccatcatcccagcactttaggaggccaaggcaggtggatcacttgaggtcaggagttcaagaccagcctagtctctttagtagagatggtgaaaccctgtctctactaaaaatacaaaaattagctgggtgtggtggcagacacctgtaacccagctacccgggaaactgaggcaggagaattgcttgaacctgggaggcagagtttgcagtgagccgagatcgcaccactgcactccagcctgggtgacagagcaagactctgtctcaaacaaacaaacaaacaaacaaaaaaaggaagggacagcttatcacaggaatgcaaggcccaaaactcactatgattaaagctggaacaatttgagcaacaaaataaataacacagtgtaaggttaaaacccaaagtataaaataaatgattgattgaataaattaatgtactggggtaaaagaggcaagtcttcctaacaaagaactttaaataatatctgtagacaccccacacttaccgattccactccttttgagtgtaagcgggtcttagtaactggcttccaataaatatggagtatagcttgagtctagaaaagggaaataggaccaggtgcagtggctcatgcctgtaatcccagcattttgggaggctgaggcagaggacagcttgaggccaggagtttcagaccagcttgggcaacatagcaagaccttgtctctacaaaaagtaaaaataaaaaaattagctgggcatcctagtgcacacctatagtcctaactactgaggaggctgaggagagaggattgcttgagcccaaaggtcaaggctgcagcccagaagggcttccagccaaggccttcctggctcttttttccttgggatgggaggccagggaaggtaaaaataactggataatgttgctagaatcacaccactgcactccagcctgggtgacagagtgagaccatgtcaaagaaaagaaaaggaaaagaaagagagaaggggagagagagagagaaagagagacagaaatgaagaaagaaagaaagagagagggagagacagagggagagagagaaggaaagaagacagaaaagaaagaaagaaagaaggaaagaaagaaagaggaaagaaagaaagaaagaaaggaagaaaagaaagaaagaaagtaaggaaggaagaaggaaagaaagaaagagaaagaaagaaagaaaagagaaagaaagagaaagaaagaaagaaaaagaaaggaaagaaagtgggaaggagggagggagggaagaagggaaggaaagaaagaaggaaagaaggaaagaaggaaggaaggaaggaaggaaggaaggaaggaaggaaggaaggaaggaaggaaggaaggggacagtggagaggcctggcagacactgctttaattccacaatcaaggtcagcatcagtgataggccatgttgatagcatgtacctctgtgcaattcctcctaaaaatccattattccagtctaaatcactaggaaaaactttatacaacccaaactgagcaacattcaacaaaatacctgaccagtcctcctcagaatggtcaagttcatgaaaaacaaggaaagactgaaaagctgtcacagaccagaggaggctaaggaggcctgagactaaatgcaacggaatctcttgcacagggtcccagaacagaaaaggagcattcgtggaaaaactagaaaaataaggtccggagttttgtataaaaaaaaacacataaaaaataaagttgagtagatgctatttttaaaaagtacaaggtgcaatgtgtctgctaaaaattcaaataataaaagttaattgacttttattattattttatatttattgtgtttttaatcaaaaaatgagctttgtactatatgcacattaaggctgggcgcagtggctcacacctgtaatcccagcactttgggaggccaaggcacgcagatcacttgagatcaggagctcaagatcagcctggacaacatgacaaaaccctgtctctactaaaaatacaaaaattagctgggcgtggtggcgtggtggcatggtggcatggtggcatggtggtggtggtgcactgcagcctgggtaacagagcaagactgtctcacgacaaaaaaggaccagttaaacaatacaggaagatacagagacaaacttaacccttcccctgcccaccattattctccagccagtcctcttctagataagcagtttgtgttgttttctacaatctctttgtgtttacgtgagaaacacagaatatatataggagcttttcctcttttttcacgttttaactacaaaagtattatcttactactcattgctctgcaactggcttctttcatgcaaaaatatattttaacactgtatcataaatatcttcccagcacaatgtatataaattgaacctgctctttctttaaatcaactttgctgggataaaatttatacagaataaaatgcacccatttgaagcatacacttattatgtatgcacagatgtgtagacctggataaccaccagcacataacttattatttttaaaatcaaagtcatcaatcatcttgccaaatctagtgaaatttcctggctcttctttctttggggtaggaagccagggaaggtagaaataactggataatgttggagaatgaccattgcaagactttgctcctcacatcccaggtgcatattccaagaaaattctgattccccgggaaaattctccatgcttggcatagtgctggagccatgtgactttggaaaggtctgagggaggcatttaggcagagactcagctggggaaatcactggggggccctgcaccaacagacaggcgcccagagctgaggaggaatggcagcggggcctgctgagttaagcagaggccacagacatcaccttctggaggctccctctaccactgctccatgggcaagcctgctagatacccagaaacaagacaaaagtgctacactgcccaggatttacttttaaagatgccaaggagggggctgggcatggtggttcatgcctgtaatcccagcactctgggaggtcaaggcaggtagatcacttgaggtcaggagttcgagactagcctggccaacatagcgaaaccctatctctactaaaaatactaaaattagccaggcatgatggtgcacacctgtagtcccagctactcaggagcctgaggcacgagaattgcttgaacctgggaggtggatgttgccatgagccgaggttttgccactgcactccagcctgggcaacacagcgagaccttgtctcaatcaatcaatcaataaaatgaaataaaaataaagatgccaaggagaaagtgtgaaccacagacttcctcccaagctgtcccttgaacctaggcaccatctgtagaagcaagacagaaaaggaaggaatagccccaaaagagagttgaatgtttaaaccagctgaatatttacctgaaaaaaagattgttttatgggagggtaaaatgggaccactcaaaactttaagagaccgagacatctctaattggcaagtttagctgttttccttgttccttggcaggacagggacctctcaggaaatttgatttggttagattgggactttgcaatagaattataatgcaagccacacatatactttcaaattttctagttgccacatttaaaaaaccaaaagctggccagtggctcgtctgtaattccagcactttgggaggccaaggtaggtggatcacttgaggtcagaagtttcagaacagcctggccaacatggtgaaaccctgtctctactaaaaatacaaaaattagctaggcatggtggtgcacacctgtaatcccagctactcgggaggctgaggcaggagaatcacttaaacccgggaggcggaggttgcactgagctgagattgtgccattgcactccagcctgggcgacagagtgagacccgtctcaaaataaataaataaattaattaattaattaaatagcaaaaactataggacccagaaatcccactcctagatatatacccaagagaaatcaaaacacatgtccacactaaaacttgtacatgcatgtttacatcaggattattccccagagccaaaaagagaaaacaaaccaaatgttcatcaacaaaatgtagcatataatagaacattattcagcagtcaaaaagaacaaagtacctatatatgctacaacagagatgaaccttgaacacattatgctaagtgagagaagacaaatgtaaaaaaccaaatattacagtatatgattccatttctgtgaagtgttcagaataggcaaatccaagaagacaaagattagtgtttgcttaaggctggaagggttggagaataattagaactgagaagagtatggggcttttttgggagatgataaaaatattctaaaattgattgcagagataatcacacaactctttgaatatactaaaaatgatcaaattgtacattttcaatgttacgtgaatatctcaatggagctgtaattttaaaaagcaaaaagatacatacagcattaatttataatattttaagtcaatgtattcaaaacgttgtttcgacatagtatcaagaatttaaaattatttttgagatagttacattcttttcttaaaatctagtgtgcattttacatttgcaacacatctccatacagatgctaaattttcattggaaatactatatagttagatttcataaaatttaccattgaaagagtaaattcatacgcacaagttgttccaaaaatattttaaagtcttccaacagctgaattgagtagtgttagtgaggtagtttctagatatagctgtagatataaatgggtaaatatagttattcagcacagatacatactcagagtatggtatgttaaaatttaactcctactgtgaaaatggaggtcattacgttaagtgaaataagccaggcacagaaagacaaatatcacatgttcttactcatatctgggagctgaaaagttgatctcatggaggtagagggtagaatgatagataccgaaggctgggaagagtgtgtgggtgggggtaatgaagagagtctggttaatggggacagacatacagttagatggaaaaaatcagtactgcagttcaacagcatggcagggtgactgcagttaacaacgatgtgttctatacttcaaaatggctggaagagaggatttgagatgttcccaaaacaaaggaatgataaatgctcaagataatggatatcctaaataccctgatttggtcattacacatgtgagacatgtaacaaaatatctcatgtgtcccataaatatgtaaaaatattatgtatccatttaaaaattaatctctactatatacaccaaaaacaaaactaaattcctcatatggcctcaaaaccctacaacatctgccctcacctcgctctctaatctcacatcatatcactctccttttcttccacaatgctctagccatactggtctttctactcctcattcactccttccccagggcctttgcacttgctattccctcttcccagaacaccttccaccaagatcttctcatacttggctccttcccatcattctggtctctgctcaggagtcatcatcctcagagagttccctgtcttgttcagtgtggtctccatccatcactctttaacccattattctctttttttgttgcatgtatcaccaatggattgtctccttgtggttacatttttggcaagaatattgtacaggcattgtatgaggaagcatatgatgatcagcttgattactcagctaagatggtgcccacatatttctccactctgaaggtgccttactatgaaataataagttatctgtggggaaatatttcaagactggtaccatacccttcccagcaatattccatattccatcttactctgtcacccaggcaggggtgcagtggcataatcatagctcactgcagcctcaaactcctgggcttaagagattcttttgcctcagcccccaaggacatgggactataggtacacaccatcgtgcccagctaattcttttttttaaattttttgtagagacaagctcaggctggtctcaaactcctggcctccaatgatcctcctgcctcagcctcccaaagcgctgggattacaggcataagccactgcacccaacaagagtttgagtttctaagtctaattccttctacatttattagttgacattcttcagtaaataagctcattcccttctctctcccttgtctttttttttaatatcagtataaattcagggattccatgtgttgttttccatttctgtcattattaatttccatgcttagattaccccagatttggaaagcccaatctgaatattttgaccctgattttcaagttggactcccttcaagctggctcctatatcattgcgacatgcccctgtcattttttcttaccactccatacattctgatgagaaaaaaaaatttaggtgtaccttgtagttttcctgccccagccctggaatcagccatttctccaatggctaactattaatgcacaatggtatttaagaaccaagatttgtcacacctgtaatcccagcactttgggaggccaaggcaggcagatcacgaggtcaagagatcaagatcatcctggccaacatggtgaaaccccgtctctactaaaaatacaaaaattagctgggcatggtggtgggcacctgtagtcccagctactcgggaggctgaggcaagagaatcacttgaacccagaaggcagaggttgcagtgagccgagatcacaccactgcactccagcctggcaacagagtgaaactccacctcaaaaaaaaaaaaaaaaaaaaaaaaaaaaaaaaaaaaaaaagaaccaatatctgagcattaggcgtgcccattcctactggtatgccatgcaccaaggaaacaaatgcactcataacaaacagggcctgggaagtcaggtccaggcaactgtgacatcaacaggattcaatattgaaattaagtcttattctccaagtggagaagacatttgttggttttagttgcccagcatcgaatcattcttctggtaacagcaccccttttttccttttggagaattacctctcccttctgtgaagagacatggcgaactgtaaattaaggtatcctaaccctctccccatatccaaaagggaggcactatttttctaaatcagacaggtccctgatttagggatggagtgagacaggtatgaggataagggggtttgaccacatatccagaattgacaaagccaagtgcccttcaaggtgaaactgaacgcccctttccaaggtctgttggcctctcatttggtgcaaggctttatctcacacagctaaaacttccctgtctttgtagaaaaattctaacacaacagagcccatcttgaatttctttccccaggattggttgtttcattcatcctttccaattcatagaattcagttgttttgacaaatgtctagatagctagcaatatattttcatctccttcgaaatcctcacaacagatatgctgcttgtaaatctgcgagggttttttttctgaggaaaatcttctaaaactttgctcatcttgtgtcaatccctgcagggtttctttatttgcctgcttgctggtttagtggggagaaaaaaaaaaaggctgaaatcctaattttcacaccttcaaaatgcataagctctgtctacctttcatttttctttctttgaattttttccctctttaagtccttgttttctttcttctccagcacatggtgttaggcaaaatggcagatatagatgaaaagatggaagagagggaagagaagggaagggaagggaagggaagggaagggaagggaagggaaggggaaaggaaaggaggggaagggaagggagggaagaggaggggaggcaagggaagggaaggatgaaggaaaggagaaaggggaggagggcaggagaaagggagggaaaggaaggaaggaaaggatgaaggaaaggagaaaggggaggagggcaggagaaagggagggagggagggagggagagaaaaatcaaagaaaaatgcttaacactccccaatgcttcataatgcaagaacacaataaaatattttgcatctttcaatgcctgggttttctgagtcatccaacactctgccattggacttgtttatatcaaaaggagttaatcgtcatgtaatgccattgttctgggggagaggaagacacagagaggcaaaaatgatgaatgccacttgtctctctaaatgagtaacaggggatttgaactcaatatgagctttgggaataaacgtggtaaacgtggttatttcagggttacaggagagaccaacaagcaaagtctaagggcttctttgcctgccctgcccttataaatctgaacttataggacaagatgggtggaagttgagtctcaggtgatgagttcagctatgtatggaaagaaataaagcagcatagggaggagatgttctgtaaaagttataattggtttttctgaagtttggagcaatagatgtacaatcaagggccttgcttaatttcccactcactaaaggcacttttagctcatcaaacatttactgagggtcagtgctatctgggaaggcaaaaataatgcagctctcaagtttttgctcataaacaagcaagggaaatggcaacctatcccctcacaaatgtaatagtttaggtttgtgttgtacaatgtttataaccaatggtatgctacaaactcttctaggtgcactgccaagtttgggtccttgtgcaaacgttattgtttgggttttttcatttgtttgtttgtttctacagctgcgggtacttactgctagtgattgttgtatgacttccgttgagttgcatgggtcatgtgagactgcaggaggtggagtctagttgagacaagtaaatacaagtgtagcaaaacatcaagagagccaccagaaaagaccatgtttcctacattcttgctactaaatgtgatacctgcagcatgggtatgacctgggagtttgaggaaaatgcagaatcaatctccagtcctgcgtcagacccagtgaatcagaaactgcactttagcaaggtccttgcatgtaaaaagagaggcagtatcttccagtatagaaaccctttctcatatggatgtataagagatcttcgtcagggcattaaacagcccaattgacatccaaggctcagccaaatgatttgtagataaaatgtaatatttgtattacattaatatataataatataatttacatttataatgtattttgtataacattaatatataataatataaaaaataatatatatataaaatataacctcttctagtgccttgctacggttcctaacgtgagagagaacaggcgcacattcagatagctgagagttacagtttacccaacgctccccttatatcaccacctttgagacttgccacatccctacaaggcaagtggtacaggctctagtgccacatccattttacaggtggagaaactgaggttctcagaggtgaagaaccggcccaaagtcacatgactcgaatgagatcccactgggacttgaacactgattgcctggcccaggaaaagagaattcttttccagctgactctgaaccagtgtaataaagaccaggctggttgtctgactgaaaagaaacggggttgggaggatgaggtgggaggatcacttgaggccaggagttcaagaccaatctgggcaatatgacgagaccccatctctacagaaaattaaaatacaaaaaatagccaggcacgatggctcacgcctggagtctcagctacgtgcaggttgaggtaggaggattacttgagtccaggagttagagggtgcagtgaggtaggattgcaccactgtgctccggcctggacaacagggcaagaccacatctctggaggggaaaaaaaaggaaaagaaatgttcttagtagcgcagtgacctatgctggtaagaaagcaggatttctctaatggggagctggacaaagtagataagctgacataatgcaggaagcttcagataccagatcctgagtgtggagctccatgaagaatccaccttcacattcatcaccttcctaggtacctggggggtgagacgaagtcatcagaccatcccactgaggcctagaaaccatccaggataacgcacctcccttaaatctaggacaggtgccttcttttgacaataatggccttttctctcctcagcagggtgactgaactctttcttcatctccaggagggactggaaaaaaaaaaaaaaacagatttagggcttcttgctgatataaaccaacttgacggaaaacccattgttcagccttgtttactcagccacctgctaacctgattgtggtcacttagggagaagttccccacagagaaactgaagagctttgcttaaagtaatcaacagagaccttgggggctcctacagacctcaggagcacagttttagcaactgtgcctaggaacctttttcctttggtcctaatcactcctcctgacatcatctataaaaccgcggagcctgacgggcttcagtaaaagggtccatgtggattctgtcatctggggcaagactggaggattcagggcactgtgtaggtaggtcaccgttttgtggtgacttgaacactgactgcaagtgtaatgcagcttcacccttttctcaccttcctcctggggccactaacttcatggggaagtccagggtaggacagcaagaagcagaattcctgggttgatgcccaattaactcaatatgtcactagcttattttggcctatcctcagggcaaattagaaagcaaaagtctcaagggacgtcttggtgttgattacctgacacccaagcattgacaagctatgttcaatgcattatgctactactactaataataacaggccaggcacagtggctcatgcctgtaatcccagaactttgggaggccgaggtgggtggatcacctgaggtcaggggttcgaaaccagcctggccaacatggcgaaaccctgtttctactaaaaatacaaaattagccggacgtggtggcacatgcctgtaatcccagctactcaggaggttgaggcaggagaatcacttgaacctgggaggtggagtttgcagtgaaccaaaattgtgccattgcactccagcctggtcaacaagagtgaaactctgtctcaaaaataataataataataaatataatttaagagccctcctgggcttgcagaattaagattggccagtgtctttctcatacacagaagcagacaattttgcatcattctgttcctcccattcaccccaatatcaattatgtcctatgctcatgtttcagaaaccagtggtatcagcaaagcagaaaccactctagatatttcaaaccaaggagttaggtataaggtttggagatggatggaagagcaattggaaaagtgggtgggtctgaggagcaaaaagaagacgtgataaccgtagatcaaaaactgctaatgggctgggtgctgtggctcatgcctataatcccagcactttggggggccaaggcaggatcgcttaagcccaggagttcaagaccagcctgggcaacatggggcaaccccatttctataaaaataataataataatttgtttaaaaaaataaaaataataaatttttagaagctgctaatgctcctaggctggaacccatcagcctccatctaacattgtgccattgaagacactgctgataaatcagctctgaatttatcagagggccacctccaccagggctagttctgctaagtgccgcctctgcctagaatactggaatctggaatcaccccacctctgttcctgctgtaactacagaaatttccctcaaatatccagaaaggatcacggctgggattcaagcccagtattgtgattctagaactcacatgcttaatcactacaataggacaaacaaacaaaagattttaatgtaagtataactgatagcttcaaagagctaagagcagatcatgtattctataaacaagaccaatctgacatggaaaagaaccacacctagttgcaacagggtgcaatttcagtgagaacagagtattctaaaaagttcctaagagaaaaaaaaaaaaaaaaacctcactaagggatgaagtagcagatcggtagcatattcctcgttggtaacactggatgctagaaggccacacaggcgttttcaactcggagactttctgaaagagcgtacgttgttgttgttgtggttgttgtcgttgttgttgttgttgttgttgtggttgtggttgtggttttggttttggttttgagatggagtatcgctctgtcatccaggctggagtgcagtggtgtgatctcagctcactgcagcatccgcctcccaggttcaagcgattttcctgcctcagcctcccgaagagctgggagtacaggcgtgcaccaccatgcccggctattttttgtatttttagtagagacggggttttgccatgttggccaggctgatctcaaactcctgacctcgggtgatctgccagcctcagcctcccaaagtgctgggattacagacgtgagtcaccgcacctggccagaaagagtatactttggaaaaacagacaaaatctaaaattgttttcagtaatattctgcgaggggagtagggaaggtgggaaagggttgaaattacctgttgtgtactatattcattgtttgggtgatggattcaatagaagctaaaactccagcattatgtaatatgcccacgtaataaacctgcacatgtaccccctgaatccacaataaaaataaataagtacataaataacattctgaaactaaagttccagatcatttcaacgtaggaaatagcagcagatggctaaggtagagaagtgaaaacatgctgcttgttcttttgctccggatgaaatcctaattaactctatactttgaaagaatagtatgtttcataatgtgtttaaaatgtcaaagataattgccaaagagacagaactagcgtgcattacttccaaaccactgaagaaaaaaaaatgcatcaaggaaaacataaccaatgtaacagggggaaaaaaaaaagcaggaaagaaaaagaacaaactttaaaacagggtaaatgaacatttctcaaaagaaaacatacaaatggacaacagggatatgaaaaaaatattcaatgtcactaatcataagggaaatgcaaagcaaaaccattacgagatatttcaccccagttaaaatggctagtatcaatgagacaaaaaataacatgctggtgagaatgtggagaaaggggaacactagtgcattgctggtgggaatgacaattagtacagccattatggaaaacagtacagagatttctcagaaaactaaaaatagatctaccatataatccagcaattccatgctgggtatatatccaaaaaaaggaaatcaatatgtagaaaagatacctgcacacccatgtttattgtagcactaatcataatagccagcatatggaatcaaactaagtgttcgtcaatggatgaagaaagaaaatgtagtatatgccgggcgtggtggctcatgcctgtaatcccagcactttgggaggctgaagtgtgcagatcacctgaggtcaggagttcgagatcagcctgaacaacatggagaaaccccgtctgtactaaaaatacaaaattagctgggcatgatggcgcatgcctgtaatcccagctactcaggaggctgggacaagagaatcacttcaacccgggaggcggaggttgcagtaagccgagattgcgccattgcactccagcctgggcagcaagagcgaaaatctgtctcaaaaaaaaaaaaaaaagaaaacaaaacaaaatataatatatatacacaatggaatatccagttagccataaaaaggaatgaaattctgtcatttgcagtaacaccaatgaaactggaggacgttaagggaaataagccaggcatagaaagataaatattgcatgttctcactaatatgtaggaccttaaaaagttcatctcataaaagtagagtagaagtatggttaccagagggtgggggggtgagtgaggggtgaagagaggttggttaacgggtacaaaaatacagttagaaggaaaagttctagagttcaacagcacagtagggtgactatagttaacaataatttattgtacatacacaaatagccagaagagaatatttgaaatgctcccaacacaaagaaatgataaatgtctgaggtgatgaatatcctaattgccctgatttgaaaagtacacattgtatgtacgtatcaaaatatcatatgtacctcatacatgtgatattttgcataattgatgcataataatatataattattatgcatcaatttttaaaacatggtaaattggaatttgaaatatcaggagtaaattcaaacttatcaataggcataataaacataaatgggttaaatttctctaataaaagacaatgcctttcagtttggagtgcttcttttaaaaaaaatccagttaaatactgtagacaagactatgcaatacaataaacaacaaataaaaacaagacaacatagaaacattgaaaacaaaaatgtatatcacaaaaattctaacaaaaagaaagcagcagacgcaaaacaaaagtaaaaacaaatttccctataatcattatctagttgtcactccagagaagtaggcataaaactggttaatgggagttggcaagataagtcagttaagtatttaagagactcatttttaaattcgatatggtggtggtggtggtgagtctgtgggtggtggaacacgtccatgaccagatctagacagtagcaacagccatcaatgtctgtcactaatctcctgtggattttagatctaacataaagattgcatacggctcattctggagggatgaccagaagtgacaagctaaaggtcctcaccctgaaagtggatgcatctctgtcttctgagaaacttagatcacaggacatgagccatagataggcataaaacctggaggtataaaactttcaggccttcgcttatgctgttttctttgcttagatgacctcccactgcactcatttccacctgtcaaaatcctccttatcctttaagaccacctttttcatgaagctgaattttacccttaccaccagagtggtttcccacagtactcattttgtgtctctctccagacattcactgtactctctattatagattgctttatatttctgtgtatctctttatataggctctttaaagatgcattagtcagctattgccgcataacaaacaactaatatttcagttgtttacaatgacaaacacttctgaaaactctcagtgatcagtaggatgactgcaatttaactgatctaggcagggatcagatgggcaggtctacctcatgctgtgggaaacctgcgcttagctttaggctgtgtgttaaattcaggtctgcctcacatatttttgctgtgactctcagactaaaggagaaaccgctatgcagagtgtgttcttctcatagtggatcaggagaacacaagaacatgaactacagcacaaaaagcacatgtgaggcatctgtttgcatcatatctgattcatgttccttggccacaagtcacatgggcaaacccaacaccatggggtggtgctatagtttggatatttgtccccagccaaatctcatgttgaattgcaatccccagtgctgaaggtggagcctggtggagttagtttgggtcacggggacagatccctcatgatttggtgctgtcttcacgatagtgagtgagttttcatgagatctggtcatttaaaagtgtgtgggctacgcacggtggctcacgcctgtaatcccagcactttgggaggccgaggcgggcagatcacaaggtcaggagatcgagaccagcctgaccaacatggtgaaaccctgtctctactaaaaatacaaaattagctgggcgtggcagtgcgcacctgtaatcccagctactcgggaggctgaggcaggagaatggcttgaacccagaaagcggaggttgcagtgagccaagatcgcaccactgcactccagcctggtgctggagcgagactctgtctcaaaaaaaaaaaaaaaaaaaaaaggtgtagaatcttacccacactctctctctcactcctgcttttgccatgtgacgtgcctgctccctcttcacttctgccatgagtaaaagctccctgcggcttccccagaagccaagcagatgccagctccatgcttgtacagcctgcacaactgtgagccaattaaacctcttttctttataaattatccagtctctagtatttctttttttttgagatggagtcttgctctgtcacccaggctagagtgcagtggcgcagtctcggttcactgcaagctctgcctcccgggttcacgccattctcctgcctcagcctcccaagtagctgggactacaggcgcctgcaaccatgcctggctaattttttgtatttttagtagagacagggtttcaccctgttagccaggatggtctcgatctcctgacctcgtgatccgcctgcctcagcctcccaaagtgccgagattacaggtgtgagccaccatgcgtggcctctggtatttctttatagcaatgcaagaacagcctaatatgggtggggaaatatgctctgtccatctggtacactgaaaggtcatatggtagaaaaattgtgatcactaaccaatctaaccaggctaggtggctcaagcctgtaaccccagcactttggtagcctgaggcaggaagattgcttgagcccagcagtttgagaccagtctttgcaacacagtgagaccttgtctctacaaagaaaaaaaaaagtgtaagttagccaggcatggtggcacatgccatgatcccagctactcaggaggctgagataggaggatcacttgagcccagaatgttgaggctgcagtgagccatgatcgcaccactgcactccagcctgggcaacagagtgagactctgtctcaaaaataataacaataataataataataataacccaatctaccataaaaggcagaaaacaagccatatcctttcatttctctattcctaccatttagtaccacgaccagcatagaataaacatcaagcaataattgtcaaaatgaattgattattcatggcatggagtaacatgagacatacacataatgcagtggttaagaacttggacgtcagagtcacaaagacctgagttcaatgtaaaatgacaaaggctctttgaaaagtttcgcagtttcttacaaagtttaacatgagcttaccataaaacccagcaattccacttctaggaaactacccagatgaaatgaaaacatccgaccatacagaaacctacacatgaatgtgcatagcagaactctttatagcagccaagaaatagaaataatccaaatgctcatcaactggtaaaatgaataaataaaatggggtatacccaaacattggaataatattcaggaataaaaaggaatgaactatgttgttgtcgttgctgtttttattgaggcagagtcttactctgtcacccaggctggagtgcagtggcataatcttggcttactgtaacctctgcctcctgggttcaagtgattctcctgcctcagccccctgagtagctgggattacaggtgcgttccccacacccggctactttttgaatttttagtagagacagggttttcccatgttgtccaggctggtcttgaactcctgacctcaagtgatccactcacctcagcctcccaaagggctgagattacaggcgtgaaccgccacgcccagccaggaatgaactgttaatatacaaaacaacatagttatctcaccataagcaaaagaagtcaaatgaaaagactacatattgtgtgattctatttatatgaaatgtccggaataggtaaatttatagagacacacaggcccaggcacagttgtcaactgaagctacagatgggaatgaggattgacggcaaatcagcaccaggggtcattctggacaccatggaaaggttctaagactgtattgtcatgataattacacaacttttaaaatttactaaaaatattagctgggcatggtagcccatgcctgtagtcttaactactcaggacgctgaggtaggaggatggcttaagcccaggagttcaagactacagtgagctacggttatgccactgtcctccagcctggccaacagagcaagaccctgtctctttacaaaataataagtgggccaggcatggtggctcaagcctgtaatcttggcactttgagaagctgaggctggcggatcacctgaggtagggagttcgagtccagcctgaccaacatggagaaaccccgtctctactaaaaatacaaaaattagccaggcgtggtggtgcatgcctgtaatccagctactcaggaggctgaggcaggagaatcacttgaacccgggaggcggaggttgcagtgagccaagttcatgccattgcactccagcctgggcaacaaaagtgaaactccatctcaaaagaataaaataaaataaaataagtggctcatgcctgttatcccagcactttgggaggccaaggtgggtgggtcacctgaggtcaggagctcaagaccagcctggccaacatggtgaaaccccatctctactaaaaatacaaacattagccaggcaaggtggcatgtgcctatagtcccagctactcaggaggctgaagcaggagaatcgcttgaacctgggaggcagaggttgcagggagccgagactgcaccactgcagtcaagcctgggccacagaatgagactccatctcaaataaataaataaatgaaataaaatgaaacgaaataaatttactaaaaattattgacatgcacatccaaatgggtgaattttaataaattaaagaagaatctgtgttcagaacttggctctaccatttagtatccatgtgatctagagcaacttatacagtgacataacctctgtgagcctcaatttctccatctgcgaaatggagatgaaacagaggcctgctgaagagtagatgagataatgcaggttgtttccccagcacagggcttgagaggtgtctgaggagttcttagggactctctagcaccctgtgcttttagggaaatcatttccacccaagtccctcctacgtccaaggtccaacccttgtttttatttaagttgctggttcccatattcccttaggaatatgttgttctctgccttgtccccaaatccctagtgcaagaatatatatatatatatacacatatttttttttttgagatggggtctcgctctgtcacccaggctggagtgcagtggcacaatcttggctcactgcaacctctacctcccaggttcaagggattctcctgcctcagattcccaagtagctgggattacaggcttctgccaccacacgcagctaatattttctatttttagtagagatggggtttcaccatgttggccaggctggtcttgagctcctgacctcaggtgatccacccgcctcggcgtcccagagtgctggattacagatatgagccgacatgcctggcctccctgatgcaagaattactcagactttttctaggccagaataagagtaggtcaacctcgtccaatccacagctccagaaattgaggcatttccagaatactgtacagagatgagaggccctggccaaacaaacacattacctttccactttgtattttacttctctttcttaacaacaacaacaacaaaaaaaaaaacaaaaacagaaacagaaacaaaaaaaccttggcttggcagttctaagctagggctgacagattctataagaagtcccagaaaacatctcagcctttgcaatgaaccttcagggaacaagtggccagtgagaaggtgattcactttgatgatagcttcctgatgagggctggaaccagctggagggttggtcagtttacgacttcatagaagactcaataaaagtcataaataaaagggcacgtgggtgtgagtgcacttcacagtgttgggaggccccatacgacagaacacaagaccgataattctgacttggctcaaggtttatcacctacgcagtgaaaggtgcagaccccatatgcctgggctgcttctctcccagtggaaatagattgagcctatggactaggggggccatttctcagattcctcaggccttggatctgtgggtagtgcggggtgaggaatggctgccttctctaataaaataaatcttggtgcctccaaggttgaccctggataaggacactcctgggagtacacaagggatgcctccccttccaaactgcctgcccctccaccattcaatcccagagctgagcgcttagtcttctaatcaccttagaataggtctcatgttgtgctttcattcattcatttaataacactactattattatcaatattaataaagctgattctgagttcacctcctctcctgcagtaatacaaacttcaaggcattctgtgatagtgagagttaaatgagacagagttgaaaaaaaaaaaaacaacttagcacctgcggggcacatagttaagctccataaatggtagctatataatttctgactatcaaaaccgtttcttggtcttgcatggcagctcaatcctgtaatcccaggactttgagaggccgagggaggaggattgcttgaagccaggagtttgagaccagcctaggcaatatagcaaaactacagctctacaaaaaaaaaaaaaaaaaaaacagggccaggctcggtggctcacgcctgtaatcccagcactttgggaggccaaggggaacagatcatgaggtcaggagtttgagaccagcctgaccaacatggtgaaaccccgtctctactaaaaatacaaaaattagccaggtgtggtggcgcatgcctgtaatcccagctactcaggaggctgagacagaggaattgcttgaacctgggaggcagaggctgcagtgagctgagaccatgccgctgcactccagtctgggcaacagagcaagactctgtctcacaaaaaagaaaaaaggaaagaaagccccaagactgtgtaatttataaaggaaagaagtttaattgactcacagttctgcatggctggggaggcctcaggaaacttacaatcatgggggaaggggaagtaggcacgtcttacatggtggcaggccagagagaatgagcaggagcagggaaactgccctataatatcatcacatttcatgagcactcaatcagtatcacgagaacagcatgggggaaactgcccccatgattcaatgacctccacttggtccctccctccatacttagggattatggggattccaatttgagataagacttgggtggggacacagggccaaaacatactgtcatgctaccaggaattttgtctgtctcatttgcccatatcagcagcaaagggcctagcacctaggaggtgctcagaaaacatttggtgaattaattaataaggaagctaagaatcacagatgtatggtacatagtttcagtaaagaacaagacattggaattggggtgacctgggttgcagccccagctttgttatttacctgctgtgtaacctctaaacttcatccacaaagtggatgtaactatggtacctatctcctgaagtctgagggaggatgaagtgagataacactaacaaaagcatttggcaaccaagacctcaataaatgctagctatctttattatagtttcaacacatagccaagtccacatttgaatttaattcatggaagaagaggaagaagaggaaaaagaagaagaaggaggaggaagaggaggaggagaggagatggggagggggaggggggagggagagggggaggaggtagaggaagaagagaagattgcggtgatctcaggagtaagtatcaatggaaaaaaagatcctggcttgaaagcatgtagaagacttgcgagcagatggaaacaacccagtcagggccggaagtgatggcttacacctgtagtcccagcactttgggaggccgaggcaggtggattgcttgaggccaggagtttgagaccaccctggccaacataacaaaaccccatctatactaaaaatacaaaaaattaaagttaaaattaactgggtgtggtggcacacacctgtagtctcagctacttaggaggctgaggcacgagaatcgcttgaacccgggaggcagaggttgcaatgagccaagattgcactactgcactccagcctgggtgacaagagagagactctgtcaaaaaagaaaggaagggaaggggaggggagggaagggcagggaagggaagggagaaagagaaagaaagaaagagagagaagagaagggaagagaagagaagagaagagaagaaggaaggaaacaacccagttggtgcccaatatattcttactgaattatatcagtctctataaatgccgccaactgtcttaaacattccagacttctccttttcctactccggctaaggggagttagatgttatattcttccctccactctacactttgggagtggcttttcaagttttgcattcaatctctttaaggacactccacattgatcatatccaaaatgtctggattgaatgttcctcagatccagtggttctcaaagtgtagttcccagaccagcagcaccagcatcagaatcatccaggtacttattacacacgcaaatcttattttggatatggtggctcatgcctgtaatcccaacactttgagaggccaaggcaggtggattgcttgagcccaggagtttgagaccagcctgggcaacatagagagactcatctctacaaaaaatacaaaaattagctaggcgtggtggcacatgcctgtagtcccagctactagggaggctgagtggggaggatggcttgagcccaagaggtcgaggatgcagtgagccgagattgcaccactgcactccagcctgggtgacagagcaagaccctgtcaaaaaaaaaaaaaaaaaaaaaagcagatccctagaccttaccctcgacctcctgaacaagaaattctggggggatggatcccagcgatttgcattttaacacgccctccacgtggctctgaggtatgggaaagttttgagaactgcagttctaacaaaaaggcaaacagggcaatcaaaagctgttttctctgcttagtccctgagtggtttcctggttggttggttgatttgagctggagtcttgctctgtcacccaggctggaatgtagtggggcgatctcagctcacagcaacctctgcctcccaggttcaagtgattctcctgtctctgcctcccaagtagctgggactacaggcgcgtgccaccacacccggctaatttttgtatttttagtagagatgggttttcaccatattggccaggctggtctcgaactcctgacctcgtgatccacctgccttggcctcccaaagtgctgagattacaggagtgagccactgcgcctggcccggtttcctggttttgaattgggaagagtgagatgaaaacaggactccctgcagaacaaatggcttctccaacaaattgtaatggaattttacatgagaggagccagaaaactgctgctcaattagtcagccaaaaaatatggagtacctactatatttcaggtgctgcgcaaagtgctgggggaaccatggtgaacaagacctatgcatccagctcttcaggattgaacactgggtgccagcagactgcatttcacacacatcaaactggcaaagataaaaagtctgacaaaaccaaatgtcggagaaactggaattctcatgtactgcaggtaagagtgtaaattggtacaactgttctgcagagcaacttggtgaaattgagtaaagttgaagaagtataacccccacagcccagcaattccactcctaggtacataccctagaccaggagaagctctatcagtttgcacaaggagaaatgtacaggaatgtatatatctgagatggagttttgctcttgttgcccaggctggagtgcagtggtgtgatcttagcttatcgcaacctccacctcccaggttcaagcgattctcctgcctcagtctcccaagtagctgggattacaggcatgcgccaccacacccggctaattttgtatttttagtagagatggggtttctccatgttgattaggttgtctcaaactcccaacctcaggtgaggtgcccacctcggcctcccaaagtgctgggattacaggcatgagccgccgtgcctggcctgtacaggaatatttactacagcactgtttgtaatagaaaaatagaaacaggtcaggtgcggtggctcaggcctataatcccagcagtttgggaggccaaggtgggtggattgcttgagctcaggagttgaagcccagcctcgacaatatggtgaaaccccatctctacaaaaaatacaaatattagccaggcatagcggtgcaagcctgttataatcccagctactcaggaaggctggcgtgggaagatcgcttgagcctggggggtcgaggctgcagtgagccatgatcataccactgcactccagcctgggtgacaaagtaagaccctgtctccaaaaaaaagaaagaagaaaaaaagaaaaagagggagagaaagaaagagagaaaaagagaaagaggaaggaaggaaggaaggaaagaaggaaggggaggagagggagatggaggggaggggaggggagggaagggaagggaagggaagggaagggaagggaagggaagggaagggaagggaagggaagggaagggaaggaagacggccaggctcagtggctcacgactgtaatcccagcactttgggaggccaaggtgggcggatcaccagaggtcaggagttcaagaccaccctggccagcatggcaaaaccccatctctactaaatatacaaaaattagccaagtgtggtggtgggtgctgtagtcacggctactcgggaggctgaggcacgagaatcacttgaacccaggaggtggagtttgcagtgagccgagatggcgccattgcactccagccgggcaaaagagcgagactctgtctcaagaaaaaaaaaaaaaaaaaggaacctaaatgtccatctgcagaatagatagcttaattatgattgagttctaccatggatgctagtactaacagattaacactaacaatagtagaaaataaatgaaacataacctgtatcaacattaacactttgcaaaatcggccaggcccagtggctcacgcctgtaatcccagcactttgggaagccaaggcgggcggatcacctgaggtcgggagttcgagaccagcctaaccaacgtggagaaaccccatctctaccaaaaatacaaaattagctgggcatggtggcgcctgcctgtaatcccagctactcaggaggttgaggcaggagaatcacttgaacctgggaggcggaggttgcagtgagctgaaatcacaccattgcactccagcctgggcaacaagagtgaatgaaactctgtctcaaaaataaataaataaataaaaataaaaataaattgcaaaatcataacaatgaaccaaaaagcaagccatgagaacaatacatacagtggtagtctatttaaagtgtttaaatatgcaacataatgttatatgttgataatggataacatatattcaataagaatacaaaataggcatgaaatataagacacaactgcaggatagagatcccattgggaaggaaggaagagagaaaggagcacgagattaagaggggtccacagaaggacttgattgtctttgttatattttttaaactgagtgacgggtaaatggttgttcactgtactggtctttatagttttttgtgtgcctgaaatagttcagaataaaattattttaggtcactttttttctgggttttttttcttatttcttttaaggaaagcaacactagagaataaaattattttaaataagccactttgagtaattaatgtaaaattacaaatgtgcaaagcactgcaaagagggactacagggtatcataagaggagatctgacaaattattcttcctctatctcaaccctgcccttaatctggcttcttaaaagtcttactattaaccccagccaattataagttattttaggtcaggtgtggtggctcacacctgtaatcccagcactttgggaggccgaggcaggcagattgcttgagaccaggagttcaatcccagcctggacaacatggagaaaccccgtctctactaaaaatacagaaattagctgggcgtggttgcatgcacttgtaatcacagctactcaggagactgaggcatgaaaatcgcttgaacccaggaggtggaggtgcagtgagccaagatcatgctactgtactccagcctgggtgatagagtgactctgtttcaaaaaaaaaaattatttaaaaaaagttattttatttttgtttgtccatattctctaatttttctacccagaagatatgccacttatatttcaaaatatctaaatgatatttttaaacaaggcaatcaaaatcagcttacaaaagtttgcataggatatctcaatgttctatgtatctagtatatgcttataagtatagctaaataaggggaggggaattctgggaggatttacattaagaagtcaacagtcattatttctagatggtgcaagtattggaaacttgtcatttgcttctcttttttttgttttgttttgttttttgaggcagagtcttgctctgtcgcccaggctggagtgcagtggcgcgatctcggctcactgcaagctccgcctcccgggttcacgccattctcctgcctcagcctcccgagtagctgggactacaggcgcccgctaccacacccagctaatttttttgtatttttagtagagacagggtttcaccatgttagccaggatggtctcgatctcctgacctcgtgatccgaccacctcagcctcccaaagtgctgggattacaggcgtgaccactgcacctgacctcttttttttttttttttttttgagatgaagttttgttcttgttacccaggctggagtgcaatggtgtcatcttggctcacagcaacctctgcctcccaggttcaagcaattctcctgcctcagtctcccgagtagctgggacgtgccaccacacccagctaaatatatatatatatatttatatttagtagagacagggtttctccatgttggtcaggctggtctcgaactcccgacctcaggtgatccgcccacctcagcctcccaaagtgctgggattacagatgttatatgcttcttatatagcaatatccattgttttcatcaattcatttccttctctttcttttggaacagaatcaccactccctgtggaggacctatttaagtggaccattccttgatttcatctcccctggccattgactcactgatctggccaatcagagcacctcatccccaaccacagggattggttcaaggatgcacaggtggtacagccccaaccacagggactggttcaaggatgcacacgtggtacatcttcacccaatcaagtccctccctgagactttcctatctgagcactgagaagagcctcttcctttctagtagcattgttcagttggtggagattaatctggaattgataatgtctaccttttccaccatctggagaaggcctattcatgaaatagagacagagcaagcaagatggcattccgctaataacgtttgagccctggatacagccatgcctgatccacctctgtgacagccttgttctgtgggccaatatattctcttgaatcatctaaaccagtttgcaattgatttctgacactttcagctgaatgagttctgactttttatattttttctgttagcttgactatattcatcgctcatgacttctgacttttacactttcattttgttcccatctattttctatattttccacaatgagcttgtatcacacgtagaatatgtctcagactctcttttttaaagcaataaaagaaatggcagattagcatttgactgcagagggctggctcacagacacttttcacctaaggcgtaggttgggcctgcctaatctgggggacaccatgggttgcctctggctcctctgaggtccccaggcctgactcactgcttccaaactaaagactttactctcccaaatcaagagcactgccaaagacacctttgctggtttccccccctcacaccccttggtccctgctttaaagtggtaattagcatagagctgggtgtctttttccctgtgggagaaacagtccttaacagtgtgaagtggaacggagtgtgggtggccttaacaaggagctaaggaagcttatgtaagtggcattattatatatgattatatcaccggtataagagaaactcattcctgtctgggtgttataccgatcatattgttttaggcttaagtggaatgaaatgatgaggaaaaaccatgagagcctccagcaacccaaggttgttcttgctccttctctcaaccccagaataacatcaacacttactcagccttactatgttccagacactgtcctaaactccttctgtatattaaatcctcattgaaatttcatgaggggagaatcattattatccccattttacagatggaaaaactgagttaccaggaaatttcataatttgcccgagatttcataatttgcccaatatctcatggctggcaagtgggagagccaagatcccaacccatgccatccaatcccgatgtccacattcaaaacctctcagaaaagacaacactgaagctgtgcacaaaaccagaaatcaaccagccaggtctctccatgtcgtcaaatacacaacaaatttattaatgggtttgggggggtgggaaaatcaacctcactggggtttttggggtggttttgggttgggttttttttttttttttttttgagacggagtgctaggattacaggcatgagccaccacgcccagctatttttcaaaccattttagatggttcatgtgctttctagtttaccatagtccccaccactctctaatgtcttacacttggcccacatcactcatttacagggaatctgactgaattagcagcctctgatgcagggaatggttgataacaaaaggagaagaaaactttcttgttggcttcgaaagaataactgggtaatcataatagttaaaatatgttgagtatttatgccagatcttgtaccaaatgttttacacaccttgtctcatttgattgtagtaacaatcccatgagaggttaagtgatgcgtggccacaagaatgcacctgccaccgacctccagctatggggagcataagagagcaagggcccaggtagatttaaaatccatctcacccatcaatagtgtatggcagcagagaaactaaggcagctcattcctagaaaacacaggggcccttgacaactgactttggaaaccccaattttcattagaccgcacagcacggacagttccaccaacattctctcttctcctcccttggagtcaggcttcatcactgtctaactcctttcacacaagggtttcccctaacaaaacccttgcatgttaggccaggtgcggtggctcacacctgtaatcccagcactttgggaggccaaggcgggtgaatcatgaggtcaggagatcgagaccatcctggctaacacggtgaaaccacgtctctactaaaaatacaaaaaaattagccgggcatggtggcaggcgcctgtagtcccagctactcaggaggctgaggcaggagaatggcgtgaacccgggaggtggagcttgcagtgagctgagatcgtgccactgcactccagcctgggcgacagagtgagactccgtctcaaaaaaaaaaaaaatccttgcatgttgagtctcaaagcaagctctgcttctcggaggacccagactgacacaaggagatttcctaaggcctcacaccaagcaaggatagaaccaggattggaactgaggccacaagccagaactctgaaccactacctcaaaattttcttgtccatggattcttattttctcaaatttcttggtccagaacaccagaacagctggagatttccatctggatccaagagtgaaccaaaggcaaaagggacagttttttgtttttgttgttttggctgggttaatagctttataacttttttttttagacagtgagtctccctctgtcacccaggctggagtgcagtggtactatcttggcttgctgcaacttccacctccctggttcaagtgatcctcctccctcagcctcccaagtagctgggattacaggcacatgccaccatacccggctaatttttgtatttttagtagaaacggggcttcaccatgttgaccaggctggtctccaactcctgacctcaggtgatccgcccacctcggcctcccaaagtgctggcattacaaatgtgagccaccacgcccagcctgatagccttgacacctcaaaatatctagcaaagacaaacataaaaccaagataaaaatgtatgttgccaattctgaagacatttctatttgtatttaccaataattttaaagctagctagtttcgtaaagatttacttaagtcacgtgaacctgaaaattgcttggacttattaagttatgagcactctcttacttataagccaatgtggtaggcacaacatataacagtaagtctacatacaaataaacacatttagacatgtatacacgcacacaaatgaagatccaaatggcttttaccttggaactctagccatgagatagcaatacaagctcgccggttttacatggttacactctgtttgccccagtaggtaatccagtgaaggctgtgaaccaaaattttggggtaaagcagtttccatgccagtttgatttttaaattccaaagaacaccggggccaaacagcaccaaaagagagtaccacatgctaaccaggcctgaccctgcttagaacagcagcacaaaagcttggatacatacaacaccatcccactttcccattcaacaacaaactccagattccaagcaatattggggacaaactattgcaaaagaatatcaagcatttcctccttagattattggggtcaaattgataccagtggttgaggatgcagccaagcgggggatcaggtagcatagatggagtctttcccgttattgtcccctggctggaacgccaaaatatgttaccagtggagggtgtccaggttcttggcagtttgaacaaagactcagacaaaacatacaaagcaatgaaagagtaaatcaatgaaagcacagatttgccggatgcagtggctcacgtctgtaattctagcactttgggaggctgaggcaggtggatcacgaggtcaggagatcaagaccatcctggctaacacggtgaaaccccgtctctactaaaatacaaaaaattagccgggcatggtggtgagcgcctgtagtcccaactactcgggaggctgaggcaggagaatggcatgaaccctggaggtggagcttgcagtgagccgagatcgcgccactgcactccagcctgggcaacagagcgagacgccatctcaaaaaacaaacaaacaaacaaaaagaaagcacagagttattgaagcaaaagtacactccacagagtgggaatgggctcaagcaagcagctcaagagccaagagggagagttttgaacccccaaagccaggcacaatattcattcctagatcctagtaggctccacagcaatcaggaaagtgcatcggctgcccagagcacaagaaggaaacacaggtaactgacaagtggacatatgtctatgattctcctttcctatagtcctgcagaaaagtcagcccctcccccaggactggggcaacacaaggccatgaacaataagagagagcacttgactaggagtctggtgatgcacccagcctgccccacaaagatgaagcagatagcagggtgaagagctttgtagtccatgaagtattttcatgtccactatcacactattggattcttttgtccactatcacactattggattcttttttttttttttttttctgagatggagtcttgctctgtcgcccaggctggaatgcagtggcctgatctcggctcactgaaacctctgcctcccggattcaagcaattctcctgcctcagcctcccaagtagctgggattacaggcatgtgccaccacactcaactaatttttgtatttttagcagagacggggtttctccatattggccaggctggtcttgaactcgtgacttcaggtgatccacctgtctcggcctcccaaagtgctgggattacaggcatgagccactgcgcccagcctgctctacactttgaggcctgctttctgttagctaaaatacagaaaagtcttagaaacatactagtatcaaattgagctattgtccttggtgtaagcagattaaaagggaactgaaatgagattgatagtttcacttcaaaatgcatcccagaccagagctcttcctaacctcagcaggggtaccaccttactgcaagtccccattatctctctcctagcttttagctactcaaaatgtggtccaggaccagcagcactggcatcacctgggagctagtcagagatgcagactccagacgcagactccaggggcaggaggctgagttttaacaacccctgcatgaaattctcatgcatggttaaaattgagaaccactgccctagattacaacaaccttctaaggggtctacatgattctattctgcccactaccctgcatccaccaacatgtcttagaggtaggaggcaggactcaactccagaggtggggctcagacaccagaccaaattgaagactagctataaaacagggcccctctccctccccctccccctcccctctccctccccctccccctccccctcccgtctccctctcccgtctccgtctcccactttccatggtctccctctgatgccaagctgaggctggactgtactgccgccatctcggctcactgcaacctccctgcctgattctcctgcctcaggctgctgagtgcctgggattgcaggcgcacaccgccacgcctgactggtttttgtattttttggtggagacggggtttcgccatgttggccaggctggtctccagctcctgaccgcgagtgatctgcccgcctgggcctcccgaggtgccgggattgcagatggagtcttgctcactcagtgctcagtgttgcccaggctggagtgcagtggcgtgatctcggctcactacaacctccacctcccagccgcctgccttggcctcccaaagtgccgagattgcagcctctgcccagccgccaccccgtctggaaagtgaggagtgtctctgcctggccacccatcgtctgggatgtgaggagcccctctgcccagccgcccagtctgggaagtgaggagcgcctcttcccggccaccatcctgtctaggaagtgaggagcgtctatgcccggccacccatcatctgagatgtggggagtgcctctgccccgctgccccatctgggatgtgaggagcgcctctgcccggccgcgaccccgtctgggatctgaggagtgtctctgcccgaccgccaccccgtctgggaggtgaggagtgtctctgcccggccaccccgtctgagaagtgaggagcccctccgcccggcagctgccctgtctgggaagtgaggagcccctccgcctggcagccgccccgtccaggaggtggggggcagcccccgctcggccagccgccctgtccgggagggaggtgggggcagcccccacccggccagccgccccatccgggaggtggggggcgcctctgccccgccgccccgtctgggaagtgaggagcccctctgcccggccgccaccccatctgggaggtgtacccagcagctcattgggaacgggccatggtgacgacggcggttttgtcaagtagaaaagggagaaatgtggggaaaagaaagagagatcagattgttgctgtgtctgtgtagaaagaagtagacataggagactccattttgttctgtactaagaaaaattcttctgccttgggatgctgttaatctgtaaccttacccccaaccctgtgctctctgaaacatgtgctgtgtccactcagggttaaatggattaagggcggtgcaagatgtgctttgttaaacaagatgcttgaaggcagcatgctccttaagagtcatcaccactccctaatctcaagtacccagggacacaaacactgcagaaagccacagggccctctgcctaggaaaaccagagacccttgttcacatgtttatctgctgaccttccctccactattgtcctatgaccctgccaaatccccctctccgagaaacacccaagaatgatcaataaatactaaaaaaaaaaaaaaaaaaaaaaaaacagggccaaagtggaagcagctttccaacagacactctcaccagcgtggcatgtcagtttaccattgccatggcaacacccaggagttactgccccttaccatggcaatgacccaacaacccggaagttaccaccttttttctagaaatgtctgcataaatccccccttaatttgcatatcattaaaagtgggtataaatatgactgcagaactgcctctgagctgctactctgggcacactgcctatggggtagccctgctctgtgaggagcagtccctctgctgctgctgtgcactgctgcttcaataaaagtgtctaggccaggcatggtggctcacacctgtaatcccagcactttgggagggggtggatcacctaaggtcaggagttcaaaaccaacctggccaacatggtgaaaccctgtctttactaaaaatacaaaaaaatattagccagacatggtggtgggtgcctgtaatcccagctactctggaggctgaggcaggacaatcacttgaacccaggaggcagaggttggaatgagcagagatcttgccattgcactccagcacaggtgacaagagtgaaaactgtctcaaaaaaataaaagtgtctaccaccaccgctcaccctggaattctttcctgggtgaagccaagaaccctcccaagctaagccccaactttggggcttacttgtcctgcatcaccttctccacacagcagccagagtcgtctttctaaaagcataaattttaccatgttgcttccctgcttaacctccataggctttcactggatttaaaataaaatccaaacttcttcctttccctgcaagagtcaagagtttccctctctgaaatctatatcttaccaccatcctccttcatgctgtgctccagacactccagccttgtgcaagtccctcacattgcccgaggaacactccttcctccgggcctttgcaggtattgttctgtcggcctggaaacctactcagccagcattcccgtcgttcactccctcattgcattgagtccctaaccaaatcctacctcctcagaggacaagaccctgaccactcccatcacaaggatgcacctcttagtgtgactagctcatcccagtttgtccagggctgccccagccttaaaactgaatgtccccagcaaactggtggttgtccaccctgcagtcccctccactctctgtgacattgccctactttgtcccccatcatgtagcatcttcatatctgttcttatttgctctcctgctccctcactagaatcagaaccccatgaagggcaaggagttcaagatgttctgttcactgctgtattcctggcacctagaacagtgcctggcacataactggcacctaattcatatgattgacaaaaatatcaaaagaatgagcaccgtggcctatttaacctattgctcacagtttagttgtttctcctgtttggcagcaatgcataaggctctctccagatttaaaattatttccttgggctagattgccaaaaattgacttattgggccaatgaggatgcccatgtttaaggttttgctacccagtgtcaaactgtttcccaaaataatcagatttccaattcccactgccagggttcttgcacctatttcattccaccaaggccaaagccaggattctcattttcagaatctttatgaggtgaaaatataacggtttgttgttttaatttgcatttctttgattactagttaggctgacttttcccatgtgcttagctaattgcattttctctttagtgagttgactgttcgcacccctttgcttgtttttctacccagattcagggacttgtcttagtgatctgtttgaattctttgaaacataattatgttagccctttcccttcacacattgaagacttcattctatgaattttctggtctcttgtcaattgtgtcccttccatatttccttacacctttttacatgtttacacctcattttgcacttctcttttcacttatctcttttagttttttttggttttgttttttttttttggtttttttttagaaacacaaggtcttgttctgtcacccaagctggagtggcaccatcaaagctcactgcagcctcaaacttcaaactgctgggcataagcaatcctcccacctcagcctcccaaatagctggaactgcaggtgtgcgccaccacatcaggctaattttttgtttttatttttgcagaaacagggcctccctatgttgcccatggtggtctcaaactcctggcctcaagtgatccacctgcctcagcctcaaaaagtgctgggattacaagcatgagccactgtgcctggcccagattttctttcatagtcagttattgaacaggtgcttagagaaactgtcttatggttttccgtctcattcagaggaagatatttttctcacaatcatctataaggcctttcatgacctctcccttacccccacccataggacctctttgacctcagttcctgtctttctgcccctggatctccctgctgtgacctttctggcctccccgctggtcctcaaacacagacactcattgcactctctcctcagagcctttgcactaacatttcctctccctggaaggttctctccccaggtgtctatccgtcacttccttcaggtccctactcaaaagtcacatcaataagttcttctgggaaggcgtggtggcttgtgcctgtaatcccaacactttgggatgctgaggcgggagtatcacttgggcctaggaggttgagaccagcctgagcaacatagcaagaccctgtctctacaaaaacagaaaatagccgggtgtgatggcacacacctatagtcccagctactcaggagactgaagtgggaagttcacttgagcccacagttcaaggatgcagtgagctatgattgcaccactgccctccagcctgggtgacagagtgagaccctgtctctaaaaacaaataaataaataagctatttcctggccaccttatctaaaatctctgtccctgtggtagacagaataattcacaactaccccctccccaaatatgtccacatgctgatacccagaacctgtgaatgttactttacatggtaaaaaggaggttgcagatgtgattaaagtaaggattttgagatgaggagattatcctagattatctgtatggctcaatctaattgcaaaggctcttataaaagggaagcaagagggtcagagactgaggagtgatgtagatcagaatgacgtagggccatgatccaaggaatgcaggaagcctctagaaaccagaaaaggcaaggaaatggtttctcccctagagcttcccgaagaaatacagccctgctgatccattttagagttctgacctccagaactataagataacacatatgggttgtttaaagcccctagattcatgctgtaatttgttatagcagaaaaaactaggaaaccaatatccctaacatcccctcatcctccttctctgctttgtttatccttagctttcacagctctctaagttcctataatattatctatttcttttttactttttcctaccgcagtagaatctcagctccatgagggcaggggcttttgtctgttttgttcactgttatatctccagtaccttggacagtgcttggcacacttaggtgctcactgtgctgagtgaatggataaaggaaggagaatgaaggaaccttttgctttctttttatttcgagatggagtcttgctctgtcacccaggctggagtgcagtggcgtaatctcagctcactacaacctccacctcttgggttcaagcgattctcctgcctcagcctccagagtagctgggattacaggtgcctgccactacgttccactaatttgttaattagtggggtgtggtggtgcatgcctgtagtcccagctactcaggaggccgaggcaggagggccacctgagcccacgaggttgaggctgtggtgaactatgattgtgccactgtactccagcctgggcaagagagtaagagcctgtctttaaaaaaggagagaactagctgggcgcagtggctcatgcctgttaccccagcactttgggaggctgaagtgggaagatcacctgaggtcaggagttcaagactagcctggccaacatggtgaaaccccgtctctactaaaaatacaaaaattagctgagcatggtggcgggtgcctgtaatcccagctactcgggaggctgaggcagaagaatcccttgaacctgggaagcaaagattgcagtgagccgagatcgggcaattgcactccagcctgggcgacaagagctagactccccatctcaaaaaataaataaataaataaaaataaaaaataaaaaggagagaactgaactgacattgttgaatacctattgtgtgccaacactacacttcagatattcaatctcactggaacttcgcaactagtctgcaagatgggcattatcgccacccactgctccactgccctgaactgcccttccctgattagggaagccagtttccctactgggagtgggaaatggctaacagaaaccctttgggaaaaccccaccatgcatttcagttaccttcaaagacatccacctgggaggctgtctgctggctcttcctgctcatttttcttctccctgacctccttctttccctcccactctctcctcctctcctttgccctctctttcccccttctcatccttttccaggaaatcctggagccacttcgccagtctgttcagatcctgccaaagtcttgtctcagagattttttaacacaggaaaatctgtgttttcccccacaggaatgggtgatggcagatggctgcacagatccactctgaaaaggggagggccacctcccacaggccccgccacatctagactccagcttcctgagacatgaatcagaggaactcagcaatggaactcccagaaaaatccatctgataacttcagctttcaagatgttcttgcagaagatggggacagagctctggacttacccaaataccgtggtagaaagtctaaaagactgggttcacagggctaggcatggtggctcacaactgtaatcccaacattttgggagacagaggtgggaggatcactttgccacaggagtttgaggccagctaggcaatatagtgagacccccatctctacaataaaaatctaaaaattagccaggcatggttgtgtgcacctgtagtcccagctcctcaggaggctgaggcaggagaatcgcttgagcctagggtgttgaggctgcagtgagctatgatcacaccactgcatcccagcctgggtgacagagcaagaccctgatatatatatatatatatatatatatatatatatatatatatatatatatatatatagagagagagagagagagagagagagagagagagagagagagagagagagactgggttcacatcctgaccccagctcataacttcatgacttcaggcaagtggcttaattgctctgagtccaatttcttcatctgtaaaatgaatgtaatgattctttctggaaaggtcaccacaaggattaataaaaacatcactagcaccatgtcttgcatacagtaaatgctcaataagtggtaacaataatcagtgatctgtcaactccttgaggtcaaggaccatggctgagaatgtctcattcccagcctgtattagtcagggttctctagagggacagaactaataggatatatgtgtatatgaaagggagtgtattaaggagaattgactcacacaatcacaaggtaaagtcccacgataggccgtctgcaagttgaggagcaaggaagccagtagtggatcagtccaagtcccaacacctcaaaagtggggaagcagacggtgcagccttcagtctgtggcctaaggtccgagagcccctggcaaacactggtgtaggtctaagagtccaaaaactgaagactttgagtcttatgttgggcaggaagcatccagcatgggagaaagatgaaggccagaagactcagcaagtcaagtccttccatgttcatcttcctgcttttattctggccatgctggcagctgattagatggtatccacccagattgagggtgggtctgcctttcccagtccattgactcaaatcttcatctcctttggcaacaccctcacagacacccaggaacaatactttgcatccttcaatccaatcaagttgacactcagtattaaccatcacacagtcccatccccagtgctcagagttttgtagattctgaataagtattggtaatatatacacattcatctttttctttaaatacatataatgatgctgagctccctccagacaaatgagaactgatgtgttgcttcttaggtgccaggaccgggatgagggagaggcaagtgagacattctccccgggagcaaaatttaaggaggcaccaaaaacccagtcatcaagataaataacacttggatgcaatatgtttaaaaacgaaaaagaatgaaaaaattaatgcaaaattaatgcaaaaatacccatgataaacaaatatcacagtcttcaggaaatgattggtattactaacttttcctttggctcctggcaccagagtgccaggcatcattgaagtgcttttaaaatacaaactcattcttttttcttcttcttcttttaagacagggtctcactacatcacccaggttggagtgcagtggctcactgcagcctcaaactcctgggctaagtgatcctcccacctcggcctcctgaggagctgggactacaggtggattccaccatgcccagttaagtttcttttttttttttgagatggagtctctcactctgtcacccaggctacagtgcaatggcatggtctcggctcactgcaacctctgcctcccaggttcaagcgattctcctgcctcagcctcctgagtagctgggactacaggcacgtgccaccacacccggttaatttttcggctaatttttgtatttttagtagagacgggtttcactatgttggcctggctggtctcaaactcctgaccttgtgatccaccttcctcggcctcccaaagtgctgggattacaggcatgagccactgcacccacccattcaatccttataacaaggctgcaatgtagccattttttcagatgaggaaagggaggcccagggaagtgagataacttgcccaaggtcattcagcttgtaagtggcagagcttggacttgaacccaggcagtcttcattcagagtccaggttcctaaccactctcctgtggctgtgtgtgatatatctctgcccaaagggtcctgtgtcagtacatcctagacaaagctttggtgtttgagcagtaccctcgtctttcattcaaattgcagacatgcaggggcccctgccatgctccagcccctgggctggactctgcagacagagaaatagctacaaaacagcacctgttcttagacgcaccagtgtctcacatgacaagtgtagggctcctgtcgactgctctcagagatctggacaagtggtctgtgaggctagaggaggacatgactaattctgctttagccaggaggtcccttgaaattcagaggagctttccggcttccccattctgtgacaactgacgcacttttgagagatgagtaagaggttgtcagccagagaagacaaaacagtgctgtccccatttgacaaagacggaaactcagctccaaggcacaccacttaagtgtgcctcgagtgacactgtgacgacctctccatgtttacttccagttcattgtgggtggctaactggccctcaactcttcgatcaagaccctgaatgaacggcacaaaatgatgcttaagagcattaagtcagagagctatgaacccaatccacactcagcactttttaaactgggtgacctgaagcaagccacatagtctctctgagcctgtttcttcatcagtataatagggacagggatgctgaccccacaatcgttgtggggattaaataaaataaagtacttagcacagttccagagaaatggaaagcactcaatatgtggtagatacacatttatcacaaatacacaaaaacccattagtttcaaaaatgggttgcaagccaggcacggtagctaaagccccatctcctcaagaggctgaagagagaggatcacttgagcccagaagtttgagtccagcctaggcaacacggcgaaacatagtctcaaacaaaaaggaaaaaaatgggttgcagtgtaacctgtgcttatacaacagtccagcaactcagtcccttgatgagaaagtgaaattgcctgttggatgtaaggagcagtacgctcgttgagaaattcaagcacaaatatggcattcacctgaaaagctagggcagctaaggtcgcacattagaatcacctgtgcgcactcccagggaatatgttttcattggactggaggaggctcaactgcattgttttgtaaggttttcccaggcgattccataggcagccaggggttagagcgccccagagaatgggagggaagcaattactctggggcagaggttctgacagagggcaggagccggtaatgacctggtaacagatttatggatgtccacttgaactaatgctcatcacaacaccttcctgtttcatgcatttctttttcttttttttttttttagtttgagacagaatcttgctctgtcgcccaggctggagtgcagtggcgtgatctcagttcactataacctctgccttccaggttcaagcaattctccctgcctcagcctcctgagtagcggagattacaggcgcccaccaccatgcccagctaacttttgtattttttagtagagacggggtttcgccatgttggccaggctggtctcaaactcctgaccttaggtgatctgcccaccttgtcctcccaaagtgctgggattacaggcatgagccactgtgcccagcctgtttcatgcattttctatgtgaatattctatatcatcatcttaggtttttactgtggggaatttgaaacatatactaagtaaacagtatactgtgtactgtgtctgcctgggtcgtgacacagttccccataccatcaactcacagtcattcgtgctgtgtccaaacgtcaagactttgtctagctccaccagtattttaaaacaaatgccagcatgaaatcattttatctctaagtattttcatgtgtaactctaaaagaaaagggttttttttttttctctgaaacagagtttcactcttgttgcccagactggagtgcagtggcaagacctcggctcactgcaacctctgccccccaggttcaagcaattctcctgcctcagcctcctgagtagctgggattacaggcacctactaccacgcctagctaattttgtatttttagtagagacgggatttcaccatgttggccaggctgggcttgaactcctgacctcaggtgatccacccacctcagcctcccaaagtgctgggattacaggcatgagccatcgcgcatagccaaaagggctcttttttttttttttttttttgaaataaaacctccctatcacctaggaaatgaataattccttaatatctgcaaatgttcaaatctcaaattatctcatagataacttcttaactctctcaggatttaaataaggtctgcatattggcatttggcttctttgtcttctaagtctcatatgtatgttcaatttcagtgcctctcacacatcaatatgcatatgaattcctgatgatctggttaaaatgcagattctaactgagtaggtctggggtggggctggagttctgtatctctgacacattcccagcagatgatgctgtgatgctggtgcatggaccataccctaaacagcataattctacttcatgataaacgaaaatctttttttttttttttttttttttgagatggagacttactctgttgcccaggctggagtgcaatggtgtgatctcagctcactgcaacctctgcctcccggattcaaatgatgatcgtgcctcagccttctgagtagctgggattacaggcatacaccaccatgccaagctaattttgtatttttagtagagacaggggtttctccatgttgaccaggctagtctggaactcctgacctcaagtgatctgccagcctcggcctcccaaagtgctgggattataggagcaagccgccatgcctggcccacaataaaagaaaatcttctattaaaaaaaggaatgttgacatcttgtggtggtagggggccagcttggtataaaatcctggaaggcaagctgctgctggctgggaaggggcctcgccttcccctgaattgcagttgctaatcacacctgctatgggtatttaaatgtaaaaggcaacacctgaccctccagaattggtacctgacaccctggccactcgagagtttatccctgcagggtctggccatcccaaaaccagaggcccccttgtcaagatcctcagaacctctggaagtgcattgatttgttcagtttctggcaggcagacagaaacacaagctgcagaaataaggcagttaccttttctcgcagttataggtttaattaaaaagccccatgctgccagattccaagcaccctccactgatatgcgagacctattgattgcctagctctccctgcgagacatagcagagagaagactttatcttcctttaatcagacctgcttccttccaatctggctccaacaggactgctgagttcttgtgtagaacgcttccatggccccaccttcatccagccccgaatacagtgggtagagccagcatcagctacagagagctgtgatctgtgctcgcagtgtagccggagagatggcatcatcatcatcatcaccgtggccagcacaaatggaacatacaccacgtaccaggtgccgagctgatacttcaaatacattctctcgtcttatgcatcaatattgttcatttctgtctgtattattacctaattgccctatttaatgtcacctgcaccaggcatttgttccctttcatatcacctgtactattttcttcattgcccttagtattatctgaaaccgttatttacttatctgtctcattattcattgtctctgcccccgaactgtaaactccagaggggcaaggattttgcccttctcattcggtccagcatcctggcaccgaaaatggccctgagcacatcaaaagttctctacaaatgtgtgttgaatttgatttgtcacatttactcttcccagcaccctaggagctcactgtcttacacgcattttacagttgaggaaactgagactcaggaaagaaaaggaatttacccaaatgcacccacacaggaagctatagagcagagattgaaacccatgtgtagcctgggatggtggtttatgcctgtaatcccagcattttgggagtctgacgcagaaagatcacctgagctcaggagctcaagaccagcctggacaacacagtgagacttcgtctctacaaaataaaaatttttaaaaagccacaaaaaagcagggcacaatggctcacgcctgtaatcctagcactttgggaggccaaggaggggagggggcatatcacctgaggtcaggagttcgagaccagcctgaccaacatggtgaaaccctgtctctactaaaaatgcacaaattagctgagcgtggtagcacatgctgtaatcccagctactcaggaggctgaagcaggagaattgcctgaactcgggaggtggaggttacggtgaaccgagatcgtgccactgcactccagcctgaacgacgagcaagactccgtcaaaaaaaaaaaaaaaaaaactcacaaaaaagaaagaaactcaagtctatataactctagcaagggccagtaacctgcaatcaatgaactcaatgaactcggaagaaaaaatagacctcttaattttactaacatcaaactgcaatgtagcaattctttccattatgagtgtaggcagcaaactgccatcgtgtcaacagaacctgtaactttgtcaccaacaggaatcacagatattttcatgtcctgttacatttgttgcaaagatgttggaatatcatttacactcatcactgctttaaactgcaatcgtaataatgttgccaacccaccaccagatcgccttatttggtgtgttaataaagaggcatgggtattgctatatcacagtttggctttgtaatatttttgtaataattttgtaatattcatatcagctgtatttccatataatcagttgtcttcacaagcctttggatttcatatttagaaacattgctcagaggctgggagcagtggctcacacctgtaatcccagtgctctgggaggccaaggcaggcagatcacttgaggccaggagttcaagaccagcctggccaacatggtgaaaccctatctctactgaaaaacacaaaaattagctgagcgtggtggtgcatacctatagtcccagctacttgggagactgaggcaggagaagcacttgaacctgggaggcggaggtcagtgagccgagatgaagccactgcactccagcctaggtgacagagggacacagggacactccgtctctaaaaaaaaaaaaaaaaaaaaaaaaaaaggccgggcgaggtggctcacgcctgtaatcccagcactttgggaggccaaggcgggtggatcacctgaggtcagctgtctgagaccagcctggccagcatggtgaaaccccatcactactaaaaatacaaaaattagccgggcgtggtggcaggcacctgtaatcccagctactcaggagactaaggcaggataatcactcgaacccaggatgtagaggttgcagtgagccaagatcatgccactgcactccagcttcagtgacagagcgagactctgtctcaaacaaaaaatgaaagaaaagaaaagagaagaaaaagaaacattgctctgagaagggtaataggcttccccagataccaacagggcccacagtgcagaaactattcaggactgggctctaacgcccatgctcagaccacaggctgcacataacgtgtggctcagacagaagagaaacatgaaaatgaccgcaggtgagtttccagctctcctccctccaagggcagggatgctgaggctcagtgtggggatgtgacctgggaggacacatagcaaggtagaacctgggtctgaactggactccgaattgtcccattagcagcctggcaccttttcagctgcaccaagctgccacctaaggacacaaagcattccaagctcagacgtttgtgggctgtagcccatggtgatgagccacttggaggcagtttgtgcagtggagaacgctctggttcactgacctgcagtgactggtagtcacttgttcacacaaaacagtcattattcgctcacacactgccagcaggatgtagatcagttcagtcaccttgaaaggcaattgggcagagcctggtaaaacacggggttgggttcttcttttggcccagtcattgcaacaccaacatccccaatgtacaccccagaacagcaggtctcaaccctgaatgcacatttagaagcaccctggagcttctaaagctgccgatgcctaccctgaaccattcaattaagaatttggggaaaggcagagagttggtgtgattgtaaaaaaaaaaaaaaaaaaacgttcaggtgattctgtctgcagccaagttgagaactactggcctcaggaaacacttcacggtagtacacagaggcctacgcggtgcacgcactgaagtgctattttcaatagcaaggcagtagacacaacacaaatgcccatcaacacagaaatagcttgagaaaacaaaaggcaattaataacatagtgagatgctatgcagaaggcaggaggaattaactagctctctatgtatcagcgaggattggtctcagaaacacagtgttgagtgaaaaaaattcaagttgcaaactatacacatagcgtgctatatcttgaggttttcagaacaaaactaaagatgcatacaaatggatgcagaagtatttgaaggtccttaaggatacacgatgttcataaaaacaagggctggccgagcgtgatggctcacacctgtaatcccagcactttgggaggccaaggcagaaggatcacttgaggccaggagttcaaaaccagcctgaccatcatgggaaaccctgtctctactaaaaatacaaaaaatttagccagtcatggtggcacatgcctgtaatcccagctactcaggaggctgaggcaggagaatcgcttgaacccaggaggtggcggttgcagtaagttggtatcatgccactgcacttcagcctgggagacagagcaagactctgtctcaaaaaaataaaataaaataaaataaaaaagcgacaaggtgcaggaatttggtgtgatcactaaaaggacttgagttttccttttttttttttttttttttttttttgagataggatctcactctgttgcccaggttggagtgcagtggtgcaatcatggctcactgcagcctcgaactcctgggctccagccatcctcccacctcagcctcccaagtagctgggactagaggcatgccccactaaacctggcccagttttgcatttttttaaaaaagcaaaatatgtatatcttttacagaaggaattaaaattgattctaaacattagtatttttaaaaatatcccagcactttctatgtattattgtactaggctcaggagaaatgaactggaatggaagacttcaagagagatacagtccagaggaggataaagacaatgctaccagaatacagcattttagctggtgatgagaaagagctgcagaagatctaagaagcagctcctaggccaggtgcggtggctcatgcctgtaatcccagcactttgggaggctgaggtgggcagatcacttgagcccaggagtttgagaccagactgtgcaacgtggcaaaacctccatctctgcaaaaaatacaaaaaattagctgggcacagtggcatgcactcactgcacacagtggcatccagctcctcaggaggctagggtgggaggatcactttagcccaggaggttgaggctgcagtgagccatgatcacactactgcactccagcctgggtgacagaatgagaccctgtctcaaaaagaaagagagagagaggggaaagaaggaggaggaggaggaggaagggaggcaggggaggggagggagggagggaaagacagagagggagaggagagagaaagaaagaggatggaaggaaggaaggaaggaaggaaggaaagaaagaaggaaggaaggaaggaagaaagggagggagggaggggaagaaagcatcccatgcacaggaaataataaggtcaaaatcgtagagtgcaaaatgagggcagcagccccatggcattcttaggtcactggtccttccttttgcctggagaaaatggtgaacagtgaggctgagaagtgggcaggggccggatggttgtgggatctcttgagccatgttaaggattttggtcttcatcctcaagggaatgggaccactgaagtgtgttatgcggggaactgtcaccattacatgtatgctcccaggtagaggcaaagggaagggaataagagacagagcagaagctaagcagtgtctgtggtcaccaggtgaaagcagggggtggcagtgggagtggagagaagtggacagagctgacagatgctttagaggcaaaactgacacacttggtgacaggttcaaagtgaggagtaagtaacgagtccaagaagatacccctcaactaggcacttctggcccccaggggtccagccagacctctggtggtcccagcccaggtctgcatccctctagattgtctccggtccagaacaaaactctggctaaacaatgaaccttccacatgcctgtaatcccagcatgttgggaggccaaggtgggaggatcgcttgagctcaggagtgtgagactagcctgggcaacatagtgagacccccgtctctacaaaaaataaaaaaattagccaggcatggtggcacatgcctgtagtcccacctacctgggagaatgagatggaaggatagcttgagcctgagaggtcaaggctagagtgagccgtgagcacgccactgcactccaagtctgggtgacagcgtgagaccctgtctcaacaaaaaaagaatgagcttttcagtcaggtgcagtggctcacacctgcattccccactacttgggagactgaagtggaaggatcacttaagcccaggagtttgagaccagcctgggcaacatagcacagaaaaacatcatctcttaaaaaaaaaaaaaaaaaaaaaaatttaaagggatggagcctttcggtaaggagggtcatctgagttccagcacatctcaaaacaaaaatcaaaatgatacccttggctcaccacatccaagtctcttgtgccccaaaagtcattatcctgttatggcgcccagtgacaattagtgagaaattgtatggacagctcccgattagatgtaacacccctgacacgcagcatcgtgaatcaattactctgagtaactcaagtctaacactctgacactccgccccccaggaaagtgcctccttctttccacatacacttctttcttcccaatgaataaattgagagctgtttgtttacagagacaaggttattttcattcgtgactgaagaagcagctctgctcaccctgttagctgtgagtcacatttgattccctcaaggatgggactgagttgggatgaagggccccaacctccccaggtactggtcccagtcattgcccaaggagtggactgtcttaccctgggtcctggggacccacgaagccagagctcctcagaacagggctcccaacatagctccagggagtgaacccccatccttcattcaagagcaaatcctgaccgcctgctccataccaggctcggttcgggaaacccccgtccacatggaggagggagatacacaagaaacagagatatgtagcatgaagatgatgagaagttctgtggggaaaaaaaaaaagcaaagacatgaagaggcattcctgggaggggatgggatagagggagcattgcaaatgctgtaaatggcatcatcaaggatgtctggctgagaaggtcacatttgagaaaagtctcagccaggcgccgtggcgcatgcctgtaatcacagcattttgggaggctgaggcaggcagatcacttgaggccaggaatttgaaactagcctggccaacatggcgaaaccccatctctactaaaaatacaaatattagccgggcatggtggcatgcgcctgtaacccccgctactcaggaggctgaggcagaaggatcacttgaacccaagaggtggaggttgcagtgaggcaagatcacaccactgaactccagcctgggcaacagagtgagactccatctccaaaaaaaaaaaaaaaaagagagagagagagagagaagcctgaaggcagtaagggagcaagttgtggggatgtctgggaagggcacggaagagagcaaaggcaagtgtcctggggcaggagtggccagcgttttggagccgcagccagggtaccagtgaggctggggaagaatgagcaaggtaggaacaacagatgaggtcagagaggccacagggcggggtagcaggggagggagggcagagggcctggggccttttaggacattgagaaaactctggctttgacgctgaaagaatttaaaagatcagcctggcaaggtggctcctgcctgtaatcccagcattttgggaggccgaggcaggaggattgcttgaggccaggagttcaagaccagcctaagtgagaccccatctctacactttatttttttttaaattagcctggtatagtggcttgtgcctgtagtcccagctgctctagaggctgaggcaggaggactgcttgagcctgggaggtcgaggctgcagtgagctatgatcacaccactgtactccagcctgggtgatagagcaagaccctgtctcaaaaaaagaaaagaaatcactccagctgctattgctgctgatgataattatgatgacagttgtgatgggctttgctgctgtcacgctggagttttggtctgcttttctttttttatgccagtccaacatctcatctcttcctcttttaccctggtggctcctctgggagttccccattataaacaccacaatgaggggatggtggcctcctcttccactaggaaaccctcagtgggctgggtgcagtggctcacgcctgtaatctcaacactttgagaggccgagacgggtggatcacttaaggtcaggagttcaagaccagcctggtcatcatggtgaaaccccgtctctactaaaaatacaacaattaggcaagcatggtagcacgcacctgtaatcatagctactggggaggctgaggcaggagaatcacttgaatccgggaggcggaggttgcagtgagctgagatcacaccactgcactccagcctgcgtgacagagcgagactctgtctcagaaaaaagaaaatggaaaccctaagtggccaggcctccctccctgcaccccagcctgaaggtcatgtggcttggttgaaccaatgagctgctctcctcagactctgcatcatgagcggtgatcccagcaaggggccgcaggaggtcctatccacatggtggccatggggattttaggaccggattgctcctgccggggccttttctgtgactgccgctgctcagatcttcacagcctccttggcccccactcatttccccagcctggatcccccagcttcctggtgggtttgtggacccctagagttttccaataatttccgtttttgctcaaggcaactaagttttctttttctgagatggagttttgctgtgtcacccaggctggagtacaatggtgcaatctcagcttacccaaactctgcctcccaggttcaagcgattctcctgcctcagcctcctgagtagctgagattacaggcacatgccaccacacccggttaatttttgtagttttagtagagacagggtttcaccgtgttggccgggctggtctcaaactcctgacctcaggtgatccacccacctcggcctcccaaagtgctgggattacaggcgtgagccaccatgtctggcctgcagccaggttttctgttacttgcaaccaagagccactcttgatgcaataatgaagacagccaggcaggtgctaacgacagctcccaaaaccagctgtctggcccaggctgctctgctggactccaggcatggacatctacctgctgaccccacatctcctccaaagcttacatttctcacgctcaacgtgtccgccatactcctgatactcccttctcaatcggtggcaacctcattctttaaggtgctgaagccaaaaaccacaggtcacccattatttctcttcttctctctctcaccccatctgcactcctttcaaaatacatccagaatctaataacctcgtcacacctcttactaccactttagtccaagccaccaccacacttacctggatgactatatggtagccaccaaattcaccttcctgcttctgactccccaaccctacccctaccttcatactattctcaacaccacagccagagagagcctgtagaaagctacatccagtgaagccacttgggatggtcaatttgatgtgtcagtttgactgggccacgggctgcccagattttttttttttttttttttttttgagacaaggtcttgctctgtcgctcaggctggagtgcggtggcacagtcagtcatggctcactgcagcctcaacctccctgagctcagacgatccttccaccttagcctcctgagtagctggtaccacatgtggtgccatcataccagctaatttttgtattttttttttatagatacagggttttgccatgttgcccaggctggtctcaaactcctggcctcaggtgatccacgcattttggctttccagagtgcagggactacaggtgtgagccaccatgcctggcccccagatatttttgttcaaacattattgtgagtgtgtgtctgtaagggtgttcctgggtgagattcacatttgaactgcagactgaatagagcaagtcgccctccctaatgtgggtgggccccatccaatccgttgaaggcccatatagaacaaaaaagcacagtacaagagaactcctgctgcctgcctgcttgggctgggacactgtgtttttccagcctgagacttgaactgaaacattggcttttcctgcatctcaagtctgctcgcgttaggaccagaacttatgtcattggctctcctgggaactcacagggtctttgggcctcacactggagctaaatcatcagttctcctgggtctcctgtttgccagctgccgatcttgggacttctcggcctccataatcatgcgagccaattcattataataaatctctgtaaagaaattaatataggccgggtgtggtggctcatgcctgtaatcccagcacttgggaaggatgaggcgggtggaacacctgaggtcaggagttcgagaccaggctggccaacatggtgaaaccctgtctcaagtacaaaaactagccaggtgtggtggcgggcacctgtaatcccagctacttgggatgctgaagcatgagaatcacttgaacccaggagacggaggttgcagtaggccgagatcgcgccactgcactccagcctgggtgaaagagcgaaactcaatctcaaaattaattaattgattaatgtagacatgtgtatatcctgttggttccctttctcgggagaaccccctcaaaataattaattgattaatgtagacatgtgtatatcctgttggttccctttctctggagaaccgtaatatgccactcctctgctcaaactcctgcactggctcccctctgacccagaaaaaaagccaaaatccttctcacagcctccaaaggccctgcaaactctaacccacccgtcattacctctttgccttcatctccgacaaccttctcccttctgtactgggcttcaggcacactggcactcactctgtttcttgaaccccaagcatgctctggcctaagggcctttgcactgactgttccttctccccggaattctcctctcccagagatctacacggctggttgcgtaattcctgccaatctttattcaacagtcagcttctcaatgagcccttcccaggccaccctttctgaaatattaatctccccacccaccccaacactgaatagtatgtctttcctacttttctgtttagcatgctctgtgttgatcttatctgtctcacttacttcctgtctcttttttttgtttgtttttgagatggagtttcactctgtcgcccaagctggactgtggtggctcgatctcggctcactgcaacctccacctctcgggttcaagcgatttccctgcctcagccccccgagtagctgggattacaggtgcatgccaccatgcctcgctaatttttgtatttttagtagagatggggtttcaccatgttggccaggctgttctcaaactcctgacctcaggtgatcagcccacctcagcctcccgaagtgctgggattataggcatgagccaccctgcccagctacttcctgtctcttctgccagaatgtgggctcctaaaaaccgaagactgaggcttgttcacttccagctgtatccccaaggtaatgcctgacacagacttagcactccataaatatgtgtggaatttagccattcatccatttactcattcattgcacaccttctctgggctaggcacacaagtaattttataacaacatagcaagggaggtcttatcatcgctagtttagataaggaaacttcgattcaaagagaagggtgctaccccaggttatccacccagaaattgccagagccaagagggacacttgcatagctccaaaccactccttctgtcttttgttttcttatcttttgtaaggatggagtctcgctatgttgctcaggctggtctcaaactcctgggctcaagcaatccacccaaagtgatcctcccaaagtgctgggattacaggtgtgagcccctcacccagcccagctttttttttcttttcttttctttttttgagacggagtctcgctctgtcacccaggctggagtgcagtggtgcaatctcgcctcactgcaacctctgcctcccgggttcaagccattctcctgcctcagcctcccaagtagctgggattacaagcgcccgtcaccacgaccagctaatttttgtacttttagtagagacgggcttcaccattggtgaaggctggtcaggttggtctcaaactcctggcctctattgatctgcccaccccagcctcccaaagtgctgggattacaggcatgagccaccatgcccggcctggctttccttctttctgtgtagtcccatgaagtaagatctgaattgagatggagtcctgctggcagtaactggctatgaggccccagctgtcacgtacactctctgttcttcaggaaacaggacacggtggccaaaccaccaccaggtccccttctctccatatcgtgaaaacctggtgccatcctgtggctgctcatcagctcaactcaaggtcctctgacccactccacatgaatgtaaaacctttctctggggaatatcactcagcttcggtgacttccagcctcactctgcaaatccctgcttcctttgcaaagtctgcatttgtctctgttttaataagaaaaacctgacctccttctggttttctgttgaaagagaaattgctggtactttccaactactaaccaaaatctagcgtttcctgtggtcccaccgaagcaccacttcccttctcccacctaccccgcctactccttcatacaagctggcagatgggcacccacagccagggtcctctcccccaaccagccttgggcccgcatctgagtttggtggtagcccctgccacttcctcaccccatggctccatgggacccaggaccagcttgcagccccatgattcgggctcctctctctggggtgctcctctcccaccacttcccttcttctagaccaggtatgtggggctggatgaatcctctacagaaaagagcccagcaccaggtcagacatatatgggttcaaatctcagttctgatccagttagctgtatggcctcaagctagacacttaacctctctgagctgccttttcttgttttgttttgttttttttttggtttttgtttgtttgtttgtttgttttgagatggagtcttgctctgtcatccacgctggagtagtggcgagatctccactcactgcaacctccatctcctgggttcaagcaattctcctgcctcagcctcccgagtagctgggattacaggagcatgccaccacatccagctaatttttgtattttcagtagaaacgggatttcaccatgttggccaggttaatctcaaactcctgacctcaggtgatccacctgcctcggtctcccaaagtgatgggattacaggcatgagccactgcacctggccaacaataataaattttaaaaacaaagaatatgatatgctgcaggtcagaaatatcctactaggagccaaagctctagaggcagaaaagtcaggagttgacagaaatccaagggaagacttgagatgcctcaggaatgggatagaggaggaggaggaagacaggacgttggggaaaattttattgaaatcagaaggggcaaaaagggccccagatgacatctgctttatattcggaagtaaaggagtgaataataatattgggaatgggatgctagtaatggatgctacagacaggtgcagaaatctgtagtaccagctggagagataaaagcaaccttgacactcagcaaaaggcggtacctgttattctccgtgtgtgtgtatgcatgtgtgtgatatatatcagtgtgtatgtatgtgtgtgcatagatatgtgtgtgtgtatatgcatttagcacaggtgctcaaaaatatttattggatggatgagtggattggtagatggatggatgaatgaacccatggacggatgggtgggtggatggatagatgggtggttggatgaatgcgtggatggatggatggatggatggatggatggatgggtagatggatgggtgggtgggtggatgggtggatgggtgagtgggtgggtgagtggagagtaggtggatggatggagggtagttgggtagataggtgggtaggtggatggagagatagacggatgaggtacaccaactattcctgtccttcagccctcaaatcaactctcttttgcctcaagactggcaatacttctactttccttcctcctccgtccggcgtcctcctcttccccacggcaagtaaatgctgtaccccagctccagtctgggcttgcgctcagggaccaatattccaggacatttgcagtcctaccctgccacctacagggagctctgtggtactgcagagaggagcccctatttgacttcgattcagggcagcgtcaagtatctcaccctattcagaaagagaaagggtagcactcagagtgcttggcaaggagtgggcaaagcccacggggaactgggggctggtttcggcttagaatcttctttcaaagggtgaaaacattgggctaattcaggtaggcagaactcagagctgttaggtagggaaggcaggcacatcagggagagcgggggagggaagaggagggaagaggagggaaggggagggaaggggagggaaggggagggaaggggagggagcgaccaggaggcgcgaaagagcacccgcctggagttcacgtccccactcccctttcacccctgaccgcccgtgcgacctggaactgctcacttctcccctctctagacctcactttgttcaactgaaacacaggccagaagattcctttttttattttttaagacggagtttcactcttgtgccccaggctagagtgcagtggcacgatcttggctcactgcaacctccgcctcctgggttcaagcgattcttctgcctcagcctcccgagtagctgggattacaggcgcccgtcaccatgcccggctgatttttgtattttttttagtagagacggggtttcaccacgttgaccaggctggtccgaaactcctgacctcaggtgatccacccactccggcctcccaaagtgctgggattacaggcgtgagcccccgcaccaggccagaagattcctttaaatcattcaccaagcttttccacttatgtgctggcttatgtcacttcacaacagacctgtgaggtgtgggtcaggttagggttattactttaacaagataaaaatatctgtaggaaggctacagttggccctctgcctctgtgagttccgcatctatggattcaaccaaccgagaattaaaaaaatattcaggaaggctgggcacagtggctcatgcctgtaatcccagcactttggcaggctgaggcaggaggatcacttgaggccagaagatcaagaccagcctgagcaacatagcaaggccccgtctctataaaatatatatatatttttaatcgacaacaaaaaccatctgtactaaacacatacagactccttttcttgtcatgattccctaaacaatgcagtatagcaactacttacacggcatttacattgtattcatttttatgagtaatctagagataatctaatgtatacaggagggccaggcatggtggctcatgcctgtaatcccagcactttgggaggtcgcgatgggcagaacacttgaggtcaggagttcaagaccagcctgaccaacatggtgaaaccccatctctactaaaaatacaaaaagtagccgggcgtggtggcacacacctgtagttccagctactcaagaggctgaggcatgagaatcgcttgaacctagctgaggaggaggttgcagtgagccaagattgcactactgcactccagtctgggtgacagagggagactccatctcaaaaataataataataaataaaaataaagtatacagcaggatgtgcatagttaaatgcaaagactacatcattttatatcagggacttgagcttctatggggtttggtatccatggaaagtcctggaaccaatcccccatggataccaagggatgactccattcggaaactctcagaaagaaaacagagttgaataaactggcctcagaaaacacaggagccggccaggcatggtggctcacgcttgtaatcctagcactttcggaggccaaggcggtcagatcacctgaggtcaggagtttgagaccagcctagccaaaaatggcaaaaccccatctctattaaaaatacaaaaatgagctgggcatagtggtgcatgcctgtaatcccagctactcaggaggctgaggcaggagaatcacttgaacccaggaggcggaggttgcagtgaaccgagattgtgcccttgcactccagcctgggtgacagagctagactccgtctctaaaaacaaagaaaacacaggagcctggacagcttagaatatcccagaacccaggaactctctcagggtttccacctcctgacctaaaggcaaatttctacagtgaggctctgacgggcccggcctggattatgtggccaccttagaggtagaatcctgttactggcagatgtcaaataaaggctggtatccccaaaaaagggatgctaagcagcccaaagcaagtatacaaggtaacatatatgttaattagcttgatttagccattccatgctgtatacatatatcaaaatatcatatatacatataatttttatttgtaattaaaaagtaaaatgagtctcttgtagacagaatataattggctcttgttttctcaacccattcaacttgtatatttagctgtccccatttcacaggcaagaaaactgagtctcagaggagtttgatatgggtagtgtgtcagtcagattcttgtaagttggccagaaagagaaatattctcagtttacattatgaaagctggaaggccaaagtctcaccacccagtcagggctgccagaggctggaacatcttcaggttacactcatcactgacagcagctctgtaattcaggggaccatcctagctctgccctctaggctccaccaagatggtgacgcagcatctccgggtcttggcctattcctctgctatctccatgctactctctatctcatagtttctgctgacttgtggctcttgccacgactcaagtttctgctgactcataattcctgtcaattcatggctcctattcacccatagcttctgctgactcaaagcgtcctcttataactttccttctctgtgtttctgtttctgccctcaatactgactactaatcctttctctgtgtctcgtattcagattcttcaaaagaaagcaactgaatttttcagttggtcctctctatttgttggatttttcaccttaggttcagtgtccactgctgtccaattagctgaatcctgcacgtgtaagttgcaaaatggggtttatcagtgtgaataacctctcagaaggggcagcaatgcaaatgcaatgggatccttcaaaccaagtaagaccaagattttgagtcaaggttctctggttgcaagtgtttcccaccggagtatctgggttgccctatcccacaggatcaaaaaataataattaacactggctgtcaagcaccatcctagccttacacagactatctcaactaatcctgaccccagtcccaggaggcggcctctttaattgtgcccatttcacagaaatgaaaactcatttagaaaaggtaaataacaggctcaaagttatacttctactaagtaaataatttatctatcaataatagatagtaaataaattatctatcaattatctatcaataattactttaagtataaatgaattaaattccccaattagaagacatagagtaggtgaatcggttgaaaaaacaagatccaactatactctgtctacaggaggttcactttactttttgttataaataaaaattatgagccgggcacagtggctcacgcctataatcccagcactttgggaggccgaggtgggcggatcacctgaggtcaggagttcgagaccagcctgaccagcatggataaaccccatctctactaaaaatacaaaattagctgggcatggtggtgcatgcctgtaatcccagctactagggaggctgaagcaggagaatcgcttgaacccaggaggcggaggttgcagtgggctgagatcgtgccattgcactccagcctgggcaacaagagtgaaactctgtctcaaaaaataataataattatatttatggtgtacatgattttttgatatacgcagtgtggaatggctaaataaagctaattaacatatatgttaccttgtatatggatcatttttgtggttagaacacttttattaactagtcacaatagacctcttgaactttttcctcctggctaattgaaattttttatcttttgaccaatgtctccccaaccctctcacagacaccctcaccttgcttctggtaaccaccattctactctctacttcagtgagttcaacttttttagattccacatataagtgagatcatgtggtatttgtctttctgtgcctgatttatttcacttaacataatgtcttccaggttcatccacgttgtcaccaataacaagacttccttctttgtttccttaatttttatggagatgggttaaggctgaagagtatatataccacattggtgtatgtgtatcacattttctttatctactcatccactgatggacacttaggttgattctataccttgtctattgtgaataatattgcagtgaacatgggagtgcagatatctcttcaacacaatgactccgtttcctttatttatttatttatttttaatttatttatttatttattttttgagacagagtctcactctgtcacccagactggagtgcaatggcacaatctcagctcactgcaacctctacctccagggttcaagctattcttgttcctcagcctcccgagtagctgggattatgggcgcgtgccaccacgcccagctaatttttgtatttttagtagagaagaggtttcatcatgttcaccaggctgctctcaaactcctaacctcaggtgatccacccgcctcagcctcccaaagtgctgggattacaggcgtgagccactgcatctggcccaggatggctattttcaaagaagcaaaaagataacaaatgctggccaagacgtagagatctttcactgtacttctgacaaaaaaagggttgttatttgtgtgtgtgtgatttttcttccctgagcagcccaggcagagcacactgggccctgtgcactgtcctgttaccttcacattttgtctccactgactccaggcccaacccctactagagctgcagctgtgcctgtgcccaaagtcaatagactgaagagcagaaagagggagtggactcttaccccatggctggcggacattaagatttatctctaggccaggcacagtggctcacacctgtaatcccagcactttgggaggccaaggcaggcagatcacctgaggtcacgagttcgagaccagcctggccgacatggtaaaacctcccatttactaaaaatattttttaaattagccatttactaaaatattttttaaattaggtgtggtggtgcatgtctgtagtcccagcttcttggaaggctgaggcaggagaatagcttgaacctggaaggcagaggttgtagtgagtggagatcgcaccactgcacaccagcctgcgcaacagagcgagactccatctcgaaaaaaaaaaaaaaagaaagaagaaaaagattcatctctagcttgcaaagccaaagtctgccaactgccattgagaagcccctaatccatgaatgaggggctttagcttccttcatagccagacaaggacagaggaaacagaagagaggagacggatcaactacccagagaagccagaaaaccctctgccagggaaaataccacttgtaaaaataagaggattatttggctgtgaaatttgcttaataattgaatagaaaacttattttgattccccaggaaaaacccagacattaagtaatgtaaattcctgttcagccaggagccaaataagcagaaaatatgaattattagagtcctccccaatgccagacccacattctatttcacaggaaataaacaaagaaaaaaattctctgacatggggatttttctctaaccagcaaactgtcagaatgggttggggagggaactgcccgcattttcccatcctccttcccctctctctctctataccacggcccctcagaatcactcacagaggactaatcatattccttgtgtccatttgtgaatcacttggatcctccaagggctggcggaggagtggctcatgaccagtcaatgtcatgaataagtgatcaatgtcccagaagggggaagccatcaagaagctgagaatgggccgggcgcggtggctcacacctgtaatcccagcacatcgggaggccgaggcgggcagatcacctgaggtcaggagttcaaaaccagcctggccaacatggggaaaccccgtctctactaaaaatacaaaaattagctgggcatggtggcgggcacctgtaatcccagctactcaggagactgacacaggagaatcgcttgaatctgggaggcggaggttgcagggagccacaatcatgccattggactccagcctgggtgacaagagtgaaactctgtctcaaaaaagtaaaataaaatacaataacaaaaacaataaataaacagagaatggggtcagctcacccagccgcatgtggaagcaggccagggcaggatgagggacggcttgagcaaattttacctttcacatggtacaaaagtgtttttatttgttccaagtaaatatccaagagttcaaaaaatagttgcaaaacatgatgttccccactctcctttaaaagtgattaaggccaggcacgtaatcccagcactttgggattaaggctcacgcctgtaatcccagcactttgggaggctgaggcaggcggatcatgaggtcaagagatcgagaccatcttggccaacatggtgaaaccccgtctctactaaaaatacaaaaattagctgggtgtggtggcgtgcacctgtagtcccagctacttgggaggctgaggcaggagaatcatttgaacccaggaggcagagcttgcagtgagccgagatcgcgccattgcattccaacttgggtgacagagcaagactccatatcaaaaaaacaaaaaacaaaaaacaacaacaacaagtgactgattagccaggcgcagtggctcatgcctgtactctcagccttttgggaggctgaggcaggatgactgcttgagtccaggagtttgagaacagcttgggcaagatggtgagacctcatctctacaaaaaataaaaaaaaaaatattaaaaaatagctgggcgtggtggcacatgctgtggttccagctacacaagaagctgaggtgggaggatcgcttgagcccaggaggtggaggctacagtgagctgtgttctcaccactgccttcctgcctgggtgacaaagcgagaacctgtctcaaaaaaaatttttttcatgaaaaaaacagtggctgattatacaagcacatgtgatgttagagagttagcgaaagtcccacctgtttgtttgggttctgaaactgatagcagctgttaggattttctgaacattgatcctgtgccagacactgaactaaacactgagcatgttcacgcgtttaatcctcatgataagcccatgaagccaatgcagtgactaagaccgaagccagggtttgaatctgcctcctccacacactagctgtatgatcaagtgacttgacttctctatgcctcagtttcctcttctataaaataggtataaaaatagtacccatcttggctgggagctgtggctgacgcctataatcccagcactttgggaggctgaggcgggtggatcacgaggtcaagagatcaagaccatcttggctaacatggtgaaaccctgtctctactgaaaatacaaaaattagctggtatgtgcctgtagtcccagctactcaggaggctgaggcaggagaattgcttgaacccaggaggcagaagttgcagtgaacccagattgcgccactgcactctagcctggcaacagagcgagactccatctaaaaaaaaaaacaaaaaaacaaaaacaaatagtactcatcttgtaaaactgctatgaaaattatacgagttatatgaacaatatctggaacatagtatgtgccatagaagtatggcatcatctttatcatcatcgtcatcatcaccacaggcgagataactgaagctcaaagaaagaaggctacactatttccccacagtccagttgactctcaggctcatcctcaagccctccttccccacattcttacgcacatggttgctaggctgcattcttcaagccccgtcccttggatgccttgggaagttggaacatcacctcttcgctctgcttttggagccatcgtgctggaaggacagcaggcgtggacctcctctccctaggcacctacccaccacccgcaatgcaacctcttcacctggcacgaggcactcctaggagctctctccagcttcctcttgccatattgtgtgcttttcgaagaggacgcagacatgcaaccccatcccacagcagcccacaacttaaacaacaaaagagaacgcatcaagcagtggtttctccgtgtctttcaccacacctgggcacactaactcagaacacatgcccatccactcagtcccaaagacacgactctttttttttttttttaactctgtgcctatgcttacccaaagacaataccgttcttctttcttttttttttgttttaaacaaaaaaaaaaagacaaagtctcgttctgtcgcccaggctggagtgcagtggtgccatctcggctcgctgcagcctctgcatccctgggctgaagcgattctcctgcctcagcctctcgagtagctgggattacaggcgtgcaccaccacacctggctaatttttgttttttgtttctttaggttttttatttttatttatttatttatttatttttttcttgagacagagtctcactctgtccccgaggccagagtgcaatggcatgatctcagctcactgcaacctctgcctcccaggttcaagcgattctcctgcctcagcctcccaagtagctgggaatacaggcatgcaccaccacgcccagtttttgttttgtttgtttttttttgtttgttttattttttggtatttttagtagagacggggtttcccatgttgaccaggctagtcttgaactcctgacctcaggtgatccaccagcctcagcctccaaaaaggctgggattacaggagcgagccacacagcaccccacctaatttttgtatttttagtagagacagggtttcaccatgttggccaggctggtctcgaactcctgatctcaggtgatccacttgccttggcctcccaaagtgctgggattacaggtgggagccaccatgcccagcaaagactgttcttcctagtgaagaaaggagacaggagaaagatatctgctaactcaagataattttggtttgctcttcctctgtgccattgttcccattcccgcaaaccccatcacaaggaggaaaaaaaaaaaaaaaaaaagaaaggaagaaaattttgactgctagaaagaccttacccaacataaaagcattatggatgcatttgtttactctaaaactttcttgaagacctagtatatgccagacactgtgccgagttcaggactccacctctgctgatggagcccttgtgatacaacaaagacttcttgttctctgagggtttttgctattcatgtgatttgaattaataatagtaataactcaacatctcactggcccactgccctgctggctctcaaggcgctacgacttctgcaaagtgctctctctttaggactttgtccatggtttccttcatctctttgagtatatttaagacagtcaatttacactcattgtcggctgagcatggtggctcatgcctgtaatcccagcactttgggaggctgaggcaggcagatcacttgaggtcagaagttcaagaccagcctggccaacatggtgaaaccctgtctccactaaaaatacaaaaattagctgggcatggtggcgggcatctgtaatcccagttacttgggagactgaggcacgagaatcacctgaacctgggagacagaggttgcagtgagccgagattatgccactgcactccagcctgggtgacagagtgtgactccatctcaaaaaaaaaaaaaaaaaagtaattgtctagcctggcattgtggtgcacacttgtagttccagcctactcaggaggctgaagcaggagactcactcgagcccaggagatagaggctgcagtgagctatgattgcatcactgcactccagcctgagtgacagagggagaccctgtctctaaaaaaaaattaaataaataaatttttttaaaagtcattgctgggctgggcacagtggctcacgcctctaatccagcactttgggaggctgaggcgggtggatcacgaggtcaggagtttgagaccagcctcaccaacatgatgaaaccccgtctctactgaaaatgcaaaacttagctgggcgtggtggcgcacacctgtaatcccagctactcaggagggtgaggcaggagaatcgcttcaaccccagaggcggaggttgtagtgagccaagatcgtgccattgcactccagcctgggcgacagagtgggactctgtctcaaaaaaaaaaaaaaagtcattgccagtaagaccaatacctgggttgccacaaggacagtatctagtcatttctttcttgccacaaatgagtggaactttattatttctttccatgccatgagggtttttgttgacattttcaatttatggcaacactgaaaatcagattctcctccctccccagggtctattgttgctctctatcgtgggttgctgtggtttgcttgtttggtaaattttccaaactatttttgtaaagtctgtattctttgtgtttctgtttctgtttttttttttgttttgttttgttttttctgttctgttctttttgcttgtttctgtcctttttgcttgtcagtcagctggtattttgagagctacctaaaatggctgaagccaacaaataaagaagaataaaagggaagaaacaagaaaacaggagaaataaagagaaagaaagagagagagaaagaaggcaggcagtcagaaaggagagaaaggaaggaaggagggaaggaaggaaggaaagaaggaagggagggagggagggaggaaggaagaaaagaaaaacactatcctagtctttgcaaattggatctgtttggggcactctctcaacccttaaccaagccatttatactctgccttagccttcacttcctgcttgcacagagactgaaggccagaaagagatgaaagcccagggtcttcttaggccttttcttttgtttttgttttgttttgttttgagacagagtctcactctgtcacccaggctggagtgcagaggcacaatctcagctcactgtaacctccacctcccaggtaaagtgattttctgcctcagcctcccgggtagctgtcattacaggtgtgtgccaccatgcctggctaatttttgtatttttagtaaaggcaagatttcaccatgttggccaggctggtctcaaactcctgacctcaggtgatccaaccaccttggcctcacaaagtttcttaggccttttctgagcatgcaactgactatgggcctgcacacagctttcttgatttcctggtttatgtggacacttttaaaagcctctacagacacacatctctttttccaaacttttccttcccaggctgcccggtctgtctattgcttgtcccaagtgttgtcccctgccccagggtattgaggccagtacctatgtctttcaatgcttttgtctaaagccacctgggaagccatgccagccctgaaaatgccctgggtaaaaagctcagaagcctttctgctagtccttggggaagttgtcagacctataaccccaaatttatttatttattttttaagacggagttgccctgtcacccaggctggagttcagtggcacgatcttggctcactgcaacctctgcctcccgggttcaagtgattctcctgcttcagcctcctgagtagctgtgattacaggtgcccaccaccatgcccagctaattttttgtatttttagtagagatggggtttcaccatgttggccaggttggtctcaaactcctgacctcgtgattcacctgccttagcctcccaaaatgctgggattacaggtgtgagccaccacacccagcctacaaccacaattctttgagagtaaattctgtgtactccccctacgctagcaaccagccccagaagggcaggctgacatcctcatggtccctgctgatctggagttggggggatgttacgtgagcaagcaaaaacgccatcaatcacactctcttatcacaggagagctttctttccttccttttttttgagacggacttttgctttcacccaggctggagggcagtggcactatctcggctcactgcaacctcctcctcctgggttcaagggattctcctgcttcagcctcccgagtagctgggattacaggcacatgtgccaccatgcccagctaatttttgtatttttagtagagccggggtttcaccatgttggccaggctggtctcgaactcctgacctcaggggatccacccgcctttgcctcccaaagtgctgggattataggcgtgagccaccatgcccagcctcagagctttctttctccaaattttcccgtagtagttgtaagtttgtttgtttccctttttaaaaactagaaggctgggtgcggtggctcaagcctgtaatcccagcactttggaaggctgaggctggtgaattgcttcagctcaggagttcaagaccagcctgggcaacactgtaaaaccctgtctctacaaaaaatacaaaaattagcctggcatggtggcttgcgcccatgatcccacctactctgaggctgaggcgggaggtcaaggctgcagtgggctgagattgcacagtggcactccagtctgggggacagagtgagaccccatctcaaaaaaatgaaagctaacaaaaagctagatcccagagtacttcagaagttgattctgacagtttttgccaccttattagttgtgttgggggagggatggagccctggaattccctactccaccattttgggccgcacagtacctttaaagtgctcctctgtctccggggaaattcctgcactgtgagtctatagatcccctaggtggaggccaggacttgttttccccatctcccttgcagccagtaaccccctcagttcctagcaagattggctctcgatttttttaaatggatttttcttttattcttttcttttttttttttttttttgagatggagttttgctcttattgctcaggctggagtgtgtacagtggcgccatctcggctcactgcaacctccgcctccaggcttcaagcaattctcctgcctcagcctcccgagtagctgggattacagatgcgtgccaccaggcccagcaaatttttgtatttttaacggagatggggtttcaccattgttggccaggctggtctcaaactcctgacctcaggtgatccacctgcctcggcctcccaaagtgctgggattacaggcgtgagccaccacaccaggccaagaggttttttttcgttttttttgttttttgttttttcaaacacattatctgtctcaaataggctggagtgcagtggcacaaacatgactcactacagccttgacctcctaggctcaagccatcctcccacctcagcctcctgagtagctgggactatagactcatgccaccacacccagctaatttttttcttttttgtagagacagagtcttgtttcgttacccaggctgctctcaaactccgggctcaagtgatcatcccacctcagcctcccacaatgctgggattacaggtgttagccaccactcccagctcttaaaaacagattcactaatgaccacaaaggtgttcctgtccactcaggatcttatgttcagtactggctcagcacaatctgcagccctaaacatccatttcataacaaacactgttcaggccccaaagaatgtctcatttctgcccagcgtggtggctcatgcctgttatcccagcactttgggaggctgaggcggggagatcacctgagattgggagttcgagaccagcctgaccaacatggagaaaccctatctttactaaaaatacaaaattaactgggcatggtggcacatgcctgtaatcccagctactcgggaggctgaggcagaattgcttgaacccgggaagcagaggttgcagtgagtcgagatcacgccattgcactccagcctgggcaacaagagcaaagctctgtctcaaaaaaaaaaaaaaaaaaaagcatctcttgtcctaaaatctcaaaacaaaaggcaactatggccaggtgtggtggctcacgcctgtaatcccagcactttgggaggccgaggcaggcagatcagtagaggtcaggagtttgagaccagcctggccaacatggtgaaacctcgtctctactaaaaaatacaaaaattagccgggcgtggtggtgcgcacctgtaatcccagctactcgggaagctgaggcaggagaatggcttgaaccagggaggtggaggttgcagtaagctaagatcgtgccactgccactccagcctgtgcggcagagcaaatgaatgaatgaatgaatgcaactattttatgtcaggaaggtttgtgggttgcagccgctaccaatgttggagacacccattgcttcagagtatgcaaaggacttgagtgttgaaacacttaagtaagaggaagcagaaattaattcttaaattcctcttctcagggaggctgaatgcagcagattcttgtataacaagtatcatttctcagaagtgctgagagtccatttatctgtttctcctcatgttccaaattgtgcctccagacatactcatgagttagagagtaatatgggtcaggcgtgttagttcatgcctacaatcccagaactttgggagactgaggcaggaggatcacttgtggctgaccagcctgggcaacataatgagaccctgtctctacaaaaaaaattaaaactttgtttaaataaaaataataaaaatttttaaaagagaccaatatggctactcactgtagctgaggaacatttagccatttaaacaatttgtatcactctctaatttgtatataagatcgagacacaaaatgtatgttgtactatcagtcctttagatgagcaattagactgacattgaacactagaactgggaaaagttatttaataataatatgcaataagatttaagttttcaaaatattaaatataaatttttcagcttttattttttatttttcattttcatgttttttgagacagtatctcactctgtcgcccaggctggagtgcattggtgcgatcgcacctcactgaaccctcaacctctccaggctcaggtgatcctcccacctcagtggagtatctgggactacaggtgtgtacctctatgcttggctaatttttgtattttttgtagagatcgtatttcatcacgttgcccaagctgatctcgaactcctgggctcaagtgatctgtccacctcagcctcccaaagtggtaggattacaggcgtgagccactgcgcccacccagttttcagctttaagcaatttttatttaaagctttgtaaaaatataaaaattagccaagcgcggtggtgagcacctgtagtcctagtctcccgagtagctcggattacaggcgcctgccaccccaccctgctaatttttgtagttttagtagagacaaggtttcaccatattggccaggctggtctggaactcttgacctcaggtgatccacccgcctcggcctaaaaaaaaaattaaaaataaattaggaggatcagtagtgccgttcccaattatctcataatttccaccattttaaagagacaaccctcacatctcccaggttcaaaatatcctaaagtatcttcaacctgggttgagtcaggtgccccaccccgggactaaacgcatgtgtcagagggtttggggtgggggtgagtatttaagaaccatgtggctgggcacaatggctcacacctataatcccagcactttggaaggtagaggcaggagaattgcttgagcccaggagtttgagaccagcctaggcaaaatagtgaggtcccatctccacaaaaaataaaaaattagctaggtgtggtggtacatgcctgtagtcccagctactggggagagtgaggcaggaggatcacttgaacccaggaggtcgatttgcactccagcctgggtgacagagtgagaccctgtctgggaaaaacaaaaacatgtggagggagggggatacaggccggtcatggaagacaggcatgttgacagcagagggtgctacagataatctcttgacatcccctaactgacaaagagaaggctaatcccttttattactctagatctcattcttttctattctgccactgaataagcccttactaaatatcagaggttgctctaagcatttgtatcagtcaagatacgttaggttataaaaacgccaaattgcagttgcttaattcacaaaagcgtcatttcttgctcttgctacacacccattgctgggtggctggatctctgcattgtcaccctcactcctgtgccaggcaaatgaagcagccgctcttgggcataatcgcccatcaccatggcggaaagaaagaggagccatatccactctgatgatagtttcttttgctgtgcagaagctctttagtttaattagatcccatttgtcaattttggcttttgttgccattgcttttggtgttttagacatgaagtccttgcccatccctatgtcctgaatggtaatgcctaggttttcttctagggtttttatggtttcaggtctaacatttaagtctttaatccatcttgaattaatttttgtataaggtgtaaggaagggatccagtttcagctttctacacatggctagccagttttcccagcaccatgtattaaatagggaatcctttccccatttcttgtttttgtcaggtttgtcaaagatctgatggttgtagatatgcggcattatttctgagggctctgttctgttccactggtctatatctctgttttggtaccagtaccatgctgttttggtgactgtagccttgtagtatagtttgaagtcaggcagtgtgatgcctccagctttgttcttttggcttaggattgacttggcaatgcgggctcttttttggttccatatgaactttaaagtagttttttccaattctgtgaagaaagtcattggtagcttgatggggatggcattgaatctgtaaattaccttgggcagtatggccattttcatgatactgattcttcctacccatgagcatggaatgttcttccatttgtttgtatcctcttttatttcattgaggcaacctacagaatgggagaaaatttttgcaatctactcatctgacaaagggctaatatccagaatctacaatgaactcaaacaaatttacaagaaaaaaacaaacaaccccatcgaaaagtgggcaaaggatatgaacagacacttctcaaaagaagacatctatgcagccaaaagatacatgaggaaaatgctcatcatcactggccatcagagaaatgcaaatcaaaaccacaatgagataccatctcacaccagttagaatggccatcattaaaaagtcaggaaacaacaggtgctggagaggatgtggagaaataggaacacttttacactgttggtgggactgtaaactagttcaaccattgtggaagtcagtgtggtgattcctcagggatctagaactagaaataccatttgacccagtgatcccattactgggtatatacccaaaggactataaatcatgctgctataaagacacatgcacacgtatgtttattgcggcaccactcacaatagcaaagacttggaaccaacccaaatgtccaacaatgatagactggattaagaaaatgtggcacatatacatcatggaattctatgcagccataaaaaaggatgagttcatgtcctttgtagggacatggatgaagctggaaaccatcattctcagtaaactatagcaaggacaaaaaaccaaacaccgcatgttctcactcgtaggtgggaactgaacaatgagaacacatggacacaggaaggggaacatcacactctggggactgttgtgggtggggggacgggggagggatagcattaggagatatacctaatgtaaatgacgagttactgggtgcagcacaccaacatggcacatgtatacatatgtaacgaacctgcacgttgtgcacatgtaccctaaaacttaaagtataattttaaaaaattaattaaaaaaaaaaaaaaaagaaagaggagccatagaggtctcctgccagccactaaaggcccccgcctgaaggaggcacttctgctcccagctgactggccagttagtcacatggacaaggcactcccaccatgtgccaaccggggagaatctgaatatttggtgaacagctctaatgaccactccagcaggttacaaacattatgtataatcttcacaaccactacaggaaatgttactatcatctctctactaaagacaaggaaactgacgcacagaggcacagcaagtggcccgagatcacacagcaagcaaccagtgaagccactagattccaaagcccattctcttaaccccattttgtttttttgttttctgagagatggagtcttgctctgctgcccaggctggagtgcagtggtgcaacctcggctcacagggcgagactgtctcaagtaaaaaaaaaaaaaaagccaggtgggggataggtgtaggggcagaacctgggtgtcctgtccatatctcagcctattccaagactgatttttgggtccacggaattctgtgaatgcaacactgtggcagaggcacctagattggattatccattttttttcttttttttttttttttagacggagtttcactcgtcacccaggctggagtgcaatggcgcaatctcagctcactgcaacctctgcctccaggcttcaagcggttctcttgcctcagcctcctgagtagctgggattacaggcacctgccaccacgcccagcaaatttttgtatttttagtaaagacggggtttcaccatgttggccaggctagtctcaaactcctgacctcaggtgatccacctgcctcagcctcccaaagtgctggggttacaggcgtgagccaccgcacccagccggattatgctttaaaaggcatgctttcccatagccgtgagggtcagggattattttttttacagcatagtgccatgcccgtggagagtctagatgctggggatacacaggtgactaacagggttcttgctgcagggaggcttagccctttagggattaacaggttccaataagggcacagactgtttgtttgtgcacccttgtgtcccgtctgcctaacattgtctggacactatagacatctaataaacactgggaaagaccaggaaaacgcagtacaaaacacgctaagggcctggagtaggctgaggcttaaaaacatttaaatgctcacgtgaccacttcctagcctcttggacaaatggctttccaattctgtgcctcacctttttcacctgaacaactggagctgggccaggcgcagtggctcacgcctgtaattccaggactttgggaggctgaggcgggcaggtcacctgaggacgggagttcaagaccagcctggccaacacggcgaaaccctgtctctactaaaatacaaaaaaaattagccgggcgtggtgatgtgtgctggtagtcccagccactcagaaggctggagcataagaatcgcttgaactcatgccactgcactccagcctgggcgacaaaacggactccgtctcaaaaaaactggagctggtaatagtacccatgatgcaggattgctcagattaaataatatatgtaacactcttagctccacgcctggcaagcactaacaaccattattagtctcattaaggcttccacatttttaggagaaagatgaagtaaaacacatgttccttttggaggaagataaatggaagtgacatttaacttggctcttgggaacatctttggagagaaaaaggcattccaggtgggatgaaccgtgagcgaaggctgaagcgcagcacgtatggagccctctgaggattcgggattgccaagtatgtctttggcaacaacggattagactgaaaagccaagtgagattcagagtttaggtctcccagagcttgctttctccctggccaggagctcaaagtgaacttcctcgcctggggtgaagtcatcctctcagacgttggtccagacctagcttcaaactctgccttgcccagagacctgtgtgctctttcacctggcactcctgaccctgaggtgagacaatagcctctaagtgaggacacgtggcaggcacgagtatagatgtgttgctgaatgtaggggtccttggcagtggttccctggtcttttgaatgacacatttctttcagcctctggtcagaggctccacggggtctctccatgaaaatgcaggggtgttaagttttgcatgtctttttggacagtgcatcatatccctgacacctgcagctccgaggctgagcagcggataggtgctgggtcccttttactatgagccaaaaccacctaggtaggaatggatgatccagatgctatcaccctctccccactccggggtctctgcctagcaacagcagcagtatgctgggaggatgctgggatcaccccacagaaatacttgtctctgagccaagacatcctgccagcacgaacctaaattgtcttcagaccctcaaaccctggggtctagtcccacaccaagcagccctgggtcatgttataaagccatttacaggatctgaggaacaaggggtaaggtcatccgcttccttgccaacataaaagaacacatgttaaatccatcagccacaccactccttcttcccctgtcacgtttctcccactcctgaccacttcaaaggacataggatccccacaaaatggtgacaacaaatggagccattttcatatcctattttatttttgaagtcagtgtccagaaagaaaccgacgattcactcaatcaacatgtaagcgactgaggcatccctacacaccaggtttgcaggctagggaccagagacacgatggttaaacaagccagagccctgtgatcctagggcttacaatgctggcataagaaaatccttctggactcactgtccccatgcttgtgactgtcatgtgccaagtgcgctttacacaatctcatttttccctcaacttggggataggttttgtatcattcccattacagatacggatgctgaggttactgagtggaagaggaaacctgaattctgctgctggaccccaaaactcatgttaattacccacagcctcccaaacatcagaggccccaaacatgcctcccaactcacttctcacaaatgggggccgttatctgccccatctctagggccgttctgtaacattctcagcgacttcccatatcttacagaggcaggccctcctttcaggaagctgatccatgccccttaataaggtagcttctctccccacttggcacaccacctagctagccaagggcaaagcagagactaggggacaggccccagcaccgggtcagcacccactacctcctcagtgatcaacagtgcccattgcacttcaatgggcacctgcaagtggcaccagattctcttggaacaattcttaaggcagggcgtggtggtcacacctgtaatcccagcactttgggagaccaaggcaggcagatcacttgagatcaggagttcgagaccagcctggccaacatggtgaaaccccacctctactaaaaatacaaaaatcagccagacatggtggcacacacctgtaatcccagctactcaggaggctgaggcacgagaactacttgaatctgggaagcggaggtgcagtgagccaagatcatgccactgcactccagcctgtgtgacagagcgactttgtcttaaaaaaaaaaaaaaaaaaaaaaaaattcctagcaagtatttattacagcagtcagtgacaaaagccagatctaaaatcctatctacagaataatcctagccaggcaaaacaaattcatcaaaaactaatagaaaatactgaaatataggccaggtgtaatggctcgtggctgtaatcccagcacttcgggaggccgaggtaggctgatcacttgaggcccagaactcaagaccagcctgggcaacatggcgaaaccctgtctctactaaaatataaaaattagccggatgtggcgacacacacttgtaatcccagttactcaggcggctgagacaggacaatcacttgaacccgggaggtggaggttgcagtgggccaagatcgcgccactgcactccagcctgagcaatagagtcagactctgtctccaaaaaagaaaaaaaaaaaaaaaaactgaaatacaactaaaatatttagtgtcaaatacctggttttggcagacagcaggggtgactgtttcttaggcatactggtttcataagaactttttcccttggctgtattagtcacttcagggaatcgcattcaccgataaacgaagcaactgcatgctgccgcagaagctgtggctacactgctgtaaaggctcaaaacgaccaagtggaagcaccagagtccatgaggcattttatttgtaaatatatgtattacatccctagaaaaagaatcccaggattttccctcctgtgtgttttcgtcttgcttcttcatggtccatgatgccagctgaggttgtcagtacaatgaaactatggagtggaaaaagaaagtgctggtaagtttaatagttcaacatagtgccttctagtgcagaaaaacatcaacactcatcagtggttaagggcgctttcctgtggggcacataggaactgacagtgcctacatgagctggtgcctcatgtagcgtatgagccatgactcctgcaacccaaagagccaaatccagagagcccagccacacaatcacacagccctgacttctgcctacaccatgaaacaaactgcactgaaaacaaaggctgggaactcctttaaatttaaatgtcactttctgctctcaggtaaggagacttgaaagtattcgtataaacttgagtttgaattgtgtttctgccatgtactgtataatagctaaactattatatggagacgttcatttgtacaatgagtggctgcttcatgagttactgtggggatcactgtaacaagcatatagtatgcaaatgtgcggcattaaaatcagtatcataattacaaagagaaatgattttggtgagaataccgtacctgtaatacagcaaccatgaagtgagaatactttcaaccaaggcaccagacgcataatttggagggtataaattcttaaccacaaagatacacatttactgtgtcagctcataaagtgctttaccaaaattaaatcaggtgataaacagaggaactattaccacttttacggatgaagaaatcaaggctgtgacttgcccaagatctcatggctttaaagcagaaaaacaagggtttgaactcagataggcttttaaggacaaagactcccaaactaagttttcccaaaggcctaggcttagaactgattctggccctcatctgggatcacagggaactatctgcagtgagccaaaagggcagacatgaaagtggacacgaccccccttttctgccagtctaagctctcatgtgcctctcagaacctgaagctcaacacatgaaatgtggcaaatagccaggcacggtggcaggcgcctgtattcccaaatccacaagaggctgagcggggaggactgctcgaggccaagaagccaaggctgtagcgtgttatgaccgcacctgtgaacagccactgcactccagcctgggcaacaaagtgaaaccctgtctctctctcttttttctcgagacagagtttcactcgttgcccaggctggagtgcaatggcacaatctcagctcaccgcaacctctctcccgggttcaagctattttcctgcctcagcctctcaagtagctgggatcacaggtgtgtgccaccaggcctggctaattttgtattttaggtagacacggggttctccatgttggtcagggtggtctcgaactcccaacctcaggtgatccgcctgcctcagcctcccaaaatgctaggatcacaggcgtgagccactgtgcctggccaaccctgtctctttttaaagagagagaaaagaaatatggataacacttgagctattaggtcaaaatggttaagagtagacaaattaccactgctttgttttaaacagaaaaaaagaaaaaaacccttaagtcaaactgcaccacagaaattcttagcattaacttcttttaattaaggaaaggccaacttacccaaactggcgggatggaagcagattattctgccatttttccaggtctttgagttgcacgtcaaatctggggctgatcaccccacactataaaataacaacaacaacaaaaacattcttcactttaccaataacagaaaaactgagtaacacaagatgacattcataaataaacagtcctccaaaccaaccaacccagcattcagatgggtacttattctgtgcacaatgcttgacatacttttcaaaaaatacacctaagtaagactacgcctgcctaggagaaaaagcaaaggcatgcaaagagatggaacaaggcaatacatggcagtgtcaggccactggcgtgctccctgttggctggagagctgtccaggatgatcagattttacatagcctagagatcaagtctcgacaagagagactacagccaaccctttcttacataataaggctgaaataaaatcatagggtctcaaatcctgaagctctacaaattattagaatatctaaggaacacgctgtccaggcactgaactaagaacgctgctcccaccaatgaagtaccgttacatatttccaagaaacaatgtcctacagccccagacaaatttttccaaacaaatctgacagaatgatggaaggcagaaagagcaaagggcctgcaattatctcatctcgtggctactgggacatggcaacaatgatcctcccaagtaaaagctcgccaagggctgccatcactcaactacatgccagccctaaaacactactgaagaaagtccactaactgatgtccactaactgaagaccctctgctcacaaaatctgctctaaaatcacaggcacacttgaaaaacacttccaaaagcagagattgacccacagaaactgaaaatgggcttgtcagaaaggcccaactgctctacgccaggaagcctgcttaagttctcctactattaccccatcagctatgctgtgacttgactaacaaggacaatctcacggcagatgaaagaaatgcagggataggaatatgggaaaaccagttttatccaagcaagctatagtgaaagatctttccaaagtctgccgcacgctgcatccaagttttatgttgattccagcagcaaaaattcttctcattctggtagaattaaaacagcataccctcccccaacccagaagaatcgtaagaggatgtgatcaaggccagaattttaatcaatctagtctttacacactaccttacttccaagctcaatttccacgctaagggtaggtccatgtcttgcatgaaagcgatggagggggacgttctcttttaaatggggagaaatgaaattccaagaaaccaaaaattgtttgctttgtcgaaagtcacagaacaggccaggcgcggtggatcacctgaggtcaggagtcccagaccagcctggccaacatggcgaaaccccgtctttaccaaagatacaaaaattagccgggcatggtggcactcacctgtaatctcagctactagggaggctgaggcaggagaatcgcttgaacctgggagacagaggttgcagtagccaagatcgtgccactgcactccaacctgggtgagagtgagactccgtctcaaaaaacgggcagagagcagcagggcctgcatatcaactgttgtaggctagaatttttcaaactagcataccacagaacaagggtgccacaaataagttccatttacagaatgctctgttcaaatttatttctcggctgggcccagtgactcacacctgtaatcccagcactctgggaggctgaggtgggaggatcacttgagcccatgagtccaagacaaacctaagcaacatagcgagaccccacctctacaaaaaagttaaagaaaaatcagcagtcacagtggaatgcacctgtattccccagctactcaggaggctgaggtgggaggatggcttgagctagggaagctgcagtgagccaagatggcgccactgcactccagcctcaaccagagcaagactatctcaaaagaaatataaataaaaataaatcaatcctattttgaggtggggttctaatggctacaactagaacaaaacatgacatactgaaaattacccttgcaagttcttcaaatcttagggagtcttgccctgttacccaggctggagtgcagtggtgcgatctcagctcactgtaacctccgcctgccaggttcaagcaattctcctgcctcagtctccggagtacctgggattacaagcgcccgccactgcgcctggctagtttttctatttttagtagagacagggtttcaccatgttggccaggcttgtctcaaactcctgacctcgtgatccgcctgcctcagcctcccaaagtgctgggattacaggcgtgacccactgtgcccagctagttcttcaaatctttaacaaatacttcagcaactcaccttctgggtctctttcccccctatctgttgcaataaacacaggggtgtccaagggagagaatacagtcatgggttcttagtttctgtttctagttgggccagtaaggccccttcctcatccctcttttccatttatcactagagacagaaactaagtaccatggtttcaggctgctacaagtctaaaacaatacaacaaaataaggcaggttggacaagcctgaactagaggatctgcctccttgcaaatctgaaagctacaaacctgacaggaagcacagtggacacctcaaccagcttaagacacctgcccccaaaacacacgcaatcacttaaaccacaaagtcagttttacttggttaaggtgttgacaagtcaaactgaaaagcagcatagaccccaaagacctatgccagcaaaaacagaaaaagtattcatattgctatttagaaagccccatttactcaaagataaagattccattcaaaaaacccaacacatcactgagaggaaggacacagcaccttggacaaaaggctcaatggccttgagccacccaagttcaagccagtgaggtgggtagcgttaacatccaaataccagtaccagcgttggtttcaccccccatctctcctgagacagcttataccccataaaaacactaggtcaactgacataatcctagcacaatcaacccaggagagcaaatgaagttccatgtgtcaatttttaaacctttttaaagtaactggataaatcaagtatggcaccactactcagtatttccaaaggcaattacaacatttaacgccacagtaaaaaattcttaaagctttgaaatgtgtagatcactcgttcttaccttgtttagcctgcctgtgaggttcacaacaattttcccagctctgtggtcatcaatgatttcaaattcgccaatgtaacctacaaaagataactgactggattaaataaaagacatcaacttgagagctaaacctctgtgctctagcctactcaattcttcactctcccatcacctcagtgactgcttctccaaaaagttggggggaagacagttgctctgtatcagaactaatttttacaacctaacatataagaattgggagacaatacccaaaacaatccaccttgcaattctgaaagaaactattttccccttgacccttccttcactgcttcccattcccaaagactactttgtgccaaagaagtgcaataatccaatctttcctctcaaagagctctgagaagatctcaagagtcctttctttcttttttttttttttgagatggagtcttgcactgtcgcccaggctggagtgcagtggccgatctcggctcactgcaacctccacctgctgggttcaaacaattctccctgcctcagcctccaaagagctgggactacaggcgcctgccaccacgaccggctgatttttgtttttgttttttgtttttttagtagagacggggttttgccatgttggccaggctggtctcgaaatgagctcaggagtcctttcaatgacttagattcatttagctcccaaacacctagcagagctcctttttccagcagtcctactctaagtgactcttcagcagtttcagactatcccctcctccacagcccacaggtcaattgcattcgttctcaggtatgacagacatactttggtcccccataattaatttctacaggactgatttcttagagagtctcacatgaaaacataaaacacagcggcagcagacttaccatgcttcatcatcacagtgagaaaccggacgatgactttggagcacggcctaataagcacctggcgtttgcctctcttttcggcattgttgatactcttgagagcatctgccaggacattcatgcgcaccattgtggctgttcaaggaagacaaaacaggaggttttactggcattgccaacatcaacagacaccaaccattacactgcggaagtatcctttcctttctggccccaccttggcgaagttttctcaagtctaagcaggctgcttctccatttcccaccacccaggaaaattcctatttactacggttgttgaaaacaggttatcgggacgtcagcctgcacattttgaaactcattcattcactaaccactcttcttcgaatcgtgccacacaccaacgtctggagataataaaatgtgggacaaaatccacttgacacaagacaacgtgagaactggcagaaactgccagctaccggaaggaaaacatcgggtatagtcgatcagtgattcagaacagaagcagagtatcatcggcaacattttccaaattgctgaaaatcagcagattccatactattaacattgtactttaaatcagttcactctcacctacaatgaacacatctaactattaaacatccatcttcgtgccatttaaaattgcgtccaacagcaagagccacagtggcaaacagaaacattttacatgcttgtcagactggactctcttctaatgggcaagaaccgcacactacactgaagttttgaaagaccaaagtgccaatagtaaagagtagaacttaaattccttaagttcaaaagtgtctaaagaaaaactctgcggcccagaagatccaagttggcacccagcaaactgccaaccccggcacgatgcagcttttacctgctgggtggcctcagcctcccaagctcccagcgcggccgcagcagtgagaagctgcacggcccaccagccccgatgttgcccgccgcccggggccaaggcgctgcctcagcactaaagggagatccagacgctgcggcccgaaccggagctaccgcctagctgggcagtcgaaggctccggctcccgcccgcgctgcggcctgcaccccacggaccgggatcccctgagtgcacagtctggggcgcccagccatggctctcctctatgcctgtccaggaaccggcaaggccaggatcctcggccaaggtggggaccagcctcctcgcaggacaccgagaccgaaccttagattgcaggatggcgccgatggcagacggatgaaattggagctctcagagagtgctactcaccggcgcggaaagatggcggaaagaggacgggaggggagagcgcacggagttatgggaagcgggagagctatcgcgagactttcaaaggcccggcaaaaacaaggaccgcctaggagaaggacgagggtgagggaaaggcggagcctcctcaggggttggcagttgagagtcgatggaatcgacctcccccggtggggcctgggagaggcaaggtgagccgttcgttggaggttcgtctacattttttttttttttttgagacagtttcgctcttgtagcccagactggagtgcagtggcgtgatctcggctcactgcaacctgcgcctcccgggttcaagtgattctcctgcctcagcctcctgagtagctggaactacagagatgcgccaccacgcccggctaatttttgtatttttagtagagacgaggtttccccaagttggcgaagatgttcttgatctcctgaccttgcgatccgcccgcctcggcctccgaaagtgctgggattacaggcgggagccaccgcgcgggccttaatttttattttagtttacttttgataaggagtctcgctctgtcgcccaggctggagtccagtggcgcgatcttggcgcactgcagcctccgcctcccgggttcaagcggttctcctgccccagcctccagagtacctgggattacaggcgcccgccatcacacccggctaatttttgtatttttagtagagacggggtttcaccatgttggccaggctcgtctcaaacccctgacatcaagtgatctgcccacctcggcctcccaaagtgttgggattacaggcgtgagccaccacacccggctaaaaatttttttttaattaaaaagttaagttcagacaaaagtcacccaacagttgtttactgagcacccatgtaccagacgctagcaaggccctggggtacgaggtgcccacacaggcaccatttagccagttctgtccctgccggttcttccagcttcgtcctctctcacacgtcaatgcccctgctcattcgttgcatttcctcttccctctagcatggtacctggatatttgctaaataaaacttaaaccttttatttttgttcttttttaaaatttttcctagacagggtcctgctctgttgcccaggctagagtgcaggggtacactcagctcaatgcaacctcaaactcatggactccagtgaacctcctgcccaggtctcccaaagtggtgggattacaggtagggtaccttatagacatctaaggaccacacagggtacttcattaatcagattcataaatccaatcataaatattatattggctaagttataaagaaagtgagacatgaagattccagctttttttattttttccccttttacacaaaacaaagtagaagaaataatacaggattaaaactgcaaaagtagttaatcagtagaatatgtatgcacacaaaaaatccagataggaagacaggcttatttacaatgaaagtaaggtaaaattaacgtagttttcttatgaaataataaaaaaaaatcaaacatatgctacaatgggcaccactgttcacagcaatattaaagaggagaaaacaacacttatttaatagggacagatataccacaaggtacaacatcagtgcaataaattcacaaaactatattacagctagttaatcagtttaagaattgttcccgtcagtcacattttttggccctcagaagttcattcctaaagatttcaactactctaaatttctagctaccaagaagttaagaatgattataagaagctttccaaggagttatgaaatctttgtagaccagaggccaactatcatcacctcaagtctgctctcaccaacagcccttgtatttttcagggagaaatctctaggaaaaaagtcagacaccagtgtagtcactatctcccatgtcaaacctaggggactaaaatggtcagtattaccataaaatgataattttgaggtttaccttaaaaggcttattctggtctcaaaaattagataagattatcttctactgaaatgaatattgactaaacatagaagactgctgtccttttgccagtcttagagtgaaagtcatagacatgagtcttaacctactgtatactatagctaatgtcagctgaaaatctgaaattaaaagcatgctagaaatcctaaatgcaatcttttggaagtctgctattaaaaagcctttaaggatttactaacttcgagtctaagtgcaaggggacgaaagcttaagcctgtcagacattccttttcttggacaaaaagatcaaagtttcctacaaattgctaagctttgcacaagggagaagcctacatgtactagtgcatggaatcagtttcatcttatttcatggggactcttctcccactggaaagaaacagaatgaggaatgaatcttaattggtctcttcatcagaagtggtaaacttggtctctatattcacgaagtcagacagttttttaagcagactgtggaagcagacagaaccagcttcctgtagccacagaccactacatggtatctaagctaaagcaaagatgaacaattatccagattcacttgaactgtactaaagggcaaggttcaccactacaaaaaggaagttgtctaaaagcaagaattcaattaacgctgggtaagaaaagtcaaaacactaatgagttgtccatgaagccaactgctaagaacgcgctcaactatacgcgacatgaagacactatgcacgaagccttacttggcgagtctgaatttctattaactaagggcagagtgagggagaacaaagagctacttccgtaacattttagtatccagatagtacagcagaaacggttcccggggcaatgggtgctgcattaatcacactgattaaagcagatgaatcattcgtttttcttttctttttgtttgagaagtttgtttatctccctcttggccattccaatgtacttcaaaatgattccatgttggtttagtccaggaagcaatagtaaggaagtcacttaaaataaaaaaaaacccaacattaaggaggcagcaattaacctgctaaaggttattactttttttttttttttttgagacaaagtttcacttttgttgcccaggctggagtgcaatggcgcaatcttggctcaccgcaacctccgcctcccaggttcaagcgattctcctgcctcagctacccaagtagctgggattacaggcatgcgccactacgcctgactaattttgtatttttagtagagatggggtttctccatgttagtcaggctggtctcgaactcccaatctcaggtgatccgcctgcttcagcctcccagagtgctgggattacgggcgtgagccaccacacccagcgacaagtctcactctttttgcccaggctggagtgcaatggcacaatctcggttcactgcaacctccacctcccaggttcaagcgattctcctgcctcaccctaccaagtagagtagctgggattacaggtgcctgccgccacgcctggctaatttttgtatttttagtacacatgtgatttcgcaatgttggccaggcggtctccaactcctgacctcaggtgatcagaggttattacgtgtgtatggcggtggtgggtggggggggtggtgagtgcagtggtgtgatctcagctcactgtaacctccacctcctgggttcaggtgattctcatgcctcagcctcctaggtagctgggactacaggtgtgtaccaccacatccaactaatttttgtatttttagtagagacagggtttcgccatgttggctaggctggtctcaaactcccggcctcaagtgatccacctgcctcagcctcccaaagtgctgggattacaggctgagccaccgtgaccagccagttattacattttaaagaaggcaggttcctacattattaaactcagtaatgggaggaagcaacatgaaatcaattacttccactgggatgtatccccagaaacttctgctctcatcccctcttccacctcagaaaataatcattgcttatttttacctcttgcacattactttctaccttggttattgcattgttttcactttctatgagaccataataatctttccatattcccacagttccttttcggtgtctaaaacttaggaagtattcagctgtttactgacgaagttacagttaaatttcactggccaggatgtgcctgtagtttttcctcaaagacttacctatcaggtaggtgagaagcaggttgtggacttgttgtcccacccaagcaaccgcagcaagggaaacgatcatggtcatgaagtactagcaatgaaaacaagaatttaatatcaaaacttcatgtgacaccataaatatatgtaatttttatttgtcaattaaagaagaatgtgtttcaaagttcgggaaataatttagcttttattatcacttttctttaaaaattcttagatttaaaaacctattccattggatctactttatagaatttggatacatttcttcctagaattactgcaattctgtatgtaaatattttatgatataaattatacgatcttttcagttaataacttcacggaacagcctcacgacgtgaagcttacagataagagaacagatgaacagatgctttccttttttttttttttttttgagacagagtctcattctgtcacaaaggctggagtgcagtggtgcaaacagctcactgcgcaaacacagctcactgcagcctcgacctccagggctcaagtgatcctcagccttccatgtagctgggattataggcattagccactgtgcccggcctaaacagatgctttctaagtatatgtcttttactattatttcagtaagaaaaatgaaacagaagaattttgttttattagaataaaaaattaaatgcaaaaatgtaatttttaactttaaaatgattcagtctaattaatacaggtaaacatttatgaatgtacttaggaattaaccaatgaataattttcaaattatagctattaagacaaaaaggcgaattgactcaaatcttaaaattttactgtacttaagtcaaagcaaaaaaagtaccatcttaggtttttcttcctttagtgtgaagaggcgtttccaccaacccacagctctgcgtcgagtttttactagattgctgcaaatttcatggaatctttgctgttgttcagtggtcctagaaaagaaatttgccttttgctataaacaaatcgttacagtagacaaaaacatgacaccctgttcaatttaagagctatcttctaaagaaaataaaaataaaaacaatgtttcaccattatcttatgtaggtgaaaaaatccttccaccattaagacaccttttatagcacaggagtaagtatttacataaactatgtgtgtgagagagagagtgtgtgtgtgtgtgcgtgtgataaagaaaggatcatctctggctctgaagccacatttatttaatggtagtaaaagactcatgacttctatgggccataaagaaatcagtataaatttgattttgctattcctaaatattctttagatcctagtaaatgctgcactatacctaccagaatcccaccgaacaactgtatttgaacactccttagtaagatactaactactggcatttaacacataacacccccaactgggcttcatacatctgatgacaaggcagcaataaacagctcaaatctaaattcttctttgtaaatttatccctagggagggaaaatataatcaacaaacaacacagcagtaaaaatccaacaagagaccctccaagaaaaccttttatatttataatgtttttcttggttctgatttttttaattgcctttgcactgtcttcgctacacagctataatggctgctattattgccctgtgctgagggatgtgttgccttctcttctctagccctcatctctgtaaaactgcagtgatagataaagtacaaggatttctgctgagccctggaacttcttttcaacaatgagatgttatttcttgcccatggtcaaggctagattgtggctatgcaaaagagtattctttcttccttgtaagatcaaaaaataaacaaaatctgctctatcaataactgagtcacatcacgaaactatcagtggttatttctgcaaactttcctctaggagttataaattagcagactggaatgttatctggctaataaggccaaggtcagtgatttatttcctttgctaactctgttatactgcacattcagaaacttgcccaaaagagccaacaacattgattcattactgcaagtgaaaaacaatttggacagttcctaacactaatccattctgctgttgggggaaacacctttaaatattgtcaattatatcataatttaagcaaactttgaatttgttcttaaagatccataaggtacacatttaaaattcttatatttacagaattattttgcaatttgctatcctctgagatacaaacaaccaaaggcacaagtagaatactaaccaaataaaataaacagccaaggatagaatagcagctgagaagaaaatatctattccaacttctattttggctgattatttgaatcaaaactcaacatgctagagaaagttaaaatacttttaatatgatccttatccacttaactatatctgaggagttcataagcaacctcatggtataaataggccgggcacggtggctcacgcctgtaatctcagcactttgggaggccgaggcgggcggatcacaaggtcaggagatcgagaccatcctggctaacatggtgaaaccccgtctctactaaaaataaaaaaaaaaaaaattagccaggtgtggtggtgggcacctgtagtcccagctactcgggaggctgaggcaagagaatggcatgaacctgggaggtggagcatgcagtgagccaagagcgtactgcactccagcctgggcaacagagcgagcctccatctcaaaaaaaaaaaaaaaaaagagaatggtataaataaaatcagcaacccatgtgtatacagcttgaacctcttcggaaacacttggtattcactttgttaactgccattccactgcctcagtgtctcagtatctcagccttaacacaagatcaatcttaaaagtcaaaatatttcacagtactttacagggcctgccacagtaggcatttaataaataattgctaaatgaatgtgaatgaaaatctgccagtttccttttctgtattcattcaaaaataatttgtgaagttattatactatcctaaatatcaatggaaatgtaaaaatgtatatgtgcatttaccataaaagaactatggagtacagaaaattcatagtttatattcaaatcagttacaatattcttcacataaaagcaataaatctaatgcttaggtgtctgatggttagacaattatctctgcttatttacagcatactaatcacagccaccaagttcagtaactacacaaaaatgagactgccaaatcattatgctacctaccatttattggagccaaaaattctaggcgctagaatgggaacaaggtagtcagccaagcacaaaaacataacaaaacaggaaacgccggacagaacagatggatctagatagtagataatcctgttaaaaaaattaataaaggttagaaaaacatagtcattattattcctaactaaacatgtctaacttaactattcacttaactattcaccgcctctcagagatatttgccatttttcttctaattttctcacaagtggctttccagaggctttgtgacatgctgatatcatagctgcagtggttaagtatatatcaatggacaaaagctctttggagttctcagcacttttttaagagtttagggaggtgggggactaggggagggatagcattaggagaaatacctaatgtagatgaagggttgatgggtgcagcaaaccaccatggcacatgtatatatacctatgtaacaaacctgtacattctacacatgtttcccagaacttaaagtataataacaaaaaaagagtttaagtgtctggaggacaaaaagtttgcgagtcactgatttactcaagtgctttaggttaccaagtttacagaagtactacaaattctggaaactagaagtgcttatgagaaacattctttatgggttctttatgggttatatattacagaagacttaaggcactcccacaaacagaagctatatattaaaaagtctttattaataagaagcacaacccatagtaatctaatagctcacttacagaaacaccaaagaaaccacacccatgatggcaggtggaaaccaggctctttcccatcggaggactttatcagccatcagcatcacttctccccatccttgcagctgttcttccagacttgcagtctctgcagcctaaataccaccgacatttaaagtgatcattttaccactctcaacatttttgtggttcatagacttcaattattttaaagctccaaatacaaaaaataacctcttaaccaaattgccaattttaaactagttggtttctgaaaaactgcaatttcaaagatgaaaatacaatgggtttttttgttttttgtgtttttttttttgagacggagtctcgctctgtcacccaggctggagtgcagtggggagatctcggctcactgcagcctccgcctcctgggttcaagcgattctcctacctcatactcctgagtagttgggactataggcgcccgccaccacgcccgactaattttttgtagagacagggtttcaccatgttggccaggctggtctcaaactctggacctcaagtgatccactcacctcgtcttcccaaagtgctgggattacaggtgtgagccaccaggcccagcctaaatatcctttaatggtcacttttctagtccaagcactgggctattctttatatacatgatgtaacttaatccttacagagagccacaaggtagggataattagactcaatttacaattaaagaaagtgagctcaaaatggtttactttctcaaagtcatgcggggaatcgtggcagtgcccagagtattaataaaatgaaataactttttttaagtttgtttatttcagatggttagaattgatccgttgtttttgtcatcttattgatttaaacccttctaaatccattaggaaagactttccctgaatagcattcaatttctaaaatagctctttgtgtaatggaatcactcagatgttgacattcattggacaattaaggaaaactactttcaccaaattaaggtggcattttacggtcaatatacctcctcaatacagtgtttcttaccactcaggatgtcattttgattatacttcaaatttctctgactctgaacagccgaaagtgggcctctaggatgagctaatgtggcaaaagcccttaaagctggttttggtaaaggaagaaaaatttagaataagaaactcaagtgtctctatgttatcaggctggatgcagtggatcacgcctgtaaacccagcacttggcgggtcgggggggattgcttgagcccaggagatcgggaccagcctgggctgagaccttgtctctttgtaaaagtcattcactggaaatcatgcaaatgacagaacaaggcacttaatcttaacaaagacgctcgctatctgtgccacgctgagcactagtgtgatctcaatatttctgactttatattccatgcttaatactagtgaaagagactactatgtgtgggcactctgctgagcattcatatttatacttcaattaatcttcctaacaacccttaaaaaaaggtgttattactgtccccattttaccaaggaggaaacagatacagaggttaactgatctgcatccaagaaatccacgaccaaaggcgttgctttccttagagttatattgctctgctggaaggagagttgggaagcaggagctctagcccaggatttgtcatttcaacagggcttgagctacttctctgtgcttcaattaatcctcttaaaaagatccacgctgagaactaactatgctagaaggagcgtgtgtttaaaggaacaaaccatgcatttctaaaagcaaatataaaatcacgcacaatcaaaactgccctgaagtcacgtcattggccagcgtctggggtcttggaagttcaaaagcccctaagtaaattctttggttccgtttttcattgctggtatgtgacctacagtcaccagggaagggcaactgagaatatgcaaggatatttctcttgttttttgcccacaaggtgcgcttaaattcataacaaataaaaatgtgtccgcctatgataccatctcactgcagttccttcggatccctgcttattactctaaagctgtttccagtagtcctgtgaccccacccccgccagacttccaaattccagacaaacgccaagacatcccattgtctgttcagctggaccccgctcccggttccccacggtgagctcgcagcctccctgtcgttttaagttgtaccagctctaagataaattctgggcagtagccctttgaccctccacccttgtccaagttttagggggaaaagaaggcaggcacatccaggttaagatcaaagacggggaaagccgaatacggctggggcctgagccgcgaaagcgctggacaggccccaggaggccttctgcccccacccgcaccccaggctagtgtcgcagcccctctgcctcccacttcctcctcgactcctactcgcggtgatgaatcacgcgccctcctcgccccgtcgcgcaccgtccccaggaaaggtaagggttcgacacccaggagtcacccaagaagcccgagggccaggcatcgtcgcctgcccagggagagaagggccgggcccgcggcgggtgacagggacgaggccgcggtgtttgagcccacggacgtctggaggcctcgctcggctcccgggggacaggcagccaggactcaccagcaggttggtgctgcgattatctccctccgccatcgtctcggggatgcagtctctacaagcgcaggccacctccccaacgagtcctccaaccgaaacccgcacaccaaccacaacccgagggaacgccccgcaggctgcttatatgggtcggccgcccttcccgacggcccccgcgacgctcgctcctcattggacagaccgagcttacgcctcaaggaagccgggccaaccgaagctcagcgcatggcttgaaatcgaggtcaaaggagacagaggcagcgccgggccgagggggaggggacacggagtgcccaatcagcgcccagggactgcgcgacgccccgcccagcgctgtgggaagcggttcaaccgcctctgcagggggcgctgtccctcagtggttctccggctcttgccgctgcggtggctttgggtccctcttcgtctggctttcgcagccgaggagactctctggaaaatgggctactcgaagagagatgctccgttgcctcaggcggagggcggggacgccgggcctgcgacacttcatcttttcctggccccgaggtggctgggatccgttccaccttcggcccagttccccagccaggcccctgagccgtttagcccggatttgcgacccgtgaggttttgaggacaagtgaaaagagctctttgtgtggattttgctgcaatgtttctctcctacccagtaggaatgaggccttagcttgcgcggaaaaacccaggcctggtttgagaacgtgtgaaaatgcaccgccttctaagtggctttattatacgtggatgtttaagttacttaaactacaagctccctctccaaaaggattctttttttttttttctttttttttgagacggagtctcgctatgttgcccagcctggagtgcagtggcgcgatcttgctcactgcaagctctgcctcccgggttcacgccattgtcctgcctcagccttccaagtagctgggactacaggcgtccgccaacacgcctggctaattttttgtatttttagtagagacgtagtttcaccgtgttaggatggtctcgatctcctgacctcgtgatccgcccgcctcggcctcccaaagtgctaggattacaggcgtgagccaccgcgcccggccagaattgtttgtttgtttgtttgagacgaaggagtctcgcgctccgtggccccggctgaagtgcagtggcgcgatctctgctcactgtaacctccatctcccgggttcaagtgatcctggcgcgtcagcctcccgagtagctggaattacagacgcccgtcactacgcccggctaatttttgtattttaatagagacggggtttcgctattttggccagggtggtctggacctcctgacctcaagatatccgcccgccttagcctgccaaagtgctgggattacaggcgtgagctaccgcgcccggccaaaaggatagttcttgacacgacctttcttccattagaggtcaagctaagaaaatatgtaaaccctctcacaagcagtagaattcctaggcagtttaggaactgtgttgaggcacttgtacatcttttctatccaggatttcaaatgcagtaacaagtgctttgatcttttttttttttttttttttttttttttctttttttcttgagacacagcctggctctgttgcccaggctgtagtgcagtagccaccgcgcccggccgatttttcatcgtttgatacaaacagaatcatgccaaatgtccggatcagatgtttgtttcaggtgaattaactatagttttaacttccaaccttttatcttttttacaggttttaacttccaatctcatggtcatttgtattcggccattgaatttaaatttatttttaaaatgttccttaagtaaccaccaggttcttaaatgttcaaggaagtcataaatgtgagagaacatagctgcagaccacatactgcccctaagagagctgggcaagggcaggagcattgtgaatttcatggaagggtgtcaatttgctgtgggtctttcggggaaaggggagtgaagtatctgaatcagggagaagcacttgaaaaaaagtctttgcaagggaagctgactgttcaataaagtgccactttggagaatgttggggtaaagaagttgtaaaggcaggatacagccagttgacagagacgctatttggagagattttaaagctatggagtctgaggagcaggttcttctccacgcccctaaaaaaaaaaaaatacaaatggggaggcagggaagatcccttgagcccaggaaatagaggctgcagtgagctatgattgcacctatgcacttaagcttgggtgacagagcaaaaaacctgtctcaaaaaaaaaaaaaaaaaaaaaagtcaaaaagatcgaagcaatcagcagccacataattagtgaatatgttgagcactgggtatgtgatcttgctagacccacagtaatagccacttccaaaagagagggtattttattagggtttaaaactgacatttctacttttgggaaatcagcttttgctgcagaatatgcttcttgttttcacccaagttttccatgcacaacttaagacttgttaacaccagcttgtgaaatgaaggtaggtgaaaaaaacagaagcaactgaaacagcagtttctccacttagtattttttgttacttaacaatgtattcccatacctatttctaaatgcacagccctgctatatggtctctcactaaatttccgattggtctaattattaaaaaacacccacccttaacatagctttctttagagctttgtttttgtcctacagagacaggatgtgatcttttgaaatgtgccagatgactaagcagttaacacaaatcttactaacttcatttagcagcaacaaatgcaatctccaagatataaagccaagctggacattttctattttttttcagaggtttcacactccaaggaatgcacctatctgtcaataatgatctacgggaattttgtttttaaatactgccaaaattaagctttataaattgggccttaacacaaagaattttatcgttgaagtagaatttctactgctattcaaaaatacaacagatgtttgagaataaaatagttacttttctgagaatttaggggtcttttttgaggtattagtgctattcagaaaaaaaagactaggcttggctcggcttagtggctcaggcttgtaatcccagcactttgggaggctgaagtgggagtgtaacttgagcccaggagttcgagatcagcctgggcaacatagggagaccctgtcgttttgttttttcaagctacccaggttccaaaaggtttcaagttttccaaaatctattttgaccaataaattcagaacttaaatgctgtatcttttgagactgaacctttattttctgaaaaacaggtatttcatacaatctttgccatgttaatgcaaatatgcacaaagtaggcatgtatttgttttccaaaagatgcattatgaacattttcaggaagctggtgtgatttattcaacttttaaatacaatcacaaaattatatccatcaggaggcattacaaccttttgtacagaaaagccactatttatacattgttactaagacaaggaagattcagttcaactcaacttgctcttagaataagggtaaaaagtaaattaacaagtaagtgaagtatgatgttgttgccactgacattacaggtggaaatataagggaaatttaaaccagaaaaatgacacaataactttaaagaggagctgaaactttgtcaaaaaaagaaaaaactattagcctgttttcaaagaaaaacattctaaaagtgtgcatttcagaacatagaattcttctaagtttaccatcttcaaaaatcttctaaattgtatgacacttttacattagcacaacaaacagctttttctaagtctagccaagttcccatggaaggcaaacgaccctaagtagttcatattttacagcccttgaacttataaagcttttctcattaagagtcagttttacccttctgtaaataaggatggtgatactgttatccaggcctaaaaagcaggaagtgcaacaaacccttagggtttcatgatacagtgaattttcccctccccaacgtttggaaaaaattgggacacttgctagttcttccctgtgggaagaatctttctaatattacccaaatattgaaaacaaaatctaccttctttaacccttgtattagtaattctacctccttggcttatggggggaaaagtcctagttttaaattgctggcattttacaagctcaacaagataaaaaattgaacactggttttcatactctaattttatgtaaaacaaagatgcttaaatgtgcgaatagtaaagcattcactgatatttgatgtatctgaataggactaacaggctaattgtaggtgctttcatatgaaaataattgggagaaaagaagaaccagctcctttgatttcagtactgccaaaacaagtaagcccccagagttaattacaaaaatgtagaggaaaataggcccggaagactttgcaatttaaagtactgcctataataccccagattaaaaaggaccgaagattgcacatcaagtctaatatttggctgtacttgcattgccctgctcggcatttttaaaaaatggctctttccttaaatttcacacgtcagaacaaccacaattaaaaaaacaaaaaacaatgcagataacaccaaacattggacaatattaagaaaactacttactaagcttaggtaatagaggcaagggttaagggcagaagtgatggaagtgtttctttgtattacaaaccctcaccctaaacctggggtttgggctctaaaaaagtaatttagggaagcagatcaagagcctgattatcagttctcacatggaaatctcaacagatttcaaaagcaactcaccacaagtgtcagacacaaaagaatcttaataatcatctagcaaactacactaagaactcaatgaccaaaaataatcaatcaaacttcaagacacaccaaagcaacagtaaaagagaaataactacacaagctaagctctgtagagaaatcaactaaaaattaggcaattctagtaaattaaagacagcaaaaaacttaagattgaacttcaatttccaagggtactttgaagaggttgtttgtaggttattctgtaccccctgattcttaaagaaagtggaggagagggggaggcgacagaggaatggagggaaagggggaggcaagagagagaaacaggagaggatccctggttttccacaggtattttatcaaaaatgtatgacttcataactacagcactctaacttttctcagtctaactgctgaggtctcttacgaaagttcaaatggcaagtcaccttgtagaatgacttaacagaggaagccaaactatacagaccagggccttgtccagagtgcagtaaggagcaggcttttgaagtcatctattacatctgccttacaaccaaacccactgtgtatgccacattattcttggagggaccactttaaaacaaaagtgatggataatttaccagaggcacatgcttttgaagtaaagctgttttttgtttttgcttgagtaaggtgccaggtacctctgaagcctgaaaacacaggcaataaaattcacctatttatcttctttaccaaagagaaagcaatttctgaatactatctatagtgctaaactaatgtgaactgactatcattgcgataaaagtttttccttatgatgacaataaagaatgttgctgaaagactttaatcttgagagagcagaggtaatgtgatgaatgtaatttgctcccagagcctctagaaaataaagcagtgtgcaaaatacaatatggcattattattccagctaggttttttgcgaaaataaggttccaaatgaatgaagaaaacaaaatttgatgcgctaggttccttaacttgctattggacacatgggtatttcaaaaaaatccaccgtgcctacaatacttgttaaagtaccaaaaaagcactgatactgaaacacattctttcatgggtacttaacgattacagattaacgtggcaatcagaatacaaaaaaggcccagagctatgtggaattttttccttaatacctttcaagtttgtctgtgaagacggcaactagaaagtgaccactgtcctaatctctaaaatgcagggaaaatgtactcaaacaatttttttttttatctagtcatttatttttgacacagagtctagctctgttgcccaggctggagtgcagtggcacaatctcggctcactgcaagctccgcctcctgggttcacgccattctcctgcctcagcctcccgagtagctgggactacaggcgcccgccaccacgcccggctaattttttttgtatttttagtaaagacggggtttcaccgtgttagccaggatggtctcgctctcctaacctcatgatccgcccgcctcggcctcccaaagtgctgggattacaggcgtgagccactgtgcccagccaacaattaagattttaattgtgttctattttgtattgatacttgattttaagaaccctattctagtctgggtttttattttggatcagcaatttagcttacacagtcagtactgaaatgcaatgctaaatttaaggaaaccttgatcatgaattcactataatgtattactgaatagcaagctattaaaattgtgcaaaaagtaaagcacttcacagactaataactgaacttaataaaagatgttggtggatctcattttcactgtttcatgtacatgtcctaaaatgccaagtaaattaaacaacttttaatttactaagtgtaaattaaaagtatcaaatgaaaaacatgaattaaaaaaatttcagtctacctccaccagaacatcactttattgttaatctatcatcaacaatgtaaaactctaatagatactctatcttggtttttaaaaaggtaaaagattacactggattagctactttctatgaaagaaactacagctatcacagaagagggaaaatttgaatgacctccaaaaaaaatgcacactataagcaaaagggagtgtacattaaatcaaatgtctgttagattcattacttttgaatgcacagtgacaattctggaaactgtacatgatagaatcacagaaatgacttaaataaccggaattacattttgtgtgtgatcatcagacctttaaacaatccttgaattttccatgttatcagaagttgttaacagcatcgagacggaagtatatgaaatataaggactgaaataaaagtgaatttgaaagatggctaatctactagattaggtaaagggggaacgggtaagtggtggggaggagtagggaacgatggggtggtttttttcccttcatttcagaagtaagttcttctactgtagtgtatctgttacatagctctccattttcagtccatttctgaaattcatatcgcatagcctttagcctttttctacttactggtcaacccaaccagtactgttgccaagcaacaagtgttacacgagaatctgaatgcatcaaatcttccttggctgtgatttcttcgcgaccccagttttctctgtttctgagtggggtttgtttttttcctggattgtacacacagggtcaggtggaatggagttccaaatcactctgtgctccgcggcatcccgatttctttccgcagctaacctcccgacacgtctgctgctgttctgtggcagaaagacaatctccgtgttcaggcggtgagcttgctttccttcacccttgaccctggggttgcaggccatggtgttgggcgtatccctgagtgcagctgtcctgcgggattcacttcctagtgcaccgagatttcctaggtttcctcagagtaagcccccagttgcatcaccaccgactgtggtgtggctttggatgcctgaggctgagttgattctggtggatgtctgacctcgcttaaccagactcatctactgtcttgccattcacacccaggctgtccaaccttcatacagctgagccaagttatctagattagttgcttccttaatgacatagtcaacctgtaaaaataggcaggatagtatgtaaagtcatttaaagcttttcaattgtctgctgaattacaatcagcagacaaattatgccaaaagttaagtgcaaaggactctatacttaccctgctcctgtaagccccttaattttcatataaaatgtaataactatcagaataaaaagcacaataaccaagtatactttaaaaagagagctaagacagttataaagatatgaaaagcacacaatccattaacctaccagaacgtttcttaagtaaaaatatcccaaactcagaaaatctctcatggtttttgacaaacttgacaaaacggtttcttaaaaaaaaaaaaattcttgcccaagaagagttcaagtctaggtcctatacaagaatataatagtgtttaaaagaaaaaaaaaattccttgctgatgttaaaattgaattacggatgccaaaccatggaagaacaggatattcagtctcttaatttttatcccacaggaaaaaaatgtacatttataatgaagacatcaagaggatacctctcttgaccaaatgatctagcttatcaccaccaaagatggcacaaactgacatgtgtctcttgatgtaaaatactgagaaagaaacatcactgatgttgcattccttccaaaaaaaatcttgaatgaattgaattatgaggaaaatatcagacaaatataaatggaggcacattctgtaaaccaactaatctagacaaaccaaaaatatcaacggaagagaagagggaaaggctcaggaactgttctagatattaaagcagatcaagaagtaggacaaggatggacagtccctgactcacagtggatctgaatgaccattttttacctcaccatgggtttatcggggtattaaatgcattttagacttatggatttattgggatgtcactccataaggggaggaccatctatctatacacaaaatgcatgatgatccttgactagatcttgaaggtcggaggaacagggggttcagagaggaggaataagcaataaaggatattttgagataattggagaaatctgaatgtggactgaatgtcagataatagtattacaacaatgttaagtttcctgagttgacaattatgtagtagctacagtattatagtattttgttcaagagacacatggtgaagtttaggcatgaagtgctaagatgtctgcaaagaaccctcaaattgttcagaaaaactgtgtgtgcatacacacacagaacaatgaaacatgggaaattgttaactggtgagtctaggtaaaacgtttatgggcattcctataacttttctgtagctttattctcaaatttatatattcaatattagtaagactaatgaaaaaatttcagaataatgacttcagacaaatgtcccgatacccaaagatgctttacaaacataggttgagtatcccttatccaaaatgcttgggacctgtagttttagattttggattctttgagattttggaatatatacatgtatataatgaggaacttggtggtgggatgcaagtctacacacagaatccacttatgccttattatacacatagcctgaaggtaattttatacattttcagtgattttgtgcatgaaacaggttctgactagattttcactactgggatccatcaccaggtcaggcatggaacttttcacttatggcatcatgtcaactctcaaaatgcttcggatttggagcatatgagtttctaattagggatgctccactcatactacacctgcaacccaaagggtccttggcatttcatttgaaaccttcaacagtcttctttaaatggaaactaactgtagtctggtggaggaggatcggacttatatttgggttaaaacagggctaggggaaaggaaagtgctcatagggaagggtcagagtaaaatggtgactacttgacgacgccagagctgtgttactcaaaatcttctgaatcctgaaaacacatttaagttccttgatgaactattaaggaaatcgatgagagggatctttatacacctctacttttccagcagcattaaaatgtgtagcccaagtttaaaacacggtcacctgttcagcaactgacatcctcctattcggatcaacatctcggccctctaacttggctttcactctcttccacacactcactgcataggagtttctctcttgcaccgctatgaagcaacaaaaacatacgtaagtcaaaccgtcattttatataaaaatttaaggcatctttattctaactaattacctttcccagttttagggtctctgactgcctttttaggactacaagcaacactcttgccagttcctggaacggtgcttggtggagtatcagctgatgtagcaagatttttttggatcagctttctagcattctgtgacatgacatcaggctgagtcttctggccagtgttactccggactgctacagagaaagagttggtggctcaatttacatgtaaacagaacatggagggggcagagtggagcaagcacgggataggtggtagtggttgataccccaattaaataatcaactataaatccttatccttggacacagcaattgtcttcctaaaaatgtagcctaaaaacagccagacattcaggtatgaatttgtacaattatgtttactaggcttgtggcatcaaaaaccataaataacagccaggcatgatggctcacgcctgtaatcccagcactttggggaggctgaagtgggcggatcagttgaggtcaggaatttattaaattcaataaaagtgaaatataaacattaatttaccaaaatatacaatggtaatatgatattttgggtatccacgtgttaatctttgtgaactattttatatatatatacatatatatacacacacatatatatacatatatatacacatatatatacatacacacatatatatacacatatatatacacatatacacacacacacacatatatatatacacacacatttactatacttcaggttctagggtacatgtgcacaacatgcaggtttgttgcatatgtatacatgtgccatgttggtgtgctgcacccattaactcttcatttacattaggtatatctcctaatgctatccctctcctgtccccccacccacaacaagccccggtgtgagatgttccccttcctgtgtccaagtgttctcattgttcaattcccacctatgagtgagaacatgcggtgtttggttttttgtccctgcgatagtttgctgagaatgatggtttccagcttcatccatgtccctacaaaggacatgaactcatccttttttatggctgcatagtattccatggtgtatatgtgccacattttcttaatccagtctatcattgttggacatttgggttggttccaagtctttgctattgtgagtagtgccgcaataaacatacgtgtgcatgtgtctttatagcagcatgatttatagtcctttgggtatatacccagtaatgggatggctgggtcaaatggtatttctagttctagatccctgaggaatcaccacactgacttccacaatggttaaactagtttacagtcccaccaacagtgtaaaagtgttcctatttctccacatcctctccagcacctgttgtttcctgactttttaatgatggccattctaactggtgtgagatggtatctcattgtggttttgatttgcatttctctgatggccagtgatgatgagcattttttcatgtgtctgttggctgcataaatgtcttcttttgagaagtgtctgtttatatccttcgcccactttttgatggggttgtttttttcttgtaaatttgagttctttgtagattctggatattagacttttgtcagatgagtagattgcaaaaattttctcccattctgtaggttgcctgttcactctgatggtagtttcttttgctgtgcagaagctctttagtttaattagattccatttttcaattttggcttttgttgccattgcttttggtgttttagacatggagtccttgcccatgcctatgtcctgaatggtattgcctaggttttcttctagggtttttatggttttaggtctaacatttaagtctttaatccatcttgaattaattcaagcctagccaacatggcaaaatcctgtctctataaaaatacaaaaattagcagggcgtggtggcaggttcttgtaattccagctactggggaggttgaggcaggagaatcccctgaacccagaaggcggaagttgcagtgagccaagattgcgccactgcactccagcctgggcgactgagtgagactcatctcaaaaaaaaaaaaaaaaattaaattaaattaaaaaaaaataaaataaaataaaaataaataagaaaataaaaaataaaaataaattggccattaagtcatttttaaaaagattatttaatgactgaaaaattattaactggaaaggcaacaaaaattacatttgcataatcatcccaatgtgtttgtgtatgtgtacatatgcacagcaagtaaatcaacaaatgcagagtggtttctgcctctatttggaatggaactacaaattcttcatttgtattaagtattttcctatgtttctctgatatatatatatattttttttagccaggcatggtggcgagcacctgtaatccaagctactcaggaagctgaggcaggagaattgcttgaatctggggggtggaggttacagtgagccgcaactgtgccactgcactccagcctgggcgacaagagacagttttgagactccgcctcaaacaaaaataaaaacaatttttttaaagaaaactattcaaattagcaaagcatttttactctctcacgagttgtttcatttttttgagacagagtcttgctctgtcacccagcctggagtgcagtggcgtgatcttggctcaccgtaacctccacctcccgggttcaagcaattctcctgcctcagcctcctgagtagctgggactacaagcatctggcaccacacccagctaattttttttgtatttttagtagagacaaggtttcaccatgttggcccgactggtctcaaacacctgaccttaggtgatccacctggctcagcctcccaaagtgctgggattatgggtgtgagccacctcgcccggccttttttttttttttttttttaatagctgtttatttatttatttttaaagagacagggtcttgaactcctggccttagacaatcctcccaccttggccttcaagtagctgagattacaggtgtgagccatcgtgcctggcttacgagtatttttaaggataagctaaaatctgttcagtttaagattatagaatgacaggccttaagtgtttaatattagacagttatgtataattaaacatcttagcatctatgtgtaacattaacaacagatcaagactcaggactcttctcctacctgcagcgaaggatggctgataagtagcagatgacgttggactcgaacattcatttgttgcatcggtgactaagggtgatgcaaaactcactaaattattatagatactgaaatacaaaataaaatggcttatttacgaaatgttttacctgatactacttataaaaatatgaacaaaactgaaaaattaaatcaagagataaacttcttataccagtagttttgtacttatgttttataaattctgaccagaaggcattcttacctctgactttgtgttttcagttctttcaaggtgggagtgatttcctggagcatttcaacgtgttcttgacttcgaacctgacccatagcctggactaatgtaaatagaactgtttgaatgttgtcttgccatgatttatattcacccaaaaactgcctaacactgttctcatagggaacatcttcaccatctgccagagcagcttcttcatcctagaattgataaattaatgattaagaaaaatagttttagtatcagtaattactctcaagacagtcacctagtgattaagtaacaaatgtttcaaatatgagtgtgtttaaactgcttagttcaactccatttttataggaactttgtttccaccatcaaataaaaattcaaagtaaaagtaaattctaaaattaaattatttactgtttgtaatgatgaagtaatagccttttctggaggcttagttttcttacttactagactatgtacaacactggagggaagagacaacatttcattcattttggaggcaaactgtatgggtttgttggtatagctaagaaagagaaagacaagctggatatctgaatgctcagactaggttcatatcttggttttattacaagttatatcacaataaaggaatctaattaagccttagcttctctgtgtatgaaattcaaactactactactggctttaaaaaatagttgatgaaaacacaagttaactcagttacaaacaaattggaagatgtgatgagataaattgttatttacaaaatgtcactgtttttcctataaataaaactacttgtaaattttataacagagggagagtaaatgtgtgttcatggtattagtcttaccttagccatagctttcaagagatgtttgacatctccaagctgtcggttatgaccagtgagcacagtctttatattatcaaccagattctgaattgtttcacagaccgtttctatctgctgctctttctctgtctgaattgccctctgagtagacatatcctgggtcaactgtttgtgtgctgacaaaagccattcagagctgccaataggatgttcaagaccagtgtcctaaatagaacaagcatttgtttgacttcgagtatcagctgaaataatgagttctttcttcattaacatcatcaaaagatattagtaactcaagctgacacaaagagaacctccattgctaagtcatgaattaattacctacaagttacttaacaataatctcaataatctatgaaatatagatgaagatttttacttttctgcataatcatgcaggctttaaatgcttaaagtttaagacctgagaaatacattcggaatcacaaagatgactggcaatccaggtccctaaattctaaataactcttcgagatgaaatgtgaacttcctaacatacagctttaagctttctgacaaaatataaacgtcaaacttaccaacttgctatttctggccttcactaacctttccagcattcatcttccataagccctctttctcctgctctattttcagtgcattggaatcatttgctacatatcgtctttctcctcccttctaaactttcatagtattttggttgtagctatgaggatcctttacacttcctcattttttatatttttaaacatataatatgtttcggggcgggggggggggcgctaagaaaataatttaatcatcactgtccccccgcccccctaacaacctcttacatacagtatatgctcaacgaatgtaatcggaatgtatatattaaattgattttaatagtataacactagccttatttaatcaagtttctttccaccaagactcaccactctctgtaataaacgaagctctaactcagacactgaactgttaaactgtgatgcaaacgaacacatctgctgacatcgcttgattagttcaaataacgccgcatccaggtttaaggcttctgcagttcttgttcgtaaactttcaaaatgaatgatattgctgcagagaaatgtgacctgtaaagacagaaatggaaccacaagaggagatgggaggaaggtgggaaagggaggtggcaattaataacatgaaaaaatactacttcctcattttgagaattcaggaccagaattggtcctgaaaatgtttgggaaatagaccaaaaccttataaaggctgtaaataaatgtacatttatactgacactgttaggtctgagatggccaaaagcactgacaaacaattaggtaaatttatcttctacattactgtttttacatagaatatttactccacaataaagctgttatattcagctgcaatttgtgttacagccacaattcagaagacacttctgtcagaatgttccccttctgcttctattcttgcctaacttatctggcagtattaagctcattttaaaggtatgattaatattgtggttagtttttttgttttttccctttgagacaaggtctcccctgttgcccaggctggagtatagtggcttaattatggctcactgtagccttaaactcctgggctcaagcaatcctaccgccttagtctcccaggtagctagtctcccagctgggaccagaggtgcgtgccaccatgcctagctaaaaaaaaaaaaaaaatttattggccaggtgtggtggctcacacctgtaatcccagcactttgggaggctgaggccagcggatcacctgaggtcaggagttcgaaactaacctggccaacatggtgaaaccccgtctctactaaaaatacaaaaaacttagctgggcatggtggcgggtgcctgtaatcccagctacttgggaggctgaggcaggagaatcacttgaactcgggaggcagaggttgcagtgagccaagatcacgccactgcactacagcctgggcaacaagagcaaaactccgtctcaaaaaaaacaaaaaaaattttttttttggtagagacagtgtcttgctatgttgcccaggctggtttcaaactcctagcttcaagccatcctcccgcctcagacttctgagcagctagagctaaagggacataccaccatgcccagctatgatacattcttaaatagttcttaataggtatatactgaaaaatttatagataaaattatgcactatttgggatttctattaaatatggatagaaaggaggattagggagtatgggtgaaataagataagacttaagttgatcattattaagcactggcgacaggtatgaagtatgagtatcatgtattagtccaattttgtacttagttgaaaatgtccgtaatagtttttttggttctcctccccctgcccaatccacagcctcttgacagggcacaaggtccttttttttttttttttgagacagagtcttgctctgtcacccaggctggaattcagtggcacgatcttggatcactggaacctctggctcccaggttcaagcgattcccctgcctcagactcctgagcagttgggactacaggtacccaccaccacacccagctaatttttttgtatttttagcagagacggggtttcaccatattggtcacgctggtcttgaactcctgaccttgtgatccacccacctcagcctcccaaagtgctgggattacaggcgtaagccacggcgcctggccaacagggcacaaggtcttaagacgttttattgtcatgtggaaaaaataatattccaagtacctttccaaatctttggatcactttagttgtataaaagagacccagagaaccttaaacagatatgaatttaagacctctttatttttcaacagaggctgaatttatttaattaatatttaaatgagaggcagtaaaggccaaggaaataacctgctgtgggttcaacttaaggcatgtcctgaaaggcccatccgtccctcctcccagggctgtgagccagaacgtgggctctcaagctcccctagttaccccacatataacttccagctactcatctaatcctgtaaaagtgaatacaaagatggtgcatgtaagtcacaatacctgacttgctctttggctctctttaaggacaagatttcttctttcagctatcgttgcttcaaaatcttgtagtacaggggccaatgcagggttggcaccacctgcccacttgagtcgctgttcaatacttgattcaagtgcagctagcttctcctataaaagccagcagaatcttggtgaaggtatatgacattctctacttcctatttgtggagtattttatataacacaataaagattcaaaagaaccagggtggacacatgtaatttagaaaacaaaagttttaacaatcaccttttggaattaaccttgatttcactttgaacatttaaggccaaacatgtatggagagagaggcaagaactggctttcagtttattatcttaaaacgtacagaaggaagtttcactttcattttaaaataaaatgatctttaaaaaataaaaaatatgctacaccaaattcttttttttttcttttgagacggagtctcactctgtcacccaggctggagttgcagtggtgcaatctcagctcactgcaacctctgtcacctgggttcaagcgattctcctgcctcagcctcccgagtagctgggactacaggcacctgccatcgtgcctggctaatttttgtagttttagtaaagacggagttttaccatcttggccaggctggtcttgaactcctgacctcatgatccacccgcctcggcctcccaaagtgctgggattacaggtgtgagccagcacgcccagctactatcttggctcactgcaacccccgcctcctgagctcaagccatcctcccacctcagcttccaaagaagctgggacaagaggtgcgtgccaccatgcccaactaattttttgtattttctgtagagacgaggttttactatgttgcccaggctggtctcaaactcctggcctcaagcaatccacccacctcggcctcccaaagtgctgggattataggcatgaaccaccatgcctggccaagtttatgaacaatggtaaaaatccatccagattatcatgacgaggaaagtttaatgtaacaaagttatttgattatttattcaacatttcaggtggacgcattcacattttctctccccaactccctctactttcctgcatgtccatgtctctaaaatcataaagaggaagagttcattcttgtaagttgaaaacacatcttttctctgaccaatacactgtagagaaagcttatttcaatcttcaaatgactgagctccaaaaaagcttcattaaaaaacttttaaaacatcacagaattatacttgattttatactgctattaatttacaaaaacaaaaatgtcagttactactgagtacatgaagtataaaggacagacaatataaagatacacataactttcattaaggcaagtttctcttatgtaaaaaaataagtagaaggattatgtacatagctttcaatatccagtcactataatagttcagaaaaatattctgctgccttaggcatcacaaaattccattatctatacaacataagaaatgcccatgcttgttagctactactaataaacaaaatagaactacttatatacatttcacaaaacaaattcagtattcaaagtttttctaatcatcaaaatttccttaatgtattaaggcacagtaattatcaaattcattaaaaacctgagatatttagtatgtttctttttttttttttttttttcttttttttttcttttttttttttttattatactctcagttttagggtacatgtgcacattgtgcaggttagttacatatgtatacatgtgccatgctggtgcgctgcacccactaatgtgtcatctagcattaggtatatctcccaatgctatccctcccgcctcccccgaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggatatgaactcatcattttttatggctgcatagtattccatggtgtatatgtgccacattttcttaatccagactatcattgttggacatttgggttggttccaagtctttgctattgtgaatagtgccgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatgatatctcatagtggttttgatttgcatttctctgatggccagtgatgatgagcattttttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcaaaaattttctcccatgttgtaggttgcctgttcactctgatggtagtttcttttgctgtgcagaagctctttagtttaattagatcccatttgtcaattttggtttttgttgccattgcttttggtgttttggacatgaagtccttgcccacacctatgtcctgaatggtaatgcctaggttttcttctagggtttttatggttttaggtctaacatttaagtctttaatccatcttgaattgatttttgtataaggtgtaaggaagggatccagtttcagctttctacatatggctagccagttttcccagcaccatttattaaatagggaatcctttccccatttcttgtttttctcaggtttgtcaaagatcagatagttgtagatatgcggcattatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcaatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtgtcctcttttatttccttgagcagtggtttgtagttctccttgaagaggtccttcacatcccttgtaagttggattcctaagtattttattctctttgaagcaattgtgaatgggagttcacccatgatttggctctctgtttgtctgttgttggtgtataagaatgcttgtgatttttgtacattgattttgtatcctgagactttgctgaagttgcttatcagcttaaggagattttgcgctgagatgatggggttttctagataaacaatcatgtcgtctgcaaacagggacaatttgacttcctcttttcctaattgaataccctttatttccttctcctgcctgattgccctggccagaacttccaacactatgttgaataggagcggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcccggctttggtatcagaatgatgctggcctcataaaatgagttagggaggattccctctttttctattgattggaatagtttcagaaggaatggtaccagttcctccttgtacctctggtagaattcggctgtgaatccatctggtcctggactctttttggttggtaaactattgattattgccacaatttcagagcctgttattggtctattcagagattcaacttcttcctggtttagtcttgggagagtgtatgtgtcgaggaatgtatccatttcttctagattttctagtttatttgcgtagaggtgtttgtagtattctctgatggtagtttgtatttctgtgggatcggtggtgatatcccctttatcattttttattgtgtctatttgattcttctctctttttttctttattagtcttgctagcggtctatcaattttgttgatcctttcaaaaaaccagctcctggattcattgattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtaggcatttagtgctataaatttccctctacacactgctttgaatgcgtcccagagattctggtatgtggtgtctttgttctcgttggtttcaaagaacatctttatttctgccttcatttcgttatgtacccagtagtcattcaggagcaggttgttcagtttccatgtagttgagcggctttgagtgagattcttaatcctgagttctagtttgattgcactgtggtctgagagatagtttgttataatttctgttcttttacatttgctgaggagagctttacttccaactatgtggtcaattttggaataggtgtggtgtggtgctgaaaaaaatgtatattctgttgatttggggtggagagttctgtagatgtctattaggtctgcttggtgcagagctgagttcaattcctgggtatccttgttgactttctgtctcgttgatctgtctaatgttgacagtggggtgttaaagtctcccattattaatgtgtgggagtctaagtctctttgtaggtcactgaggacttgctttatgaatctgggtgctcctgtattgggtgcataaatatttaggatagttagctcctcttgttgaattgatccctttaccattatgtaatggccttctttgtctcttttgatctttgttggtttgaagtctgttttatcagagactaggattgcaacccctgcctttttttgttttccatttgcttggtagatcttcctccatccttttattttgagcctatgtgtgtctctgcacgtgagatgggtttcctgaatacagcacactgatgggtcttgactctttatccaacttgccagtctgtgtcttttaattgcagaatttagtccatttatatttaaagttaatattgttatgtgtgaatttgatcctgtcattatgatgttagctggtgattttgctcattagttgatgcagtttcttcctagtctcgatggtctttacattttggcatgattttgcagcggctggtaccggttgttcctttccatgtttagtgcttccttcaggagctcttttagggcaggcctggtggtgacaaaatctctcagcatttgcttgtccataaagtattttatttctccttcacttatgaagcttagtttggctggatatgaaattctgggttgaaaattcttttctttaagaatgttgaatattggcccccactctcttctggcttgtagggtttctgccgagagatccgctgttagtctgatgggctttcctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaacgttggcctgccttgctagattggggaagttctcctggataatatcctgcagagtgttttccaacttggttccattctccacatcactttcaggtacaccaatcagacgtagatttggtcttttcacatagtcccatatttcttggaggctttgctcatttctttttattcttttttctctaaacttcccttctcgcttcatttcattcatttcatcttccattgctgataccctttcttccagttgattgcatcggctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtcctcccgtagctcagagtaatttgatcgtctgaagccttcttctctcagctcgtcaaaatcattctccatccagctttgttctgttgctagtgaggaactgcgttcctttggaggaggagaggcgctctgcgttttagagtttccagtttttctgttctgttttttccccatctttgtggttttatctacttttggtctttgatgatggtgatgtacagatgggttttcggtgtagatgtcctttctggttgttagttttccttctaacagacaggaccctcagctgcaggtctgttggaataccctgccgtgtgaggtgtcagtgtgcccctgctggggggtgcctcccagttaggctgctcgggggtcaggggtcagggacccacttgaggaggcagtctgcccgttctcagatctccagctgcgtgctgggagaaccactgctctcttcaaagctgtcagacagggacacttaagtctgcagaggttactgctgtctttttgtttgtctgtgccctgcccccagaggtggagcctacagaggcaggcaggcctccttgagctgtggtgggctccacccagttcgagcttcccggctgctttgtttacctaagcaagcctgggcaatggcgggcgcccctcccccagcctcgttgccgccttgcagtttgatctcagactgctgtgctagcaatcagcgagattccgtgggcgtaggaccctctgagccaggtgtgggatatagtctcgtggtgcgccgtttcttaagccggtctgaaaagcgtaatattcgggtgggagtgacccgattttccaggtacgtccgtcacccctttctttgactcggagatatttagtatgtttctactcctggttcaaaatatacctgttactataagattcagttaccttggagggtaagaaataaaaaatataggccgggtgcggtggctcaagcctgcaatcccagtgttttgggaggccaaggtgggcagatcacctgaggtcaggagtttgagaccagcctggccagcatggtgaaaccccgtctctataaaaatacaaaaattagctggacatggtggtgcgtgcctgtagtcccagctacttcagaggctgaggcaggagaatcgcttgaacccgagaggcagaggttgcagtgaggtgagatagtgccactgcactccaacctgggcaacaaagcgagactctgtctccaaaatatatatatataggtataaatatacctatatatatatatttttatatatatttggtataaatataccaaaatatatatttttatatatctttggtataaatataccaaaatatatttttttatatatctttggtataaatataccaaaatatatatttttagatatatttggtataaatataccaaaatatatatttttatatatatttggtataaatataccaaaatatatatttttatatatatttggtataaatatatctaaatatatattttatatatatatttggtataaatataccaaaatatatatttttatatatctttggtataaatatatctaaatatatattttatatatattttggtatttggtataaatataccaaagtatatgtttttatatatctttggtatatatatacctatatatatatatatatgtataaattaaaagcaaaagtgaaaaaaattatgctcttctggcttacaagccaaggacacacaaatagacacactgaacaacagagcactaacaatcatagtattggttatttctaaaaagaaaatgccctggaaggaagatctggcaaaacacacctgaactgttgcaatagaagtttcaatctggctcagggtatgcagcttctttttcatgctggttaggatagcagaccgtgggggaggtgtgactgacatggcttgtggtctattgataagtagatcttcatgttgccactgttgagagaaaaagaaatgtattaaaatcagcaggaaaaaagcgtttagataaataagggaagggaggcgcaacctaggactggcggaagagaaaaaaatcccagctgcagccaatgggaggtaagcagggagaagtaacagaaaagacacactgaaaaaaatcacatccaggtgaaagacttcttgaggtagaacatggctaataaatttcttggatcactcacatgcaccatttaaatagtaattctgaagatgttaactacagttaaggaaatcagagcttaaggaagttaagtacaagtttatatacccaagtctcatttgaatacaaatccatctcaccccaaagcctgtgctgttatacatcccctaagtaattaaggccaaaactaggcttctaaaaaccatttccaaaataaagacagatttattcccaaagctgtttatcacatcaataaggcatcaaggaaagagaaactactttagaaataaatacaggaagcatacctacatatgaatgaattcaacattaaaaactatatttatgccaggcatggtggctcacgcctataatcccagcactttgggaggccaaggcgggtggatcacctaggctcgggagttcgagaccagcctgaccaacatggagaaaccccatctctactaaaaatacaaaattagccaggcgtggtggcacatgcctgtaatcccagctactagggaggctgaggagggagaatcgcttgaacccaggaggcggaggttgcggtgagccgagatcgcgccattgcactccagtctgggcaagaagagcaaaactccatctcaaaaaaaaaaaaaagcaatatttaatacagatcatgcttatcatacagccttgatggaaagaaattctaaggacacaaaccataaaggataaatgatctcaactatacagaagagaaacgaagtatcattggaaagaaagtgccaaaatgctatggtgtgtttgcattgggttgctgtgagttcaggaagttttaaaaaaatttctgtgtattgttttaaattaatttcccccatttttcaagtttcctaccttgaggaaaaacacattataaacaaaaacacttacctgaaacatggcaatatgcagctgaacccgctgcaggcttgtcttacaagaagaaatactggtttctagccttcgcaccaagtcatgcttcttccaggcagtgtcgtaagaacttgctaacacagttgccctgttcataaccagctgagagaacttccctatctggatgttatgttccaccgctttcttacagagatcatcaacagaaactttgctttcggcaccaaagtcctttgcctctacttgagcaatgatgtctacacccagagcactgataaaactgcacagtgtgagtccgagggcttggttgggtagccctatcaagagctgcctcacaaagtcagctgtgaatgccttgataggtttggccatttggtcttcactgaaacaagagtttctaaaaagggttttcacattgacaatctgtacaggcccattcacagtattctgatcttcaagtgaacttgatcctacaaaaaggaaaaatttcttgtatttcatgaaaaaaatcaggtaatatgctgcttatttatagtatttaaggtgtcatgaatgtataattaaattaagcctactctatcctgcccccttccatagtgctacatagctaaagctagtatgtttacaggtagaatattacctgacaatgttttagaaaaggtaccacagagcctgaagaactccttaatagtctgtagtctttttagaaagaaaatctcttctagcacctgccggtgattatcatcatcaaaaaaattaacttgagtactcctggcttcccttatgatgtcaatctttcgccaagctatgggaatttccatcttgttcaactatgtaaatgaaagaaaacaaagttcatttctccactcttgacacaactgaacaactactttatggcacttgcattatttttaaatccaagtccacatttaccttttcaactaataagctgaaagcagtttcaacttgagcaaacatgccatcgaatgctaccaaaagcatctggccagctgacattttgggtgtttcatcaactgaaccatttctcggttggattaattcaccgtactgagcatgtagtagtctacagaaaaacaaaaggagttaaaaccttcgctgaaaagtaatgcctttggtgggaacatacaaagtcagtacatctcacagctgcatgctgtgagagtctagaaagccttctggcattaagaagaagtgttattaggccgggcgcggtggctcacgcctgtaatccagcactttggcaggccgaggtgggcagatcacctgaggtcaggagttcaagaccagcctgaccaacatggagaaaccccgtctctactaaaaatacaaaaaaatcagccgagtgtgatggtgggcacctgtagtcccagctactcaggaggctgaggctaggagaatcgcttgaacctaggaggcggaggttgcctaggaggccaagatcgcgccattacactccagtctgggcaacaagagcgaaactccatctcaaaaaaaaagaaggaatgttatgatgataaaatggtatttcatgtcaaccacaataggatttcaatgattccaattcgttattaatgactgttatgtgattaaattttatgcaaacttcagtgatcagtctcatttttacacacaaaatatgaaataatttaaaatcctgtattgaaaaatgtcagaaatcacaccattctaaagctggcggacctagtaaattgtcaggtatgttcgcactattactacaagatacgatacaaccaagtatacttgctattttgggtatgcttggtttttatttatgcacattttgaatgtaaggtcttcagaaattcacccctcacattaccattaagacttacatagtgcttatgtatccaggcactatttcttatcacacacacacacagaaaccattccaaatggctggaactattaagaatttttaagagaattaaaaatgttaaactaccagataaatttctaatggaaaaagagctgtaagatggtatgagattttccttgagattacccaaaaaaagcttctctgaaacaaggcacagacaggctgccatagatccaggcacaaagtttgttacccaaagtacacatttaggtaaacattcctctgtatgaggataaggggaacccagataagatattaagagagataaaatgaagtctgaaattcagtgcaaaacaaagatgtacagatctagcatttaactttttaaatactgctaaaaattatatgataaagctgttctataaataatctaatatttatgctattaatgattatactttttctagccgggcatgggggcatacgtccatagtcccagctactagggaggctgagccaggagaatctcttgaacccgggagatggaggctgcagcgagccgagatcgcaccattgcactccagcctagcgacacagcaagactccatctcaaaaaaaaaaaaaaaaatacatatatatatatatatacacacacacgtacatatttatgaatatatatgaatatatttattattttatgaatataaccactccaaagaaacatgagaaacaggaaatttctgaatgcaggataattaacattaaggaattattgctacttttttcatgaaataatggcaccacagtcaagaaaaataagattacatatatatgtatactttctgcattattaatatttaagaatgaaaaaatatttgcttctaaataactagggtagtaaatttaaaccagactagcccagtgcagataattaccaaaggtggtggcagggggttcattagactattctctctacagtcttgtatctttgaaatttcccatgggaggaaacggtgctacaattcatttctactctctcaattatacttcttctgtgaattagacattggaacgccaaagaaaagaggccctgagtcactaggcacaaagaagcttagggattagctctgagtacaatgcatgtctgcaggaactgcccaaactctacagattccaaagtcagattgcttttctggactaatgagatgaaaaatacaatatccaattagctaaaacaaacttacaatatttaaactaatttaaaagtattcacctgaaatgaggtgtgtactctgttagctaaataaactgtttcaggtgtctccaaggggttctacaagatggcttaaaaatatcatgttcgactgtgtgtatgtacatgtacataactacaagcactaaaaggatatatgtatgtatgtgaccgaactatacacttgcacacacacacacacacacacacacacacacaaataagtgcatgtataactagtgaaatctgagtaagcggtgtggactatatcattgtcggtttcatagtgttactatagatactaacactgaaggaaggatgaagcatgcacaatacctgcctgcactttttttttaagcaacttctcgtgatgtataattatttcaaaataaaaaagttttaaaaagatacgtgtatgagcatttataagtaattatacctgctctaaaaactaaaagtaaacttacgttaaagagctcagaatccctttctctggctgtcccatctcttttacaaggaaacggcacagccagcattcacttgcctggcaacatcgatgtaatgagcatgtgtttcttcttccagtcccatagctgcgtttcttaagtaggcctgaagagattccactagagtctgcaggggaacgccatcggtggtctgctcaataagaccgtccagttcatgcagcatactttctaacgtgtattcccctttcattaaacatcgaagtgcttctggaaatatgatttgccggaaattcgaattcaattcctataaatatatgagaaaaaaacttttaatgttttttgagtttagctaagttacacatttggagacttagagccatacattaagagcaaacttatgtaactatgccatcaactcattcatgtaagtacatcttttgtttactttttatttctacttttaaatattttcttttcaaattctatttcatagtcatgtgaaatttttcaggaactatttcaaatgactttaaaaagttgtcatataattaaacattcctaggatgatgtaccttaagaacaaaaagaactgccctaaagtatgttatataatgttattaatttttaggaatcatatttctgtagtgatattagcattgttattctctttttggtttggttataagtggcttctatttcccttcaaaaaaaaaaagtcttatcaaggtataatttgcatataataaactgcatgtttaaaatatataatttgttatactttggtacttgcatacactcatgaaactgtcaccacaatcaagaaaatcagcataccgactaccctacaaatttcctcctgacttcttaatctctctcactcacacttctccataccacctcctccatctccaagtaaacactgatctgctttttctcatattatacactctccatttataggggtagaaatgtctagctttctttactcagcataattattgtaagtcatacatgtggctgtatgttatcaaggtgtcgttcacttttattgctaagaagtattccattatgtggatgtaccatatttgtccatttgcttgatgaacacttgacttgattccagtttttgactattacaaataaagctgctataaaaattcaaaaaaacaaagagcaactgtaaccaagttatagctataaatctcacaattatcttccttttaaatgactggttgagcaacattcaaatggggaagtcaaattgctttcctgggttaaagagatgagaaagacaatattcagtatctaaaacaaactaatatttaaaataaaagtgttcacctgaagtgaggtatacactccattggctaagtgaactgtctcagacgcttccatggggttcgggatatctaagtcctgtggcaccaggtggcactgcttcagtaactgaaccaagcaggtgacgtttccgctcatactgcagagttcctccaagaaccaggctccatcccgagaagtcagatcaaccagctgttctccagcacttgacgctgcaccttccatcatcaggttacgcctacaagagataaatatctgtacagtgaaacttaaatgtataaacaaaacaaggtaactggccgggtcaaggccatgcctgtaattccagcattttgggaggccgaggcaggtagatgacttcaggccaggagttcgagaccagcctgatcaatatggcaaaaccccatctctaccaaaaaatacaaaaattagccaggtgtggtggcacacacctgtagtcccagctattaaggaggctgaggttgctgtgagccgagatcgtgccactgcactccagcctcagtgtcaagagtgagaccctgtctcaaaacacaaccaagataactaaaatctgaaaagcaagtaagcagctgtaacacttggcaagactaaggaaagtaaaagaacattttaggtttgggattaaaaataagacacaggaaatggtccaatatgaagttggctaacttaccttgtaagggtacaaagggcagaaataataacacttgctagactcaaagatccttcttctccattctcatgaaggaaaactttaatgcaacgttcaatttctttcaactgatcttcacaaactggcacagtgacagcttcctgtttcaagcgttccacttgtctaataagtctgctgttgatgtctgctgcgtatcgctgcagggtcatttcagtggcagtgatgaactgacacactgttgggggtggctggggagcatattgcatttcatatctataaaaataaggaagaggtgcttgtttataacacaaccacccccaacatacaaaagaatattgcatttaatcctcaaacaaaacttgaagagtagaaatcattatttacattttacagataaaaatgtctcaagagcttaagcaatttcctaaaaggacttgttgatgactgtgacagaatcaacatttgaggccaggcaccacggctcatacctgtaatcctagcactttgggaggccaaggcaggaggatcgcttgagctcaggagttcgagaccagcctgggcaacacggcgaaactccatctctacaaaaaaatataaaaattgttcaggcgtggtgacacacgcccgtggtcccagctacttgggaggctgaagtgggaggatcacctgagcccagggaggtcaaggctgcagaatacaactttgcttccactcccaataagaaatacaattggccaggcgcagtggctcacgcctgtaatcccagaaatttgggaggcccaggcaggcagatcacgtggtcaggagttcaagaccagcctggccaatatagtgaaaccccgtctgtactaaaaagacaaaaattagccgggcttggtggtgttgtagtcccagctactctggaggctgaggcagaggaattgcttgaacctcagagacggaggttgcagtgagccaagatcatgccaccacactccagcctgggtgacagaacaagactccgtctcaaaaataaaagaaaattaagcactatcaacttacttcctatagagctcttgacaacgctctactgtggtgttacagatgagctcttccatccaggtcttccactgttcaattcgatgtttctgaaatatggccttcggatactgcagggccacggttgcatagtgatgcagttgctccagacagccacggagcacggagcgcctctgctgcaggagagcaccaacctccccctccagctgctcgcactggctaatcaagtgggcctgaccagcattctgcagaaaggctgttgctggcacgtaacttggaggaccttttggtaaaagacattattaaacacagtaaaacagggtcaagtcagctgtcactaaaagcaagcacaaaccaggaccccacacaaacacacatgactataaaactcatagtttcacatgtgaatctaaaataagtcaacccataccaaggtccatttgtgtgcttatctcttgaagcaagcttgcaagctgtgttgcttctaaattattgaatgcagcctgataatgtgttatccattgttcaaattcattcagcttcacctggattgcttcctgaacagctctttgctgagtctgtagttgggtgtgctcagaatacctaatcagggggacacaaacaaaatcaaaagatttattgctgttttcttccacatactttcctaccctggaatgtgctcacacatggactgtctggtacgctccttgttcaccttgagggccctcctcaaatgtcccttacttctctgtttttcctgaccctgtgattccctcaaccatgctcatgacattttaattaaaactgccacatctgccaagttttaggttccttgaaggttagagactgatgcttgacagatctttgtaatctgagagcctcacacaatgcttgacactttcatattcaactacccttttactgagcacctgctgtgtataaggttctttcagttaatcatcttatttaatacttagtgaggtagatgaagtagctgccattgtacaaatgagtaaggactcaagatacataatggtaatgagaaaaccaaaacccagattttctgattccaagttttgtgttctaaccactacacccacctatctcccataattagtcattcaaacatttaagttaaatataataaaagcagacaatttcagtgaatttttgtttactaacactttgaagttgcagtcactgagacagcttttatcatttatgtgatttgttacaataattctaatccatattgatgtttacatgaatatgaaaattctaattaatggcacatatttagaagaattcaacactgttttaaacctgtgttgcagagtatgagaaggatgatccaccccttcagctccttctagaaactctatttcctccagtagtttgccctgcagtttttccacatctgtcagttgctcttgcaagcttaggtattcatctaagctaccgtccaacttgggaagcacaaccagcatctcatctctattcttaaaccagttcacctgtaaaaagatattacgattaagaagactcttacagggccaattttgagacacaacagtgtcagaagaacattttgcacatcctacttaaatctctacaaaacccgaaaggggtgatgcgttgcctccactgtacaaaaacaactaatgcgttcaagtttacacaggcataaactgacaggctcaatctcataataccatgtattaatagttgccaatgtcacccagaacaagactggcatccctggctaccagatagggaagggaagctatccaattaaagaacatttacagtcatcactggtaaacacatttcaataattaagaaatataattttttcaaatcatgaacccacctcttaggagtgtggaatgtaactgtgcatgtttgtgtggaagaattacctaataaaaagttaacatcaaactgccatatttaactgccatttcaatattatacattagttttgccaaaaaaattagagaaacaatttgcctcaacattttgatgagcatgtttactctattaataaaaagaagacaatgacttattccgtcactgggcttcaccttaatctcagctactctagaagaaaacaggctgcgggtgatctctcgctccatctctctcttgctctgcttgctctcggcctgctggccacctccaccatagacagcaccagcaaacccagcctcgcctcctgctgtccagtccaccagagggtcgtacacaaaggcctccagcagcgtcagcagggtctctctgccacgccgcataatgtgtaaaacctgttttcaggagagtttttaaaataaggtctgccacaagtttcatcactaaagtgtggttttcattccacaggttttgctcatttaacaaatacactaaaagggagaagagaaaacagcatacctgctcacatgaaagcctaaatacaccttctactccagttacacccagtgctgtttcaatgttttgtgtcattcgaaaaggtactttctcaggaactctaaggcttttaccttgaaaagacaaatcattatatttttgccctttcaccaaaaaacatttggccctcataaatgtaaagtctacttttatattacctttttcaaagcaaacattgtaatctatgtgaacaacttctccagtcgtcatatctataagaacattatccagatgtctgtctccaaggccaattatgtatccaaccatagacatgactgcagtagatcttgcataagactaaaggaaaggaaatgggggcagcaagtgaaacaccattaagaaatttccctccaacatggacgtgatactataaaatttacaaagcaccattaacctactcccttattttaaaataaatcaacaaataaaaagcattcctcaaggttgctgcatgtggttatgcaggcatacaacactgtagacctgattggtcctagttaatcagctatcaggatgctggattaaaaaaaacacaaacaaacaaacttttcttcagtcttcctagtttgtccctttctaaattttttattcttttttttgttttgttttgtttgtatttttggttgaaacggggttcagtgttgcccaaaccaatgttgggcaggctggtctcaaactcccgacctcagatgatccacccaccacagcttccaaaagtgctgggattacagatgtgagccactgtgcctgacctctttctttttttaaatttaaatattgattttatttaaaaaaatttttttccttctaacttttaggtttagagggacatgtgtaggtctttacgtgagtaaattgtatgtcactggggtttgatgtacacattattctgtcacccaggtaatgaacatagtatccaacaggtattttttcctacctcaccctcctcctgccccccaccctcaagtaggccccagtgtctgttgttcccttctttgtgtccatgtgtgctcaatgtttagctcccacttataagtgagaacatgcggtattcagttttctgttcctgtgttaatttgcttaggatctccttttcatttcctccataactctttccccatcctgccctcggacacagtcatgttcatgcctttataactgtaatattaaactcaaatatacgtctcaaactaccaagtctggagggacagaggaaggaagggaaggaggacaaacaagataggcaagaaggtagcaggcaaaagaaatactactactgagtatagtctaaaacaaagcacatacctgcgtaactctccaccattcatcaggtgttgtgcaagatgaccagagctctttggcaaggagattcgggggtgtggcctccattaactcttccaatactgccttcattacatgaagaggccaatcccgacgggacacatccaggctaagcccaactgttttcaaagcagggccaattttactgtaataaagttcactaggacggggtacaattccaggattctgaggagtttggtaggaatcttgggccttaagaaaaaacaatttttttaaaaaagaaaagatcaattttatataaggaaaaagagtgccttttgtatgtaaagtagaatttttaaaaatgatttttcagtagcattctctcattactcaactaaatttcatgtattaatacaaaatagctaattattctggactatggatctttcttatgatatataccttttaattaggcccattcactttattgaaaaattggtctactgtttaattttcttgaggttcaattcaaaactaaacactcaagttactttcttctttataatacagaattcagttttaaaattatagttcataatttatgcacatacttcattcttcacacacaacttaatcgttaatataaaattaacaacagaaattcaaaaacacattacatgagaatttagatagcccttctctaattactatttgaaattacccttcaataacagttctgcagtctcctgtgcctaggtttaaaacttgcctcctttcaaactcatgctcttttcccctacctacccttatcaaaagcattttctttagctagatgtgggatcctgaagataagactgtataaaatttatctcaatatcctaagagcttagtactgttcctggcatatattaagcactcagatacatggctaaaatatattctaaattaaactcctagtctaaatcaaagcataaaattcatagatacaaaataggatgccatggtgattaattccaaatttaaagttgcttcttatttacatacataaaagaacctgggttttaaagcgattatttacaaatttaatttaaaagcatggtaaatccaataaaaacactaagatgtaaattatcaagttactgagtgatgaacaaccacacattccccctctccaaatttgtctcaagttaagataaacccaatgccatcacttttgcctcttatataactatttttggctgggtgtggtggctcatgcctgtaatcccaacacttaagaaggctgaggtgggaggaatacttgagcccaggagttcaaggctgcaatgagctatgatcataccactgcactctagcctggacaacagagcaagaccctgtccctttaaaaaacaaaaccaaaaaaaagcaaacaactttatttttataaaaggtacctcaaggccagatgcggtggctcatgcctgtaatcccagcattttgggaggctgaggcgggtggatcacctgaggccaggagttcgagaccaacctgagcaacatggcaaaatcccatctctactaaaaatacaaaaattacccaggtgtggttgtgcgccccccatagttcccgctactcgggagcctgtagcagaattgcttgaacctgggaggcagaagttgcagtgacccaaaaccacaccactgcactccagcatgggcgacagagcaagactgtgtctcaaaaaaaaaaaaaaaaaaaaagtacctcaaaaatactctcctagggacctcaagtcttttccttctttaactgcttataaacatgcaaaaatggtccagtaagtctacaagtatttcacataataacagagaatagactaatacactgtgtagatgatttaatcaaccttttgtgcttgtaaggcagcttcccgttgttgccatcgtttgtaaagaccaaataagggtgtggctccatctacccactggattagtcctgatcttgttcctagtggtgttacagaatagtgtcgagcatggaaccggggtgtttcttggcgattaattgtagcaaacatggtattcacaatagataggaactgcattattctctcatccagatgtaaatcctccagtcctatgaaaacaaaattaaaatagctaggataggtgattaaacagggttgggagcataccactcctctttttcaactagcagtggcagtcaaaaactgacagtccatgaggcacactgagagcattaaagaattctattttgggacaagatattggcagtagatattagcattattagctgtacctcacttgtcctgcttgtacaagttcatacacaaagtgggggtggaaaatctttctgcacggcatccaatcactgccgttcaaaagcacataagatatagggcactgcaggctaataatgacatacagaaattcgcctgaaataatctcctactatacacacccacactcacacaaagcattagtaagactaatactcttctgaaaaatggaggaagtcttaaatcctacctttgaaaagataaggatagctcttcccatctgatccaagaaagagaagtttctttggcttggttttagtcggtaagattgtgatggttccgcccacactatggattgtgacagtgtctctggctgagacttccccaggaagagcaatttcagtgttagtcatggcagccaaccatggactgatttcttcaagacgcaagatgtaacttgcacgtttctgtgctctctgttgcaaacttagcattatctatattcataagatgggagaaacaaatttacattacattagaacacttattttcttccacattcaatatggcataaaagtaaattttaggtcacggcggcagctcatgcctgtaatcccagcactttgggaggccgaggtaggcagatcacttgagttcagaagttcaagaccagcctgagcaacatggcaaaaccccatctctacaaagaatacaaaagttagtcaggcacagtggctcgtgcctgtagtcccagatacttgggaagctagggcaggagaagaggatcacctgagcccagggggcagaggttgcagagagccgagattacgccactacatgccagcctgtgtgagagagggagaccctgtctcaaaaacaacaacaaaactaaattttaaaatccacacaactatctgctgttcttatttctacatttaactcagtactgggatctgggccatcctggatgggttaacgctggtggccgatgtgcattacaggattctttgttaagactctttcttttcctctgtccaaacatgcagtgaaatcacaggagatagaaggaaaacactgctgtgatcatcacccaattaggggcttttagcaaactattaataattccccaatgttgagctatgtatgcacaacaccaaaacaatccagtccttgcaataggtacagctagcagtcggctgtcaggtcgacaaaactttaaaaagccacctgcaaagttattaaccttaaattacaagaaaaaatgaggctcaatctactcttatcaaactggagtagaggaaatttggtggatctctaagagacttaacaaaactgaagaaaagacaaagacaagtaagaacatttttaacagagaagtaaccatttaggtctgaccacttgaggtttgcagaaaagccctataatactttctaataatcacagggaacagactgtatgtacagttgtgttgctacatgcagcaaactcaataatatgcacccaaattaacaaattctggactccgcttccatgtgaaaaaatgtaaagcaatttttagcaagctctgttcataaaaagaaaaaaaccaattggaaacaccccaagtgcccaatgacaaaagaataaattgtggtattttcatataatagatcattgtttagctacacaaacacacacacaaaaattgatcaattattttaaaacttaataccaatccaatatggcagtaaaaagaagtagacgtacacacaatatgatctcattcgtagaagttcaaaaacaggcggaaactaaacagtgtcatttagaaatgcatctgtaaacaaaaactattttttaaagtagatagtgattaattaaaactcagaaaactggttgtgggtggggagataaaattagggagagaagtgggacttctataaagtttaatttctttaggtaattccttttttttgagctgtactatatctaaaagagagacacaggtattcttaatttttaaaattattctttaaatgtacaaaatcattttaaaaattttctatgattatacacacacacacacacacgtgcgcacacaaacagggtttacagggtttcctcctatatcctcttctgattttctaatttgatttactgaaagggaaacaaagaaacaagaaactggtcttagaacacaaggaaacgcaggccgggagcagtggctcacacctgtaatcccagcactttgggaggccgaggagggtggatcacttgaggccaggagttcgagaccagcctggccaacatggtgaaactccgtctctactaaaagtacaaaaattagccaagcatggtggtgtgtgcctgtaatcccagctacacgggaggctgaggcaggagaatcacttaaacccgggaggcagaggcagcagtgagccaagatcgtgccactcactccagcctgggcaacagagactccatctcaaaaaaaaacaaacaaaacaaacaaacaacaccccccccccccgcccacctacacacacacacacacacacacacacacacacacacacacacacacacggaaactcgagttttggcaagaacacataataaacttcatccttctctcacacacacacacggaaactcgagttttggcaagaacacataataaacttcatccttcatgttagttttctttcttgtacttctagctatttgctctgaatttagcaccttgcatttgctaaagttggctgtactttttgtttctacatgtatcttttaatagctttctcactgctcaaattcagtaaggaaatcagttaggagcaataaaggtaagagacagagaaaagagggagggagaaggaaaagctggagctacaaagtaataagctcccccaactaatggtgttatttgctagaaaagataaagacctaagagaatatagaattaagaaaaccaaaatataaaagataaggattctcaaatatgtgaatacactaatcatcccacgcagcatatgtggaattgattccagaactacttgtaaaactttatgttgttataagcgactattttatctgttagaaatactgaatgctctccttgtgaaaaactacataggcacaaagttaaatttcttatctttaatgaggtaaataaagcaggcaaccaatatttagctcagggtcacagccccttccttggctaatttcttcatctgttgttcactggtgtgagccttccatacatgaaagattgggcacctttgccgtccatccccctttgcccactgatttccaaattcttaaacagaaacacttttttctatgttccttataagcaactggccacaggctgcctcctataggcttataaaatctcttacattccaagtaagaagtccacttattgaaatttcgtatctcatgggaactgtgatgtgccatttcagtagcatgcttgggattattctgtacctctttaaatggaatccagctgctcccaggctttgcagggttcaatggagtcttcagtttttctagggcattttcaatggcatcaccatagttatcctgaaaccatttttcatgaggtgtttctgcaggagccgctgtgatactcctcacatgctccaaagcaaatacgatgggcttcatcaaagctgtgtgcttctccctcatgattgcaattttctcttctctgaccaagaagacatttttattcaaaaacttaaatgtgtacattaaagttttacacaaacatgcaacaatttcaatatatcaattgttaagtaaacagtaccaaggaataagtctaaataaagcaataacatattcacaaagtaaattactaacaaagaatttttggttttgtttttttttggagacagagttttgctctgtcaccagactggagtggagtggtacaatcttggctcactgcaacctccacctcccgggttcaagcaattcctctgcctcagcctcctgagtagctgcgactacacacgcgcgacaccacgcccagctaattttttgtattttagtagagatggggtttcaccatgttggccaggatggtctcgatctcctgacctcgtgatccgcccgcctcagcctcccaaagtgccagaattacaggtatgagtcaccgtgtccagccaagaattttttgttttttaaaaaaatgcagctcataaaagaggcagctcctcttttcaatgaactaaatgatacaaggaaaatgtgatatcaacatgcaaaagaatgaagcaataactcaaaatggatcaaagacctaaacttaaaagctagaactacaaaactcttagaagaaaacataagggaaaggtttcatgaccccagacttggcaatgattccttggatatggcaccaaaagcacagacaaattaaattgagctacatcaaaattaaaacttttgtaaatcaaaaaatactatacactatgaagagaatgaaaagacaacccacagaatggcagcaaatatttgcaaatcatgtatctgataagggttagtacccagaatacatagagaactcctacaattcaacaataaaaaaacaaaaaacccaattaaaaaatgggcaaaggacttgtaatgacatttctccaaagataggcaaatggccaataaacacatgaaaggaagctcaacatcactagtcattaggaaaatgcaaatcaaaaccacagtgagataccacttcgcatccatcacaacagctattatcaaaaaaagaaaagaaaagaagtgttgccaaggattaggagaaactggaaccctcatgcatggctaggaggattgtaaaatggtgcagccactgtggaaaagtttgttggctcctcagtaagtcagacgtagaattgccatattgccatacgattcagcaaatccactggatcatccacaaaatatacatgaaattcacaaaaaataatagaaagcagagagtcaaacagatactcatacaccaatgttcacagcagcactgttcacagagctaaaatgtagaagcaacccagctgtccataaacggatggacaaaacggtataatcatacagtattattcagcgataaaaaaatgaaattatatcacgttacaacataataaaccttcgggccattattctaagtataaaaagccaaacacaaaaagatggatagtttatgtttctacttctatgaggtagctaaaataggcaaattcataatagagatggcaagtagaatagaggtggccaggaactgaggtgagggggaaatgaagagataatttttaatgagtacagagcttcttctgcttaatataatgaataagttctggaaatggaccgtggtgatggttgtacaatatggtgaatgtatttaatgccactgaattgtacacttaaaaattaaaatagtaaattttatgttatttatactttgaaacaaagtggcagcttcactgtctcaggacaagtgtatggaaacatacttgcgtaaggtgttgttgttctggactctcttcacctcatcttcaagctgctgaattcgtctcaggacatacatgtgttgttgcagcaaaactcccagccagagctcatcccagagcacagtgaccctgcgcagttcagccacgagcatctgaacctgcatacacagcacacccaaatagctcatctacaagcctatgcacagcacagctcttcaaacactggactttgtaagttaagtgtgtgcaattggtgctcattatacaattggagaaccctgaccagtgattgtcaatacagattggcaaaagcaatttttattattctataaaaaattcttctacaacatgtgagtttctttgtacctgtaataccatggtggggtttgcagaggacagcttatctacaattttgctgtaacaatcctgcatcatggcttggtcttcatttaatccacttttaggttcatccttattgctatcctgagatgcaggaggacttcctccctcacattcagaaaccagcaattcttctccttgaatattgccaagtaaagttggaattgcagtggaaaatttatttcctgtaatgaaataggagaacaaggaatattttgaacatttctcccatgtgcatatgctaggttagggaaaacactgataatctatttgactcaagagcactcattgaactcatttgccttccaggcatagaactgattaaagattgtggatattctgcctttttataggttgagctttcatatttattaatattataagctaatggaagatacaaaggagaaagataatgagtgtttaacaaataatgtattcttcaagccagagttcaaaacttggtataatccttttttttttttttttggaaacagggtctagctctgttgcccaggttggagtacagtggcacaatctcggctcactgcaacctgtctcctgggttcaagtgattcttgtgcctcagcctcctgaatagctgggactacaggtgtgtgctaccatacccagctaatttaacagaaacagggtttcaccatgttgtccaggctggtctcaaactcctggcctcaaatgatccaccctcctcggcctcccaaagtgctggtattacaggtgcgagtcactgctcctggccaaaaattggtataattcttatccatcagtaacagctcagtgagcctggcagaggtactccatttctccacgtcttggtggattactgtcaaggctacagataatgtgtaaagcacatgtcctggtgccagatacatagtagttactccctcaataaatgctaattattactattaaaaaacctacagccgggcacggtggctcatacctgtaatcctatcactttgggaggccgaggcaagtggatcacgaggtcaggagttcaagaccagcctggccaagatggtgaaaccccgactctactgaaagtacaaaaattagctgggcgtggtggcacgcacatgtaatcccagctactcgggaagctgaggcagagaactgcttaaacctgggaggcagagactgcagtgagctgagatggtgccactgcactccagcctgggtgacagagtgagactccatctcaaaaaaaaaaaaaaaaaaaaaaaaaaaaaaaaaaaaaccctacaaactctaacaactctggaacataaagcttaaaaactttgacctcactaaaattattggcacagtcatttatactcaaagtagcaatatttgaatattccatacctgaagcctgggattcactactaagcgatatggtacccactattgcaggatacaatatgagatgtggggaatcttgagccacacggcagagaaggttacaaatactttggcgcacatacacttcagggtggtttaagcgtgagaaaagttgcggaataattccttcaggacaagaagagagaaagacactttaaagttatttaaaactatgaagaaactatcagcatcgtagatcaaacagataaaacgtgatgtgtgtcggcattagtacggattttaagagttcaaatttctccctgtgataataaagaaccatacacaatagttcttgattcgcaagtctggttaaggttggtttagatacagagctgtaatcaaagtccagggcagctcaaaaatgttacggagaaatgtatcttctgtgaatgcctacaaacaaggcaggcacagacaatttttacagagggtatataaaaccttttgaaaatttttcaccaccctctccaaaactcattttgtatataaaaagctcctgcctttcagcttcccatttcttggaaaggtgggaggaaaagtcctagtgatgtaacaagcagtgcagggtgtcctaggaagttaatctggctattctttttacacattcaaataataaacataaggaaaccactttttgaaatcttatatatcctagtgagaaactatttttcctgaaacattttatgcaggtctcacctctccatggtgcagtgggtgttgtctccaagccgtgctccagatactgccgaagctcaccagcatgcttcacgagcaaccgcagcaggcgcaatgtggccatcacaatcatgtcatcagtgctctgttccactctgtgacttaaatgcagcctagggtcatcctcatctaaaggaatctaagagtgaaagatgaggggaataaataagaaaataactcagaacactacttttgtttaataagaaaaagtttccaaaataaattttcttagaacactgtgctacatacttgaccagcgttgagtttaaggaaagtaaagtatgcactgcaagagagtttgtacaggctgaatattctatctacaactttcctccacactttaataactccttcagttgcactttcatcaagttctgaaagccatgggcagcttgatatcaactgacgccagataacatcaaccatgtcatcttcttcgttgtcttcactctcagttatctgaagtgttatatcttcatcctgaagaaaaattgtgcacaaaatgctattttaaatacaaactgaaaagggaaaaaggtatgtaatttgactatcataaaaaattcttctcatatataaaagataaaattatcccacatttagtgttatacacagtaagtcaatgtcagtatgcttctctttatgatatatttactaatatgaagccagtgaagaagaatataagcatttagcaaagactagacttttctggggtttcgttgtactttaaatgcttccaagttacaatacagtattctacctgcagaaatttttttttccttgtgacaaagtctcactctgtcacccaggctggagtgcaatggcacaatcatggctcactgcaacctctctgcctcccaggttcaagcaattctcatgcctcagcctcctaagtagctgagattacaggtgcccactaccacgccctgctgtttttttgtgtttttagtagagacaaggtttcaccatgttggccaggcttgtctcaaactcctgacctcaggtgatccgcctgcctcggcttctcaaagtgctggaattacaggtgtgagccaccgcacccagcctatgcctgcaaaaaaaataagcacaatctgctcaaaagtttgaagctgaatgtacacagaatacatatactaaacctcattctcttcacagtactgtgcatgtatcagacaccagcttagggagagacttagatacgctgctgtttacagcaagaactgatcgatatagcttagcttggcaaataaaatccatgcctttgaggactgcaactaaataatatattgctttggcattctagaattgacggaactctgaagggagagagtgtgaattatacagatcatctagtccattttcaacactggctgcacattagcatcacctagtaagtttaaatacacacacacacacacgcgcacgcgcacacacgtctcattcagagtatctgggagtaagtttcgtgcactggcatattttaaaagctcacaaccaaggattaagaacttacaatttctgataaaagtaattaaaaaataaatgtaatttacctaaaatgaacttcacttaataacttttttttcttttgagacagtctcactctgtcacccagactggagtgcagtagtgtgatctcactgcaacattcaagtggttcacctgcctcagcctcccgagtagctggcattacaggcatgcaccaccacaccctgctaatttttgtatttttagtagagatggggttttgccatgttggccaggctggtctcgaactcctgacctcaagcgatccacccacctcagcctcccaaagtgctgggattacaggtgtgagccaccgtgccaggccaactcacctatttttaacaggactctaaggaaatgccttattttctcaaaagtatattcttcttagaaaaatataactcactttcatcttaaaatgcagaagtttttatttacaacaacaattggtaagccccattcagtattttatcaaatatatatgatcaattttctcaaaatcaatgatttggagtagcaatcttgccccaagcaccatgttttccttgcctgaatccccgccggccgacacacagcctgtccaagaataccatatattctctctttctcttcctcagttatagtgtctggaagtagattctgaacttcagatttttctctaggcagcagacgaacaccttctccctgactataaaaataaacaagtcatcagtatttcagctacccaaactttaccatatcagcagacatttaaatatctatttatgcaatgcataaataaactacacatttaaacatacctggcattgtcaaccacctttctgccccacctataagcccagctggccaacgctgcccaagatttggctacttcaggtgcctgtactgaagacaggtgatacaactgtcccaaaatgaagtcaggttctccaactccaatatgcactgccaaaatggacaaaaaaataattataataaaagaactcaacaatgttacattcataaattcctaacgacatttccattagcattttaggtttttatctgcaagcaatcaaaagttccaaaatattactgtacataacttgagaaggcacaaatatgaattatgttctctaaaaggttggtatgttgaaatgaattcattagcttcccaagtaagattatattatctcctgtggaagacatcaatatctttcatgacactgaacattgtaaacagtcaggtgtcagctgtgctgtagaatgtcttgcattatgaatcggactggctatttcctcatgatcagattcactttaatcattctggcaaaaataataaataggtgatgagtatactgtttcattcatacagactcatgaggcaaacatctttattcccttgttaaaggtgaagacactgcctgctatagtgcatctgacaagatgaagatttataatgaccacaagacatatcctttatgaatatcaagactctatcaaaattattaacaccaatgtaagtaattaaactcttaggcttcagaacaacaaaatgaaggtatattctcatgtttcagcaaagaaaaccatctcccaaattttctctcaaattttaaaaacaggggaattatgccttccacaacaggcactcaaacatggacagaatcaactaccctatttgtaaggtatctttgtgttactagcactagcaccagaatgggaaacttgaatctttatatagtttctgtgttccaccaatcaataggaacacaggtaactattttaaatctttgttgctccttctattgtgaggtgaaattttttgatatgaggggcaggatcttattgccagcaaaaacatctaagtccataaaagcaaatacctgggggcagagttcagtgactcccaaaatggcattcgatcctaaatatgttttagttatttcccaacaataaaataaactcaacttccacagatatactttttatggaaaattatagccagcataacattataaactttaaaacagaaaaaaatatagcttctaaaattaatattctaaagctaataaagcaactctacctgtagattcactctcgatccgaggatactcttcttccatcgtattaacagatggcagttctattagagtgagtatgtttttagacaaagtagaaagacctgtgaagttctgttggtgctgagctctgtaaacctgtttcagctgtcctgaaatctctttccattctgcctggatccatttagccagtgtcagaattgatttagcaactgcatattcagct

SEQ ID NO: 720 - DNA, 129327 bp, Homo sapiens
aggttgtttaaaatttttatagagattgtaaatcagaactattttctatttgccctaaatatttagatgctacagggaaagcagatcaaattaaagggtactgtgcacatttttttactgggaactcccagggatataaatcatttcgcctgcagcatggaattcttcagtacacatgcttgtggaaacattccacgctccgccagcacgctcattaaagtgatgatttgggttgcaacaacagtgccaagtacttcctgtgttcaactggggaccatgtggcaagacccaaagcttccccagagatcctatgggaataagttttttgagccaccatattccattatttcagcctaaaataacaccatgggacaagaatcagaagacagaggagcagacaaatgtgtgtagacatgctggaaggaatctttctttttagaaacagggtcaatatctattaaactttaagatgtgtatctcttgacctggcagtttctgtatttgagttttaacctactgatatacccatgcatgtgaataaagtatcttcctgcatgtaacaggatatttaatgtaaccttgattatagttgcaaatgctgggaaacgatccaaatgtctttcaatatggcactgattaaataaattatggcacagtctcacaatgaaaaacaaatgtagccattaaacagaatgaaatgggtctagctaaattgaaataggactacctctaagatatgttgttaaaaagaaaaaaaagaaagtgcagaggaacaagtatgataccattttgtattttttaacatatgcaagcgtgattgtgcccacacagaatacctttgaaaataaactcagtatttgcctcagtggataaaaacaagaaccagccttattttcactgttatatcttttggtgccactttttgaactttttaccatatgtgcatatgtaactttctaaataaattttgtaaaaaagagaaatatggctcgttgcaataaatctaacaagataaaagatttgttgaagaaaataataaaactattcagacatgagcgttcttgaaaaatggagaaatacattatttccttgtatggtaaggaatggtaagtaagctgggtggtatggtaagctggatattgttcccgactcttcattccctctcttaacagaattatacatccttgcacctttgcaatcttcccactgtgagtggaacatacatcctgacccactgatatcagtcttgctaatgccaatagtgttagtaaatgtgatgcaagtcaaagctttatatgtgcctctgtggtctggtttggccccttgcacttctgccatccaccctgagaagtacaaatctttgggatccattggtcccagaataaaaagatacatagtgcagacccagaccaacccacagcctggagtcaagccgagccaacagagcccagcagaatcacagcctatgcacagacctgtgaaagaaaaaatatttttttgttgtaagcaagatttggggggatgcttgttatgcaaccttgttgtagcaatatctgacagatacatatgggaaaactacattatttcctttggctctattccacctccactaggaaaatattcctgattaacctcattccacaccagattgtgatctcttcaatgacaggaagtgtgtgttattcatccctgtgttcctagacttctgcacagggcctaacagaatttctagaaaacaaaaaattctgactactgtgcctaaagtagccatctctgcccaacagttaatctctgccacatcacagagtttatttagttcagaccatgcataacaatcaataatcatctttctattttgctatgtttccctcatacacagtgtaaacttcctagaagaaatgaatcaatgagtgggggaaaaatgaatatatgactttcttactctgatttgcataagtactcatacatttttgtctaccaccctcgccaaacttctcaggctgcctttcaaaagctggtcccaaatggttcccaatttgatcacccactgctccccttaggcatatgtagttattcaccattgcccacccattacccacactttttctttctctgcaacattagtgttatattccctatgtcatggatgctcttctttaccatccctgcttgtttaaatcctgaccatctgtattcttttgcaataggttcagctatgagtaactgcaaaactcaaaacaatgacctaagcaaaagtttattaatttctgttgtttagtaaatttagaagtaccagaatagaactggaaaggtaatcagtggttttagaggaacaagacactcccagcttattgctctgccaggagtgtcttccattcctaaacttacttcatgatccaagatggctgctggagctccagctattacatacccattccaggcaacataaaggaaaaaaagtggaagaagagcataccttctccctggaaggaaattccccagaaattacacacaccgtttttgtatgtagaaacttagtcacatggatacactcagctgcataggaaactgtactagctagttttgctaaatcacaaaccactattcggcagctttaaacaataagcattcatttagcacatgattctgcaggctggcaatgtgcgctgggtctatctgggcaaatgtagtgctcttgattgggcccatctcaggtaccagcagttagctgcctggttggtcgggtgctgactggtccttacctgggctgtctcctctccatgtggcatcccatcctcccaaaggctagctggggctggttcacatggtggttgggcaggattccaagagattgagtggaagtgtgcaagttatcttgagatataggctcggaactggcacactgtcacctccatcacactgtattagccaaagcaagtcacaagactggcctggattcaagggtggggaaatagactctaataggagaagctacaatgtcacattgcaaaggggtgtgcctatagagaggagaataattgtggccatttttgcaatcactatttcacagaactctagtcttaattctgagggacagcttgcattttctgtgacaccaacttttaaagcccagttcaaaatgaactttctcctccaggaagccttccttgactattgagctagaattctgaccaccaaatatttttacccatttgttctgtggcctttgcatagctacacatggagagacactgtcccatcagtgatggttcgggatgacagaaggtgagcccttcgccatcctcagaagccaccaagaacttagaccccatcttcaccaagatactaacatttctgttgaaacaagtgcccttatgatttaaaagtaatagaccccttgtttcaatggcaagagtatgaaattgttacttttgctttcagcaagcccacaagaggcacgaagaatccacgtgacccaaaagtaagaggtcaaatactgagatctggaaggaatcccttagcatccggagcctgaatagatatatacattcttcatcagagaagatgtcggaactagtccatgtgtacattggcatttttctttctccctttgtaatttttcctcctctcggtatgactgaaatataaatcagtagcctagagtccttctggttaacaaggttctcatttgggaggttgcagcctaggaggctattaaaaacagaaagaaaggcttcttctataaacatttcctgccagctgctgataactggggaggagggagagcacaggggtgacagcacaaaacaggacaattaggggaagaaatctgcaaaagaggaagaattcttggtccacgtccctggcagaaggatccatgaatagaagtccaaagtgcaaaagaaaacctctgggaagaaaggaggaggggcaggagagccttccactgatccaaacaggccagtgccatcggaagggagacaggaggacaaaatccctgcctgcagatgcttccaaatgtttaagacaaaataccaggacattaaaagttggaggaggggtggtcttggcatcttccctcaactcctacaagaataagagtttgcatttgttgagtgatcactgtgtgctggcccacattaatcatttttttaattttttaaaagttgtatatatttaggggatataggtgcagatttcttaaccgcatacatttcattatgatgagatctaggtttctactgtatccatcacccaaacagcgaacattgtacccaagaggtaatttttcaaccctcactcccctcctaccttcccaccttttgtagtctccagtgtctgttattttactctgtatgtctgtgtgtacccattgtttagctcccacttataaatgagcacatgcggtatttgacttcctgtttctgagttatttcacataggataatggccttcagttctatccatgttgctgcaaaagacatggtttcatttttatatgcattaattatctcaattaaggccataaggttggagctattattaaccccatcttcaccatgagcctggtgatgctcacaattttcccaaagccccttggttaataagtggaagaggtagagttcaaatcagtttctctgactgcataggccagactcctggacctctgcaccatcctggtctttgacaccatgatagagtaaaagaggagatgtttcagaacctaccatagaatcatctatcttcaagattacccatgggatgagactgttaatggacacagtgtctcattgaagagctcctgaactttgtgaagacagttgagtgtttacaaataagaatgaagcaacaacaacaataataaattgagtcattgtgttgtgttaggtactgtgctaactgtctagattctctcacttaatgcactgatgtaagaattattgtccccatttcacagatgagaaaatagaagctcagagaaggtaagtcacatggccaggatctcacagtcaaggagtagcagagttagaactcaaacccaggtgtgagaccaaagagcaggctctttgtttattgttctgaggtgcctccttaagtgggcaacttggtcactcattgcttcattcacccttcagatatagactactactcactgtgtttggaaaattttttaatttctaaaattgaggtgggggactagaaagaaacccattgcatttttgtttgactgagggacacaaaccttttatttgtaaaaaaatgtaataactgcaaagcacaataaagccaagtgcaataaaatgagatatacctgtaatcggtttttttataagctaatttcagaagtgacagcccatcaggacagccatattgcattcactacaagtgagtcagtaagtccagcccatgctaaggggagggtattacacaaaggcatgaataccaggagacagggatcactggggtccctcatagaggctgcctgccacattgtacctttcataagatcacaaatacctttcagtcatcctatcacctaatctcttaacatgcaacctgctttctcaatgaaaatcatggtgtaaattgagttctccatcattctcaagactatgaaatcaaggtagagccctggttttcaagctttttgatgacaaagatttcttcaaataaaatcttcctcaaggtgaatggacatactcattgttttgtactataaaacagaatacttctcaaggtgagaaaatagaaaaacatgactgatacacacaataaatagcacagatgaataaccaaagcattattctaagcaaaagaagccaggagcacatactgtatgatttcattcatatgaaactcctagaaagaaaaatctaatgtattgggatagaaagtagttcagtgggccaggcctggtgactcatgcctgtaatcccagaactttgggaggttgagccgggtggattgcttgaccccaggagttcgagaccagcctggacaacatggagaaaccccatctctttgaaaaatacaacaaattagccaggcatggtggtatgtgcctgtagtcccagctgctcaggaggctgaggtgggagaattgcttgagcccaggaggcagaggctgcagtgagcaaagaccatgccactgcactctagtctgggtaactgacagacacctcagggaggggaaggggaagaaggagaggaaggggaaggggaggttaagttcagtggttgcctggagttggggtcgagattaaggattaactgggaagaggagcaaggagccccacccaactcttacttaatccccactgttggaggtggggcctcctgggaggtattgggatcatgggggcggatctctcatgaatggtttagcactatccctttggtgctgttcttgtgatagtgagtgagtttacacgacacatgatcatttacaagtatgtggcacctccccacctactgatatgcctcctcccccttgccttccaccatgattacaagcttgaggcctccctagaagctgatgctggagctatgcttccagtacagcctgcagaaccgtaagccaaataaacctcttctcttataaattacccagtctcagctatttcattacagcaatgcaagaacagcctaatacatcatcacgaaagcttctttgcctaagacttgcagagatagatatgtcctatcaggccctcctcagcccaacctctaacacccacagaaaaccctgaaaagtgagaacccagtgaacatcctgaacatcctctgatggctgtgaaaagttagtgcacttctgctgttattgacacctgataactcattaaaaccagactaatcatcaacaagcagcaggtttctttcacactcaaagcataccagctccattctgaaatgatggctaaattaactgcagagaagcagccaataacctcctcctctcaccctgttcactctttgggctaataagtgtcttcttcatcagctgccttggataaaaaacaaatgactgggttatacattttcttgtacttgatacataagcctttctgcagaatatgataacaacgtaaataataaagatggccattgcttattgaatcatttactgtgtgttgtgtcttttgtacagcatataacactatatgctgtggcctctatatatgctagagttataaccctcaccctgagccgatttaactttatcaatatgaaaatggatacaaagaatgtaatctagtcacccaatgtcatgcagctaatgtggtgtctcaggtccctctattccaagccccaggtttagagtgagactaactggacctgaccgtcaggaaaaattaataaacaaataaggacttccctgctgagataccccaggataatttgtacaagtctccaaagcctagcacactgctggcacatagtaggtgctcaataaaatcttgtgatacgagaaaactggaactcctcatgcactgttttgtcggttacaaaatgtgaccccggacagagcatcatgatttgattagagtaagcggacttgttttcaactccacaggtagtcaaatggggagagtgggcatcagaaaatacataggtatatataagataatccatctttcaaaggaggctgaatggcagctcaaaggcatagagagaacctagggcaaggttatccaacctgtggcccaagacagctttgaatggggctcaacataaattcatcaactttcttagctcatcagctgtcgtcggtgttagcgtattctatgtgtggcccaagacaattcttcttcttccaatgtggcccaggaaagccaaaagactggacacctctgacctgggaaaaaagtacattttctccccagtgtcagaaagggatgtcataacaaaatattctaaaatcagaaaggaccaaaaaaaattgggtaactatccaaaatgaaataaattcatgaaattatgaaatattagtcatggtttgatttattctgcagctatataacatcactccatcaacaacacagaaacaaaaaattctctcaaaaatgaataatggatatgttcaatcaatcatggcataaccagggaatggaatgctttgaagctattaaaaaagtgtaattggccaggcgcaatggctcacgcctataatcccagcaacgtgggaggctgaggcacgtggatcacttgtgcctaggagttcgagaccagcctggccaacatggcaaaactctgtctctactaaaaatacaaaaagttagcgggcatggtggtacatgcctatggtctcagctactcaggagactgaaacgggaagatcacttgaacctgagaggcggaggttgcagtcagcgagattgcaccaccgcactccagcctgggcaacagagcaagaccttgtctaaaaaaaaaaaaagaaaaaaattaagtaaacaatgtaatcaacacatatttaaggagttttaataactaaatgaataaagtcagtaacaaaacagaagatgaagtataataccactttgcataagtataaactgataagaaaaataatctggaaggatgcggaatagagaaatgtacagttttttctagatggtcagcttatgggtgattttttaaattttaattggcatatctgtgttttgaatttttatatagtaaatgtgaattgattgctgaatttaaactaaataagggccgggcacagtggctcatgcctgtaatcctagcactttgggagaccgaggtggatggatctacaaggtcaagagatcaagaccatcctggccaacatggtgaaaacccatctctactaaaaatacaaaaattagccaggcgtggtggcgtgcacacgtagtcccagcttcttggaaggctgaggcaggataatcgctggaacccaggaggcagaggttgcagtgagtggagatcgcaccactgcactccaacctggcgaaagagtgagactccgtcttaaaaagaaaaaaaaaaaaaactaaataaaacccgttgtaatggtggtgtttaaacagagacctaaggagaagtcagtcagagcctaaaggggtcccaggaaaggaataaggaactggaaattcaaccaggcttggcaattagcaaaggatctgagacaatttaggtggaaattagaaacagctaaaaaatgaagaaggggctttttaagacctcacactactatggttcacaataatgcctctcaaaactctgtcataactatttttcaatatgtcaaagtaaatgtcatctctagttatctaaaaacatcttgatgcctgatacctactagaaaaaacagcccgagtttgtccacagttttcagttcctgtgtcatttcagttgcctggcgaggaacttttcttactatattggctctcaggtaactctctaactagaccattccatctccccaaaaactgtcatggaaaaagaacagtcttgaaagtcgagagaggcagcccagctctgctattcaggctgtgtgaccttgggcaagtctctccccatggtctcagtgggttgatctatggagcccaagcaataggattctctcccccaggaatttgaaacttggaatccgagattggaaagtgagacacattaatggtagaactcaagaaaggtaggggctgggggccgtggctcacacctctaatcccagaacttcgggaggccgaggtaggaggattgcttgaggccaagagctcaagaccagcttgggcaacagagcaagaccctgtctctacaaaaagcaaattaaaaattagccaggcatggtggcatagtggcattagctacttggaaggctgaggcagcaggattgcttgagcccaggaggtcaaggatacagagagctatgatggtgccactagattctggtctgggtgatggagtaaaaccgtgtctctaaaaaaatttttttaagagaggtagatcatgaattccatctgctgctaagcttccaaaactctattagtattttccttcctatgcaaactcctctctcattcagtgagagcacctgttatcctaacaatcacgaatttattttccttacattaatcagagtcagtttctattgcatggaaccaggcaacacttagctactgtggcttagatagaaggaagtccttcctgccagcatgaaaggaattggtcagtcaggcaaaggagtctgacccaaagggaaaagctgccacaaagagtgactttcatccttgggctaagaagcaggggcccaatggggcaacttgtcacattcaataaggattcttggtcagcccaaccatgctctccaagcatccaggcatgaatccccacagggcaaggcagcagagaggagcaacagtgagcatgatgggttatctattctcccagctccccacagcccactgactgcactcagctgagtgcaggcaccaacttcttgcatctgagtttttgcagctgctgttggaatctctctaacacagagcttctcaactgggaaccattttgctccccaaggagcatctgacaatgtctgtggacatttttggtgatcacaaattgggaatgggggctggaaagggtggctcatgcctgtaatcccagcactttgggaggccaaggcaggtggatcacttgaggtcaggagtttgagaccagcctggccaacatggcgaaattgcatctctacaaaaaatacaaaaattagtttggcagccaagatggccaaataggaacagctctggtctatagctcccagcatgagtgttgcagaagataggtgatttctgcatttccatctgaggtaccgggttcatctcactagggagtgccagacagtggatgcacgacagtgggtgcagcacaccgtgtgtgacccaaagcagggtgaggcattgcctcacacgggaagtgcaagggatcatggagttccctttcctagtcaaagaaaggggtgacacatggcacctggaaaatcgggtcactcccaccctaatactgcacttttccaatgggcttaaaaaacggcgcaccaggagattatatcccacacatggctcggagggtcctacgcccacagagtctcgctgattgctagcacagcagtctgagatcaaactgcaaggcagcagtgaggctgggggaggggcacccaccattgtccaggcttgcttaggtaaacaaagcagctgggaagctccaactgggtggagcccaccacagctcaaggaggcctgcctgcctctctaggctccacctctgggggcagggcacagacaaacaaaaagacagcagtaacctctgcagacttaaatgcccctgtctgacagctttgaagagagcagtggttctcccagcacgcagctggagatctgagaatgggcagactgcctcctcaagtaggtccctgacccctgacccccgagcaccctaactgggaggcaccccccaatagggccagactgacacctcacacagccaggtactcctctgagacaaaacttccagaggaacaatcagacagcagcattcgcagttcacgaaaatccgctgttctgcagccaccgctgctgatacccaggcaaacagggtctggagtggacctctagcaaactccaacagacctgcagctgagggtcctgtctgttagaaggaaagctaacaaacagaaaggacatccacaccaaaaacccatctgtacatcaccatcatcaaagaccaaaagtagataaaatcacaaagatggggaaaaaacagagcagaaaaactggaaactctaaaaacagagtgcctctcctcctccaaaggaatgcagttcctcaccagcaacagaacaaagcttgacggagaatgactttgacgagttgagagaagaaggcttcagacgatcaaactactccgagctacaggaggaaattcaaagcaaaggcaaaaaagttaaacactttgaaaaaaatttagacgaatgtataactagaatcaccaatagagagaagtgcttaaaggagctgatggagctgaaagccaaggctcgagaactacgtgaagaatgcagaagcctcaggagccaatgcgatcgactggaagaaagggtatcagtgatggaagatgaaatgaatgaaatgaagcgagaagggaagtttagagaaaaaggaataaaaagaaacgaacaaagcctccaagaaatatgggactatgtgaaaagaccaaatctacatctgattggtgtacctgaaagtgacagggagaatggaactaagttggaaaacactctgcaggatattatccaggagaacttccccaatctagcaaggcaggccaacattcagattcaggaaatacagagaatgccacaaagatactcctcgagaagagcaactccaagacacataattgttagatacaccaaagttgaaatgaaggaaaaaatgttaagggcagccagagagaaaggtcgagttacccacaaagggaagcccatcagactaacagctgatctcttggcagaaactctacaagccagaagagagtgggggccaatattcaacattcttaaagaaaagaattttcaacccagaatttcatatccagacaaactacgcttcataagtgaaggagaaataaaatactttacagacaagcaaatgctgagagattttgtcaccaccaggcctgccctaaaagagctcctgaagcactaaacatggaaaggaataaccggtaccagccactgcaaaatcatgccaaactgtaaagaccatcgaggctaggaagaaactgcatcaactaatgagcaaaataaccagctaacatcataatgataggatcaaattcacacataacaatattaactttaaatgtaaatgcactaaatgctacaagtaaaagacacagactggcaaattggataaagagtcaagacccatcagtgtgctgtattcaggaaaccatctcacatgcagagacacacataggctcaaaataaaaggacggaggaagatctaacaagcaaacggaaaacaaaaaaaggcaggggttgcaatcctagtctctgataaaacagactttaaaccaacaaagatcaaaagagacaaagaaggccattacataatggtcaagggatcaattcaacaagaacagctaactatcctaaatatatatgcacccaatacaggagcacccagattcataaagcaagtcctgagtgatctacaaagagacttagactcccacacaataataatgggagactttaacacccactgtcaacattagacagatcaacgagacagaaagtcaacaaggatacccaggaattgaactcagctctgcaccaagcggacctaatagacatctacagaactctccaccccaaatcaacagaatatacatttttttcagcaccacaccacacctattccaaaattgaccacatagttggaagtaaagctctcctcagcaaatgtaaaagaacagaaattataacaaactgtctctcagaccacagtgcaatcaaactagaactgaagattaagaaactcactcaaaatcgctcaactacatggaaactgaacaacctgctcctgaatgactactgggtacataacaaaatgaaggcagaaataaagatgttctttgaaaccaacgagaacaaagacaccacataccagaatctctgggacacattcaaagcagtgtgtagagggaaatttatagcactaaatgcccacaagagaaagcaggaaagatccaaaattgacaccctaacatcacaattaaaagaactagaaaagcaagagcaaacacattcaaaagctagcagaagacaagaaataactaaaatcagagcagaactgaaggaaatagagacacaaaaaacccttcaaaaaattaatgaatccaggagctggttttttgaaaggatcaacaaaattgatagaccactagcaagactaataaagaagaaaagagagaagaatcaaatagatgcaataaaaaatgataaagggaatatcaccaccgatcccacagaaatacaaactaccatcagagaacactacaaacacctctacacaaataaactagaaaatctagaagaaatggataaattcctcgacacatacaccctccaaagactaaaccaggaagaagttgaatatctgaatagaccaataacaggctctgaaattgtggcaataatcaataccttaccaaccaaaaagagtccaggaccagagggattcacagccgaattctaccagaggtacaaggaggaactggtaccattccttctgaaactattccaatcaatagaaaaagagggaatcctccctaactcattttatgaggccagcatcatcctgataccaaaacctggcagagacacaaccaaaaaagagaattttagaccaatatccttgatgaacattgatgcaaaaattctcaataaaatactggcaaacagaatccagcagcacatcaaaaagcttatccaccatgatcaagtgggcttcatccctgggatgcaaggctggttcaatatacgcaaatcaataaatggaatccagcatataaacagaaccaaagacaaaaaccacatgattatctcaacagatgcagaaaaagcctttgacaaaattcaacaacccttcatgctaaaaactctcaataaattaggtattgatgggacgtatctcaaagtaataagagctatctatgacaaacccacagccagtatcatactgaatggtcaaaaactggaagcattccctttgaaaacgggcacaagacagggatgccctctctcaccactcctattcaacataatgttggaagttctggccagggcaattaggcaggagaaggaaataaagggtattcaattaggaaaagaggaagtcaaattgtctctgtttgcagacgacatgattgtgtatctagaaaaccccattgtctcagcccaaaatctccttaagctgataagcaacttcagcaaagtctcgggatacaaaatcaatgtacaaaaatcacaagcattcttatacaccaataacagacaaacagagagccaaatcatgagtgaactcccattcacaattgcttcaaagagaataaaatacctaggaatccaacttacaagggacgtgaaggacctcttcaaggagaactacaaaccactgctcaatgaaataaaagaggatacaaagaaatggaagaacattccatgctcatgggtaggaagaatcaatatcgtgaaaatggccatactgcccaaggtaatttgtagattcaatgccatacccatcaagctaccaatgactttcttcacagaattggaaaaaactactttaaagttcatatggaaccaaaaaagagcccgcattgccaagtcaatcctaagccaaaacaaagctggaggcatcatgctacctgacttcaaactatactacaaggctacagtaaccaaaacagcatggtactgggaccaaaacagagatatagatcaatggaacagaacagagccctcagaaataatgccgcatatctacaaccatctgatctttgacaaacctgagaaaaacaagcaatggggaaaggattccctatttaatacatggtgctgggaaaactggctagccatatgtagaaagctgaaactggatcccttccttacaccttatacaaaaattaattcaagatggattaaagacttcaacgttagacctaaaaccataaaaaccctagaaggaaacctaggcattaccattcaggacataggcatgggaaaggacttcatgtctaaaacaccaaaagcaatggcaacaaaagccaaaattgacaaatgggatctaattaaactaaagagcttctgcacagcaaaagaaactaccatcagaatgaacaggcaacctacaacatgggagaaaatttttgcaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaaaacacatgaaaaaatgctcaccatcactggccatcagagaaatgcaaatcaaaaccacaatgagataccatctcacaccagttagaatggcaatcattgaaaagtcaggaaacaacaggtgctggagaggatgtggagaaataggaacacttttaactgttggtgggactgtaaactagttcaaccattgtggaagtcagtgtggcgattcctcagggatctagaactagaaataccatttgacccagccatcccattactgggtatatacccaaaggactataaatcatgctgttataaagacacatgcacacgtatgtttattgcggcactattcacaatagcaaagacttggaaccaacccaaatgtccaataatgatagactggattaagaaaatgtggcacatatacaccatggaatactatgcagccataaaaaatgatgagttcatgtcctttgtagggacatggatgaaattggaaatcatcattctcagtaaactatcgcaagaacaaaaaaccaaacaccacatattctcacttacaggtgggaattgaacaataagaacatatggacacaggaaggggaacatcacactctggggactgttgtggggtggggggaggggggagggatagcattaggagatatacctaatgctaaatgacgagttaatgggtgcagcacaccagcatggcacatgtatacatatgtaactaacctgcacattgtgcacatgtaccctaaaacttaaagtataataataataaaataaaaaataaaaattaaaaaaaatacaaaaattagccaggagtggtggtgggcacctgtaatcccagctacttgggagattgaggcaggagaattgcttgaactcgggaagcagaagttgcaatgggccgagaccacgccactgcactccagcctgggtgacagagggagactccatctcaaaaaaaaaaaaaaagaaaagaaaagaaaaaaagggggggtggggggaatgcggtgttactggcatccagtaggtagagaccaggtgtaaccatttcttattgtaactgtaaaaacttgccatgaatttagtggtttcatttttatttttttattttgagacagggtcttgccctgtcacccaggctgtagtgcagtggcaccatcatagctcactgtagccatgacctcctaggctcaggccatcctcccatcttagcctcctgagttgctacaactacagggcatgccaccatacccagctaattgttattttttggagagatggggcccaggctagtctctaactcctaggctcatgcaatactcctgcctcagcctcccaaagcactgggatcacaggcatgagccaccacacccagccaattaagtggttttaaacaactcaaatttgttcttataattctagaggtcagaagacaaaaatgagtccacagggctgcatgtcttctggaggctctaggggagaatctattccccacctttcccagcttctagaggttgcctgcattccttggctcatggctccttcctccatcttcaaagcaacagggtaacatcttctcttcccactcttattctatcatcatgtcacatcatcttctaaggacccttgcaattacctgagtctcacctgaataactcagaataatctcctcatctcaagatttttcattccaatcacatctgcgagagttttctcttgctttgttttcgtttggattttgccatcttaatgtaatgtattcacagattctaggagttgagatatgaacatctttgaggagagggggcattgttctgtctaccacaccaggtagacatcctgcagcccgcacaacaaaggatcatccagcttaaaatgtcaggagtacagaggttgagaagcctgcatgctctgatactaccagatttcccacagaccctaattcaatgccactgcttaatgtgcatgacaactgcagaccccctattccttgataccatccatccaaaacactccctacaatgttttttaaatatgtgtgagtgttattgagtccaagtaagtgacagaaatcctgtttccctaaaaagtttgataacaggaaaaaacagtcatttattaggcttgacatgattcttgtgacttctaagtttggggcttcaggtgtttgaaagttactcagaagccaggcacggtggctcacacctgtaatcccagcactttgggaggccaaggtgggcggatcacttgaggtcaggagttcgataccagcctgaccaacatgttgaaaccctgtctctactcaaaaaatacaaaaatcagctgggagtggtggtgcacgcctgtagtcccagctactagggaggctgaggcaggagactagcttgaacctgggaggcggagcttgcagtgagcctagaccatgccactgcactccagcctgggcaacagagcaagactctgtctcaaaaaaaaaaaaaaattttttttactcagaagggaaaaaatgaactcctcaaactttgggacagaaaatgggaagtaaaagcagagaaaagctatcaccaacccggtgcctcatacctgcccattttctgcttccacttcctgggagtaaaagtctttaggaagggaaggtgaattagtattgattatacatgcaccaaaagacaaacaccaggctgtatgccttacgtatgtgactcttccaggttggtgtcatcattcccacgttaacataagtggtaaagtgaatggagacaccaaagaggtgtaatataacttctttaatgaaataaaccaggaggcagcaaacgttttctgtaaaccatcagttagtaaatatttgaggctcttttgaccatgtgggctctgttgcaatcacttaactctgcccttgtagggccaaagcaatcattgatgctatgtaaatgaacgggtgtatgaggctgttccaataaaactttatttacaaaaataggcagagaccagatttggccctggagctatagtttgctgccccctgaaatacatttttttaattcccaaaatagccttcatcagcaaatatttcccaagcacctactatatgtcgatatacaactgaacagcccagaaactacaaagatgaataaagaagccaataaaagtccaggtgcagtggctcactcctgtaatcccagcactttgggagaccaaggcagtggatcacctgaggtcaggagttcgagaccagcctgtccaatgcagtgaaaccccatctctactaaaattacaaaaatcagccaggcatggtggcgggtgcctgtaatcccagctactcaggaggctgaggcaggagaatcgcttgaacccaggagacagaagtcgcagtgagcctagatcacaccgctgcactccagccggggtgacagagcaagactccatctcaattaaaaaaaaaaaaaagccaattaaaaataaaacagttcaaatgccaccacccagaaataaccactataaacatttggtatttatcatgaatgatttttttaaactctatgaacatatattttcaagacaaaaataagatgattgcatacataatttttatgacctaatttcaaaataaatccaagactgctttctctgtcaccaactgtaaatgtagatttaacatttaatatttcatgactatgcaacgatttgcatgtagcaggatttgctgagtgacctccctattgatagacagtgagactgtctcctttttatcaccaatagcatttacccagtttcctcctccgcccccttctcctcccactcccaacctcccgccctctttctggcataccttacattgctcgtgggaatataagtcagcacaatcttcctaaaaacagtttaacaatgtgacccagaaattctaggtctaagacaagagggcaaagatagagatgtaaagatgttcttggtagcattgcttagaatggtggaagagggaggatagtctcactgtccatccacaaggagtcatttcacaaaccctgctacatgtaaatcattgccatagttaaatgttaaatctacatttacagttagtaacagagaaagaagtcttggatatattttgaaatcaggtcagaaaaattatgtgtacaataatcttatttttatcttaaaaatatgtgcttatggagttttttattaaaaaaattcatgataataccaagtgtttatggtggttacttctgggtagtggaatttgaacttttactggcttcttagtctttgtagcttctgtgctgttcagttctacactgacacataggaggtgctggggaaatatttgccgataaggtgaacacaacactccagcatcaggggtttcatgtggctataaggaaggtatttctaccatgatgcttggcaaacacaggaaaggatcattaaagtcgcatctggaatccccttttctgaaggtgtttttttaaagaatagaattatcttatgatcttgaaatgacaaaggtttttcttagtatgtcacaaacccgggagacccccccgcaaaaaaaaatttgattacatagaagttttttaaaaaacagagctgcggaaccaaaaccaccctaagcaaagtcaaaatacaaaagaaaacccaggaaataatgtttgtgaagcaaggcgtggaaaatggctaattcccctaatgtataaaatcaataagcaaaagagcagattcatagaaaaatggacaaaagataagaacagtttgtaagaaaagaaacacaagtgattcttgggcaaatgaaaacatgctctgtgttattcagagtaagataaatgcaaattaaaactatgctgagatatcaattttcacctatcagattggcaaaattaaaaagaactcaataatacatggtgcttgatgccactatgggaactcaaacattccttgagggatgggtgtaaattttttacaacctctatggagaaaagtgtgtcatttgacccaactattacacttttagaaatttatcccacagacatttgcacaggagcaaattgcaccggtatcagattatcgattatagtttttttaaataatagcagaagagtagaaataacccaaacatccatcagtaggaggttgcttaaacaaattatagggtactacatggtgtactctgccactcagaaaagaaaataagaaagttaactgtgtactcataaggaaggatctccaagatatgtatttaagagaaaggtgaaaaaagcaaataacggagaagcatttttcatattaaaaaataaaaggagatgatatgtgaatatcatatatatactatatatagtgtggatatgtatatacataaactatacacactatatatacacatatacatatacacactatatatagtatatatgtgtgtatatatacacatatacatatacacactatatgtagtatatatatacacatatacatatacacactatatgtagtatatatatacacatatacacactatatatagtatatatacatatacacactatatatagtgtatatatgtatatacaccatacacacatacattttgcttatgtatgcacaggatatttctagaagaataccaaagaaattggttcatttgttgcttcagggatagaggtagggggaaggtggtaaatggaaaaagggagacatttcactgtttatccttttgtattttttggaatttggaccatgcaaaagtattacctattcaaaacattaatgggtcaggcatggtggctcacacttgtaatcccagcactttgggaggctgaggcaggcagatcacttgaggccaggagtttgagaaaccctatctctattaagaatacaaaattattggggcatggtggtgcatacctgtaatcccagctactcaggaggctgaagtacgagaattgcttgaacctgggaggcagaggttgcagtgagctgagactgtgccactgcattccagcctgggcaacagactgagactctgtctcgaagagggaaaacaacaaaaaaaaaaccattaacagaggatccttcctacttcagagcttcctatacactgtttccactgctggaggtgttctgatgttgactgacttacacacacacacacactcctcctggaagtattttatctttcagatctctgttcaaatgttacttcctccaggaagtcttacctatcacctccacctcctccgcagaaagggagctgttatacccattcatggtaccttgtgagatttatcacaatgggtatcaattaataattaacatctgtcttccttgctggaggtaccagagggactagtctgccaatgaaccccaggcaccaagtccagcatatgccacataagacacgcatctcagagactttcttctgttggaagggagggaagaaaataggaagaaataaccacagttacactcctagcatgagccagacagtggtctatgcgctttatgcagattagcacattaaattctcacaagagagttgtgattcttgcacagatgaaaaaaacaggctcagagagaccaagcaacctgcccaagatccccaggcagaggcatgattcaaaccaggcaggctggttccagagcctatgctcttggctcctagaagggaaaacagaagaaagggaagaagaggagagagggaagaagagaggaggttgctcacaatatcaggaggatgcatttttctgctgtctccagttcagtatctcacaagaccagcaagccttccagtctgggaagttataagaacatcattgtattactccattttcatactgctgtaaagaactgcctgagaccgtgtaatttataaaggaaagaggtttaactgacttacagttcagcatggctggggaggcctcaggaaacttacaattgtggcagaaagtgaagaggaaaacaatgcatcttcttcacaaggcagcaggaaggagaaatgccaagcaaagagggaagcgttccttataaaaccatcagatctcgtgagaacgcactgtcatgaaaacagcgtgggggaaactgcccccatgatttaattatctccacctggtctctcccttgacatgtggggattatagggaatgtaattcaagatgagatttgggtggggacacaaagcctaatcatatcaaccattaatggggattctgtaatgtatatgaaacacttgcagactgacactactggacctcaacaaagagacagcagacttgaagtatgacagctgtcttatctagaggagcaggtaacatgcattgtagataaatacactatctgatgtgggttaataggcttcattgaattaatgatgacagaataattacagcgacaagcaacagcagcagggactctaattgaggataattcaagcacacggcaagatcggaagttttgactttaggactatggaaacttccctgagattggagatttattatttctattattttaaatcaacaatatccaccactggcaaggtgcagtgtctcacacctataatcccagcacgttgggaggctgaggtgggcagatcacttgaagtcaggagttcaagacgagcctagtctgtttagtaaagatggttaaaccttgtctctactaaaaatacaaaaattagctgggtgtggtggcatctgcttgtaatcccagctactcgggaggctgagtcaggagaatcacttgaacctgggaggcggagtttgcagtgggctgagatcatgccactgcactccagcctgggtgactgagcaagactccatctcaaaaaacaaaaacaaaacagtatccatatctaccatagcatgtctgagctctctgcaagtcaatgggaagttatccacaggacaggatttccttacttttatttgttaataagagaaatggaagggaatgggaaatcagaaaagcagaggcataccaatttttgccatttctcctcacatagaatttgttcctcatcttaaaggcttggacaggatgctgaaaagtataagagaatggggattacattcaggtaatcacaacagcaataataatagttatcatttattgaacctttacctccaaacagcatctaaagtaagcactatttataccttagcccactgaattcccaaactaattttgtagagtgggaacaaatgtgtttgcccattttatgggtaagacaactgaggctctgagaagtaaagtgatttgcctaagctaggaaaatgcagaagttaagaaatgaaagcattagaataatacccaagaaggggtcatttctgaaggaggagatggattcatgaacaaacaagcaggcaggccaatatgtaatttgttgataagcatgaatatatttaattaaataaggatctactggatacctgtcacaagcccagtgcaaggtccttgtggcagatggtttttttccaaaggtggccatagtgatatctcccataccacatgctgtcataatgtgaccttttatttctcttgttgagtgatgaagtccatgatccctccccttttaaccttagaaactgcctcaatcattaagattacagcagaaaatatgctatttgatttccagggctagaacataaaaagcatatgcacttcctccttgttttcttgagctactcgctgttggaccccagctactatgttgtgaggaagtccagttagcccacctgaagagaccacctagggaggccacatgcagacgttttggctaactggctagctgaggtctcagctaacagtgagtatgaaatacaggcatgtgacagaagattcctctagatgcctttagtccccagccatcaagtcaccctcaacttttgagttttcccagctgggtccccagacatcatgaggcagagcaagccactctctctggtctgattcttgacctacaggatctgtgagtgtaataaaattgtggcttatagcactaaaaattggtgtgatttgttacccagtaatagcaactggaagagccctcatatatttttaatacaaaaaaaaagtgtgtgaaacaggacctgcccttctgtttaatttggaaaacaagacttctataacaatgttatttacaaaatgtatcttataatagccaaaaggtggaaataatccaaatgtctgtaaacagataaataaacaaaatggggtctatccatacaatggaaagttatttagccataaaaagaaatgaagtactgatatattctacgacagaaatgtagaaattagaaattagaaaacactgtgtttcgtgaaagaaccaagacacaaaaggccacatattgtatgactccatgtgtatcaaatactcagaatgggcaaatccacagagacagaaagtaaattagtggttgccagaggctgggggacaggagtgaaagagtggctgcttaatggtagaggtctggggttggagggtgatgaaaacatcctagaattagacagtggtgatagttgaaaaatcttgagaatacactaagaccactaaattatacacttttaaatggtgagttttataagacatgaattatatcccaatgtaaaaaaaagcaatgtgccatattaggaccttctgtgagggtggaaactcatcagctttggggtcaagtagatctgggttgttgtccagggactaccagtgcctaattgtatggacttgagcaagtttctcagtacccaagggctcagattatccatctgtgaaatgggaataataagactcactttgcaaggctgctgtcaggattaatgattgtctttatcaaagatggtaacagaaactcactcgagcagcataagccaaaataagcattttatgaaaggaatcagggacattttacagaagcccaggtcactaagaacaatttggccacataagaaacttgaaccaggaatttaaaatatatcaaaagccaaggttgatattctttctggcgtatatgtagtgaacagagaaatttctttcaaattattcattcgtggaaaatcaagatttggcattgcattttaaagttaatccattagagtcacttagttatttgcaaaataacattttggtaaaggagaatttatttgaatatcaaataagaaaaggttcaataccctacctggtagagctggaaaacagttaatgatcacaggcttggaacacaaaatcaacctcctgtaacaaatttagtttatgactttaaaaggaaaaatggacttttctacaataaacattcaaacaaacatggttcaaacaaacatggtttccaataataaatgtttttaaatctcaaggtcataataaatcagtcctgggactcttaaagcaaacttttttatagtataggaaagtgctttcctattttataatcaaaattagaaggaaactagactctatgttgacaagagacaaacttacacatagactttaagttaattctttagggtagttgccttaatagccattgaccttctttattagtctgaaggagtgattctcagctctagctacacattgaaatcactgagtacctttttaaaaataccaatgtcaccggccgggcccagtggctcacatctgcaatcccagcactttgggaggccaaggcgggtggatcacttgagcccaggaattcaagaccaacctgggcaacatagtgagactctgtctctccaaaaaattcaaaaaattagccaggcatggtggcacatgcttgtagtcccagctacttgggaggctgaggacaggtggttgtaagcttctatttctcatgttgagtgatgaagtctatgatcccttccacttgaaccttagcaactgcctcaatcattaagattaagattacagcagaaaagatgctatttgacttccagggctagagcataaaaaatcataggcatgtcctccttgctttctggagccactcactcttgcacaccagccaccatgtagtgaggaagtccaactagcccatgtgaagagaacacctggggaggccacatgcatacattttggctaactggctggctgaggtcccagctaacggtgagtattagaaggatcgcatgagcctgggaggtcgaggctgcagcgagccgtgttcgtgccactgcactccagcctgggcaacagagtgaccctgtctcaaaacataaaattaaattaaaaacaaataaaatactaatgtcctgatcccactcaaaaagtctgatttaatccgtatgaagtagggcctggcacgtttgacgaacaagcaaggaggcaggaatggctgcagcggagtaagcaatggcgagagggacgggagatgaggccattgaggctagggcaggtgtgtcctggcatgccaacgtgagggcttgggattttcatctaaagaaatggggagccatcacggggaccacttggctaaagtagcaaaaaaccaactcaaatcagtccaagaaaagtgggaagttattggcttttctaagtctagatagagctgatttaaagctcaacattatattatgtctctctctttctctcccccacttcaatgtccctctccctctccctctcaatgactttccatcttttggctcgttctccctatagacgagatttctcctcatggtataggagacagcccctggcagtccctgactcacttctttcagccccattattcaaaagccaagaccctgtctctcacagctctgtattaaagaacaaaaaacattctgaataggtgattggcttagctaaggtcacgtgcccatagctggaccaatccacatggccaggatattggggaactctgattggcctggtcacttgcccagtccttctacgggagtgagggagaaggcaggatgctgggactggaaattatcaggactgatgtgggtaaaagaaagtgaggccgggtgcagtggcttacgtctgtaatcccagcattttggaaggctgaggtgggtggattatctgaggtcaggggttcgagaccagcctgaccaacatggtgaaaccccatctctgctaaaaatacaaaattagctgggtgtggtagcacacacctgtagtcccagctacttgggaggctaaggcaggataatcgcttgaacccgggaggtggaggtttcagtaagccgagattgcgccactgcactccagcctgggcaacaagagtgaaactccgtctcaaaagaaaagaaaagaagagagagagggagagagagagagagagagagaaagaaagagagaaagaaagagaaagcgagaaagaaagagagagagagagagaaagaaagaaagaaagaaagaaagaaagaaagaaggaaagaaagaaagaaagagaaagaaaaagaatagaaaagagagaggagatgctcaacagtcaaaacaatccaggtttacggcatggtggtgtaaaattctactcttgctttgcccatttgattcacccatgtgtgtgatgggccgtagaggaatagtaacattttttttctttattcttatccctctactaactcgggcagaccagatagaacacttagagctccatagaaccttctcttcctctctcttctctcttcttttctcctttcttcactccttctctctctcaccccagtttattctcctgtctttgaatattgcctttctgagctaaaagaagaactaccatcaacccagcaatcccattactgggtgtatacccagacgaatataaagcattttaccataaagacacatacacgtgaatggtcactgcagcactgttcacgatagcaaagacatggaatcaacctaaatgcctgtcaatgacagactggataaagaaaatgtggtacatatacaccatggaatattatgcagccataaaaaagaacaagatcatggcttttgtgggaacatggatggagctggagcctatcatcctcagcaaactaacgcaggaacagaaaaccaaacaccacatgttcttacatataagtgggagctaaatgataagagcttacgaacagaaagaaggaaataacagacactggagtctacttgagtggggagggtgggaggaggaagaggagcagaaaagataactattggggactgagcttaatacctgggtgatgtaatgatatgtacaacaaacctctgtgacaaatctttatgtaacaaactttcacatgtatcctcaaacctaaaataaaaaaaaaatttaataataaaaaattaagaattaaaaaagatcacctttctctacttttctgcttttctttccaacaaacattcaaacaaatatggtttcctataacatttttttaacctcaaggttctaagtcaacagagcagaaagtggtcactcaaggacgcttgacatcacttcccagtctacatatccaaccctgaatgacaaatattggtgtccaatttcaaaattccaggagaaataatacaattgtcctggcttggttcagggaaccaaggtcccaaggtcttacggtccaccgtttttttcatcacaggtacaaaggcaaactctgataaactaagcagagaaacatatagttctattgaatcattggtagtcaatagcataccaactgctggccagataccaggctaaaagttttttcatgcttttttttttttttttttttttttgagacagagtcttgctctgtcgctcaggctagagtgcagtggcgcgatctcggctcactgcaatctccgcctcccaggttcaagcgattctcctgcctcagcctcctgagtagctgggattacaggcatgcaccaccacacctggctaatttttttatttttagtagagatggggtttaaccatgttggtcaggctggtctcaaactcctgacctcagataatccacccacctcggcctcccaaagtgctgggattacaggtgtgagccaccgcacccggcctcatgcattatttcattggtgcatcataattgccctataagttaggcactattattacccccattttacagatgagggagtcgaggctagggtggtcaagtgaacttgctcaaggtcacacaactaaaatgattttctgaataaagagcacttgttcttttttttaagagacagggtctcgctatgttgcccaggctggtctcgaactctcggactcaagcaatactcctgcctcggcttcccaaagtgctgggtttactggcgtgagccaccacgcctgacctcaagatcatttgttcttaaccaccatactctactgccacttaccacaccatggtgctgtgattatccccgcaaaagataggaggctaatgtaataaatgctctcaattgtgtgaacacactggactaccttactttacatgagaaaagtactggaaggagcaaatccaaagctagtgataaagaggaaagcagcccctgacagcagggaactggcctggtactgacaggtcaatctcggtgttttcctaaacataaacaatttcacagagcatcaatgttagacaaagccactctgtagtcatgatgaatcaggacagaaagaagactccgtaatcacacgtgaacacagacaaaacaggaacattgttcaagccacaaaatgccaaacatgaccttctcctggtgaatgcgagtaactagtgttcttcaccaatcatagttttagcctcgctctagtctgctttccctcccttccttatagataaaatttattgagagagtcaatggtaacattgcctctttcaggctgcacccatgccagtgcacatcccagcttgcttggactctccccaaaatcacacaaccaaagtccaattccataatgagtcctttccaacaccttccatggttccccatgtgtgtgtcctctcttgctgcaatgaacatgaaacacaacttgttcaatatgggtgtgttcctggaggtctttggctggagggcatcaatactgttcacttgtcaggggcctgttctgacagactcaagactgctctctctcccttgaccaaagagcttgaaaaccagtccttggtcctagaaggcagcgcaatgcaaacagaattccagtaaccagagacatccactaaacctcccctccacacatacacacataaggaaagtagagagggccatttctgcatcttgctctacagcagagtgaccccaacaccatagaatggatggaacccagtgagatgcacccaaggtgccacaccgcgttcctgcttgaagttgctccaattctttcccaaccccaaagttcttctctgtcactctgagctatacaattgtaggcccataacagttggacagctgagaaaaaaactcaaggctcaatttcatgcttcctgtaagactgtggtgaagttcaagttttccataaatgtaacaaaccttcacagattgaaaaggaaatggtttcccttatcctcttgtcctcaatctagttgcatgggactgactcagcatctcacgggggtgaaaatcaaggatcagtgtttcttaaagcacccccgagtgactctcctgtgcagccagggttgagaatcactactctagtcattcaactgatcgttgctgggcacgcactgggttccatgaactgtgttgtatgctggagacgctctggcaaataacacagatgcaattcctgtccttgagactctacactctagggggagagaaaagcaacaaataaacaaagaaacgtctaattatacattgtggtaagtgcaataaagaaaatttacagtgtgttagggtagagaacaacaggcagaactctttaggtaagaaaggaattaaaagcttcactaaaggggtgaaatgaggctgagagtggaggaataagagggaatgagcattgaggaagggaagtaagactgttctagaggctggttgtggtggctcatgcctgtaatcccagcactttgggaagccaaggtaggaggatctcctgagcccaggaatttgagaccagcccgagcaacatagcaagaccctgtctctacaaaaaaagttagctgggaggccgaggcaggtggatcacgaggtcaggagatggataccatcctggctaatatggtgaaacccatctctactaaaaatacaaaaaattagccaggcgtagtggcacatgcctgtagtcccagctactcaggaggctgacgcaggagaatagcttgaacccaggaggcagaggttacagtgagcagagatcacgccactgcactccagcctgggcaacaaagcaagactccgtctcaaaaaaaaaaaaaaaaaattagctgggagtggtggcacatgcctgtagtcctagctcgtcaggaggctgaggtaggagaatcacttgagcccagggaggttgaggctgcagtgagctatgatcacgtcactgcactccagcgtgagtgacagagtaagactctgtctcaaaacaagaagaaaaaaatgttctaggcagaaaaaaaacacacatgcaaaggccctaagatggaagagtatttgcaaagaagtgaaaggaggctgccatggcttaggtgagccaggagcaagtggcaggcatctgcttcctcgagctgccacacaaagtgccgctggcagggtggcttaaagtgactgaaatgtattttcttgcagttcaaaggctagaagttgaagatcaaggtgtcagcagggttggttccttctgagggctgtgagacaaggatctgttctgggctgctctctttggtttgtagaatgctgacttttccctatgtcttcacgtggtctgccttctgcttgtgtcggtgtatgcctttcttataaggatgccagtcatatcggattaaggcccagtcaaatgaaatcattttaacataagtacctccacagaggccctaactctaaagaaggtaggatttggaaggaaacaatgagggttaggacttagaatttggagggggttagggtgagggatacataattcagcccacagcatcatagtagggggatttggaacttatttaaagtggaataggattggagggttttaaatgagatggcatgtctgatttaaatgaatgctctgggccaggtgcagtggctcatgcctgtaaccccagcactttgggaggccaaggtgggtggatcacttgaggccaggagttcgagaccagcctaaccaacatggtgaaaccctgtctccactaaatatacaaaaattagctgggtgtggtggcacacacctgtaatcccagctactaaggaggctggggcatgagaatagtttgaacctgggaggcggaggttgcagtgggctgagatcacaccactgcactccagcctgggtgacagagcaaatgctctggctattgtgttggtagcagattggaggaaaacaagagtgggagggtgagacctctgagcgagttacttatgttcagatagcagtcctgtcctttacttgttatgtgaccctgggcacattacttgacctttctgagactcggtctccccgtctgtaaaattggaataattataatacctcacacacacatttgttgagagaattaatgaatcatccgtgtttagtatatactaactgcaaatgctagataaatgttaaatattattatattttagccatcttaggaagagacagcagtgcccgtgataggcagcctctaagtggcttccaaccctctcattctcgtatttatgcccttgtggaacctcctccctagagtgtgggctgaacctgatgacttgcttctaaggaatagaactggcaaaagtggtgagatgtcacttccaagatcaggttatcatattaggcagctcaggctgccaaaacaaaatatcacagactgggagattaaacaacaggcacttattttctcacagttctggagggtagaagtccaagatcaaggtaggacagcagggttggtttctggtgagggctctcttcctgccttgcagacggccaccttctcactgtgttctcacatggtctttcctatcatgtttcttcctcttcttgtaaggacacaggtcctatcagattagggccccacccttataacctggcttattttaagtatctctgaaagggccctgtctccaaatacaggcacattgggagtgagaacttcaacatgtggatttgggagattgggagagggctgcaattctgtccataaccgttaaaaaaaaaaaaaaaaaaaaaaaaaacctgtgagttctgtcttctttctctatgtagatatagacatatagatagataaaggcagagatagagatattttctcacaagcttgctttgatggaacaagcttccctgttgtcagggagaaccatctagcaggaaacagggcagcttctggccagcagccagcaatgaaaggaggccctcagcccaacaactctcaaggaactgaattctgccaatgaccacatgagcctggaagcagagcctctccaagttgaatcttgagataactgcagccttgtgggcaccgtgattgcagcctgtgagagcctctgagtagaggtcccagttaagctgtacctggatgcctgacccctagaaactgcgtgttgttttaagctactaagtttttgggtgctttgttatgccataatcaaaaacaaatacattagctagacatggtggcatgcacctgtagtcccagctatttgggaagctgaggaaggagaatcacttgagtccaggagttcagggtaagcctggacagcaaagtgagaccccatctctattgaaaagaaagagagaggaaaggtaggcagggaggcacaaagggaggggaggggaggggagggaagggaagggaagggaagggaagggaagggaagggaagggaaggggagaaaaaattttaaaaagtgagtaattcgcccaaattcacacagtaaatggcagagccaagaaaaataaaataaaaaaatgataacaggtcaggcatgttggctctcgcctgtagctccagtacttcgggaggccaaggaaggaggatctcttgtgcccaaaagttcgagaccaacctgggcaacatagggagatctccatgtctacaaaaaattttaaaaattagcaaggcatggtggcatgcacctgtagtcccggctacttgggaggctgaagtgggaggatcgcttgagcctgggaggtcaaggttgcaatgagctatgattatgccacttgcactccagcctgggcaacagagcgggacactgtctcaaatgaagaaaaaaaaagaaaaaaaatgatgataataatattaaggaaagacaaaaacaaagaatcctaccaagtctcttggattccagaaccaatgttaaaaaaatcatgaaaccaaagtaaactactgctatcctgaaacaatgataaataatccacagatcataaaaccagggactctggagcatgtacattaatataattgtatgtcccttagactgaagttctatcaaagcttaatgaccaaacaaattagctattggcattattttgcctccactaaaacctaagcagtagcagaagtacagatccacaattctaaaaacttcatcatgcgggctccttttataatagcaggtggttgtgattttcttgtttctcgtttccttttctctatcctttgggggagccatctgtaagtgtttggtttcaagtttcaaaaacaatctccatgaccttgaacaatgggttaaaagggttgtccacatgtgaactgaaaaaggaacaagttatagaaaaacattccaggccgggcatggtggctcacgcctgtaatcccagcactttgggaggctgaggcgggtggatcacccgaggtcaggagttcgagaccagcctggccaacgtggtgaaacccccgcctctactaaaaatacaaaaaattagctggacatggtggtgggtgcctgtaatcctagctactaggagggctgagacaggggaatcacttgaacccgggaggcggaggttgcagtgagctgagatcgcaccattgccctccggcctgggtgacaagagggaaactctgtctcagaaaaaaacaaaaacaaacaacaaaaaagaaaaaacaaagaacattccaaaagaaatttcttctgaccattttcttaggaaacatcagtgctgcaaattaatccttccatccaaagtcctgtcttctaacattttacatctgtatatgtgctttacatagttgttgaattgctctcatattcagtatgtcttggtatttcaatgcctccatttccttctctataaaaaaattttaaaaaagaagcaataaagtgcttattccagtacctgggctgcttgaatgatagcactgttgttaatcatattcaacattcattcattcaacaaacacctaggtagcagcatgagagccagttttctatcaattcatggtcctaaaatggaggatccagaatttccatgtatagcagcagcaacctagctagaaatagaagacaaggctgtcatctggaagtggtgatggggaagggcagctgacagatgcttaagaaggcttaaaccatcctgctgctgctgttgcttggtcttttcagaaaaggaaagcattggttgggtgccctggcttacatttgtaatcccaacacttcaagaggccgaggcaggaggatccactgaggccagagttcgagatcagcctgagcaaaatagtaaaaccttgggtctaaaaaaaaattttttttttcttaaattagccaggtatggtagaatgtacctatagtcccagctactccagaggctgaggtcagaggatcacttgagcctaggagttcaaggctgcagtatggtggaatcatgccagtgcactccagcctgggtgacagtgcaagactaaaaaatagaaggaaaaaagtaaagacaagcactgttaccaccattcgattgataagaaatttgaggctcgcatagctccagcgacttctcaaaattacaagactaggggccgggtgtggtggctcatgcttgtaatcccagcactttaggaggccaaggcaggtggatcacaaggtcaggagatcgagaccatcctggctaacacagtgaaaccccgtctctgctaaaaaaaatacaaaaaattagccgggcatggtggcatgcagctgtagtcccagctactcgggaggctgaggcaggagaatcgcttgaacccgggaggcagaggttgcagtgagttgagatcacgccactgcactccagcctgggtggcagagcaagactccgtctcagaaaaagaaaaaagaaaaaacaaattacaagactaggatatggaaaatcagaccccctagaaggcactgagctgccttggggcagagactttgctcgaagggtttaacactctatctccaaggcatagacacagtgcccaacacacagcaggtcttaggcaggttctgcaggagcaaagcctgaaacagggacttatgccctgctttattgagggagtgttcttgttaccggaaaggggtcccaatctagaccccaagagagcattcttggatctcatgcaagaaagaattcagggcgagtccacagagtaaagtaaaagcaagtttatttaaaaagaaaaggaataaaagaatggctgctccatgggcagagcagccccaagggctgctagttggctatttttatggttatttcttaatcatatgctaaaccagggatggattattcatgagtttgctaggaaaggggccaggaattcctggaactgagggttcctcttcctcttagagcatatagggtaatttctggacgttgccatggcatttgtaaactgtcatggcactagtgggagtgtcttttagcatgctaatgcattataattagcatataattagcagcaaggataacaagaggtcactatcgtcaccatgttggtttgggtgggttttgactggcttctttattgaatcccgttttatcagcagggtcttttatttatttatttttgagacagagtctcactctgtcgcccgggctggagtgcagtggcatgatctctgctcactgcaacctccgcctccctcgttcaagtgattctcttgcctcagcctcccaaagagctgggattacaggcgctcgccaccacgcccagctgatttttgtatttttagtagagatggggtttcaccatgttggtcacgctagtattgaactagctggtcttgacctgctgacctcaggtgatacacccacctcagcctcccaaagtgctgggattacaggtggaagccgcagcgcccggccatcggcagggtctttatgacttgtatcttgtcctgctgacctccaacctcttcctgtgactaaggatacctaacttcctgggaatgcggcccagcaaatctcagcttcatttcacccagctcatattaagatggagtcactctcgtttgaatacttctgacaccctcaggagaaagagagtgagggaagtgagatagaaaaggaaagtatatagattcagcaggagcctattctcagaccaactccacaaggagctctggggcatgaagccatcacagaattatccagcctgtatcaaggggccagctttacatatggcctctccattggcagggggctgcccctggggagggtgcaaaatgtaacctcccaggcattcctcagcaccatcagctgagcacaattccctggcagctgccttagactcctaagtgggatccaggtgggaaaccaatcgtatccgggacaatgctcaataaatatttgttggatgaatgactcataactagaacacaattctctactctctctatatcttttctctatacccaagagaggactttcaacccacaaacattttacagtcatcatctctaattcagagaccttgcccagcacaactaaacagcctggcaagagtcacatctgaccgtgtttaattaccactttggaggaggaaggacacgctgttgaggttttaagctacagactaatactttcacccatcatccaaggccaccacaaattaacagttgcattgggtttttgtctgacggctggacaaagccaattcatgtcaagggacctgagacataacataaaaagtcccctagaattttatctcctggagagagtatttgcttctcacattcttgtaccgcccctgggcggagaactcagcctagggactaatatacctttcacagaaaatcggtgttaaagcgggaatgtgtagtacaatcattcctggcaagagaaatcaagccaggtctttccaccttttttcttttaattacacccattctccattcagctctcaaatgtcctgccattctggtagagctgctagcagccctcatctaccactactctgttcttgctcttcatctcacaaacaaaagcagcccatatgagggaaagagaatttggcaagagaagggttacaatgtgatcctttccaaaaaaggagagatccatcccctctccaccctgctgccagagtgagctcctgctaatatgctaatattaacatcctgtttaaaacccttcaatctttggacaacatgtgcaatctttcatagggctcacaaggtttgatgtaggagggtttgcacctgctctccctccagccacattgactttctttcagttcctccagcctgccacaggatctttgcatatgctgaatgcactcacctccagctacttcttcagatcagagcttaaatgttatatcttgagctccctgtcccactcagatctgctctggttgtcacagcacattttcttcacggcacgtcacagttactatcgttttatgtgggtgttctccagcgcaggtgcaccagaagaaagctcttagtttgatgattatcaaatagctagctctacttctcagttagttcctggcatggagggaataaaggatacactctctcattttagagatgaggaaattgagctggataggaaacaatatttatctgaggtcacatggtttgttggttaattggctgatttttttaaagacaagattagctattttctcctgaaatattcaacccttttgcaaacatcctgtgttaccacctcagctctaaggactgctgtcttcctgatttactgctggccagggaagagtgtcctggaactcagtgaagaaccacatagaaacctcataaggaggtggggcgtggtggctcacgcctgtaatcccagcactttaggaggctgaggcaggtggatcacatgaggtcaggagctcgagactagcctggccaacatggcgaaaccccgtctctactaaaaatacaaaaaaattagccggcatgatggcgtgcgcctgtagtcccagctacttgggaggcagtggcacgagaatcgcttgaacctgggtggcaaaggttgcagtgagccgagatcacgccactgcactccagcctgggcgacacagcgagactccatctcagttaaaaaaaaagaagaaagaaagaaaaagaaacctccataagagctctgtagaccttgctgttttcatcaccaatctcttctagaagtgccttcttcaaactcctgaaactatcaaatttcccatccacgctctcccccggcatcacctcaaagcttatctttaaatcatataaaataaaacaatttatcaacatcatattaatgcctagcctttattcagcactgactgtaatgtgccaagccccatgctgagcatgttacacatcttaatccatgagctcctgtgctcaccaaggcaggccgggcagaggccattctctgggggaaggggagggcacagcatcctccctgaggtgacacagctgctgagtggcagctcctggctttacacccagcttggtctgacgtgaaagtccatggactaccccatcatgttactctgaggtgatcagttccagactgggacagagtcctttatcctctcagccacaggacttggtccccggctccatgaccgtcttccagaatgtacatgggccttcatgagccaagacatctgcatagagcaagcatcaaactagtatacaggaaatggggcaatgcaaagtctgacagactccatgtccttgttgaatatctctccacattgacacaaaatcacataaagagaatgtgttctgtgccaggcacggtggcttgcgcctgtaatctggcactttggaaggccgaggcaggcggatcacttgaggtcaggagtttgagaccagcctggccaacatggtgaaacccagtgtctactaaaaatacaaaaattagttgggcatagtggtgggcacttgtaatcccagctactcgggaggctgagccaggagaatggcatgaaccagggaggcagaggttgcagtgagccaagatcacaccactgcactccagcctgggcaacagagtgagactccatctcaaaaaaaaaaaacaaaaacaaaaaaacaaaaaaaaagatgagttccactgcttgtgattgtagatgattttgttctttgcttcttgtgtttttcagtttccgataatgcacatattaactttttttaaatgaaggttatttaaaaagaaaagaaaatgagccccaaacaaagggtacacatggacatatagagcggaataatagactagacactggagactccaaaaggtaggagagcgggaggggaatgagaagtgaaaaattacctattggatacaatgttcactattcgggtgatgtttaccctaaaatcccagaataggcatgtaagaaatcttcgcttgtaccccctaaatctataattttttttttttttgagacagtctcactctgttgcccaggctggagtgcagtggtacgacctcggctcactgcaacctctgcctcccgggttccagcgattctcctggctcagcctcccgagtagctgggattacaggcacctgccaccacgcccagctaatttttgtatttttggcagagacagggtttcactatgttggccagaatggtctaaaactcctgacctcaggtgatctgcccatctcggccttataaaacatttttaaatatatttttaaaaaagaaaatgagctccctctgtaaccagcactccaatcatcaaaaacagttggctttttgactgcctggcatacaatccagcttctcctttccatggcagtgcccattttcttttttgaagcttaaaaaaatatataatgggtgcagtggctcatgcctgtaatcccaacactttgggaggcagaggcgagtggatcacgtgaggtaggagttcgagaccagcctggccaacatggtgaaaccccctctctactaaaaatacaacaattcgccgggcacagtggcacaggcctgtaatcccagctactctggaggctgaggcatgagaatagcttgaacctgggaggcagaggttgcagtgagccaagatcatgccattgcactccagcccggccaacaagagtgaaacttcgtctcaaaaaaaaaaaattagctgggcatgtcagctcgggaggctgacgtgggaggattgcttgagcccaggagttcgaggttgcagtgcgccatgattgcaccccagaattccagcctggatgacagagtgaaaccctgcctcaaaaaaaaaaaaattcaaaacaaaagacaaaaacaaaaatcaaaatgcagatttggattctgtaggtccctgagggggacctgagcctctgcttttcttatgagctcccaggctggtgctgatgctgctggcccaggcactacactttgagtagcaagtgtctagcaaggcatacagtggttccagggctctctaagcacaaaagccgctcgtgcatcaccctcacagggccaggcccccatgcaggacagatgctgctttgggtcagtttgctcagaacatctgggccttcctacaatcacaagtcaccccctgtctccccactcagatggcaagaggtgttcccaggggcacagaaggaaacatactgtcactcagggccaccccagatgctccctcagcctcagatcgagtcagtctgagaccccctgagccaagttgctcccattcacccctccttgtccaatgcccaacccctgtgcactgagcctcctctcaaaataaactcacagagccccccacccccactttccattgcacctgaggcaattattacttgtcaaaaacaagaactgccagctgtgcgtagcattcagcttgctgttcttaaaatcccttataatcatttccctcggagaagaattctccagccccacaatggttctgcacagccaatcacagtgtagtcccggacccgtgttttgataagacaatctgacactgtcagtcagagggattcaagactcttgctgcagggaggagggagagaggaagaaaagaggagagagagagagagaaagcgtatgcctcttctccctctggaagtgcagctgactgcagagtctcccaggagcctgtccctgcagaggccttgacaaatgtcaacagacaggacgagatttctgcctctccaatacctgtaggccccatcccaccccagctatactcacactcatttcttgtttgtttgtcttcaagctccattcagagagaatggagatgtcttcttggtctaaattaaagttgaagcccggctgggtgcggtggctcatgcctgtaatctcaaaactttgggaggctgaggtgggcagatcacaaggtcaggagatcgagaccatcctggctaacacggtgaaaccccatctctattaaaaatacaaaaaattagcccaacatggtgtggcgggcgcctgtagtcccagctactcgggaggctgaggcaggagaatcccttgatctcgggaggtggaagttgcagtgagccgagatcacaccactgcactgcagcctgggtgacagagtgagactctgtctcaaaaacaaacaaacaaacaaaaaaaaaagttgaagccaagagggaaaagttggagggcacttggaggaacagggaggccctctatggcccaacctgcaagatggtcccaattattcttgcctccaggtattcatccccttgtgtggcatcccccaccatgcacagaccagggctagtctgcatcatgaatagaatagggttgtgcttgctctctccctctctctctctctctctctctctctctctctctctctcgggaaccagctgccatgttgcagagacattcaggccatcaatggcgaggttcgcatggggaggcacagcccccatgtgaaggaacttcggagcagagtctcctctggttgagtcccagtgtgacagcagctctagccaacagcctgacttgcagcctcatgagagatcctgagtcagaaccacccagctaagctgctcctgggttcctgacccgtagaagctgtgagataataggtatttattgttttcagctactgcatttggggtaactttttacacaacaatagatgatgaatacactatcccaaatcaatccacaaatttggtgtccccacaagtgtggggtgtgtctttcaattttttgagacagggtctcgctctgtcacacagactggagtgtagtggcacagttacagctcactgaaacctcaacttcctgggctcaagcaatcttcccacctcaccctccccagtagctgggaccacagatttgcaccaccgcagctggctgattttttaatttttgtagagactagatctcattgtgttgcccaggttggtctcaacctcctgggctcaagtaatactcccgcctaggcctctaaacacgctggaattacaggcatgagccaatgtgcccagcaagtatggggtctttctatggcaagatgtggtgcccatcactgtgagggacaaagataatattattaataataataggcctgtaatggtgcctcacacctgtactcccacctactcaggaggctaaagtgggaggattgcttgaccccaggaggttgaggctacagtgagccatgatcacaccactgcactccagcctgggcaacacagcaagacgctattccgaataataataacaataataataatatctaacattttaatagaccttacttggagccaggcatcattctaagcatattgcatgcatgaactcatttaaacctatagccatctattattattcctgtcatgctcatcagccagaagccaccagaaacacacctgtagttgaacagaaatgggtttagtaacctgttgcaacaaggaagaccacacaccatggggagtgggagctgtgtcccagtaagagtgtgttggggcgcttctggttagctggcagaaagcagtgttaattccatggctgggcatcatcataatttttatgtaggaggcaggaggaatagagtggggctaaagctgtcattggaaaaccagcagtaactgcatgtgtcagtcagaaggagaggatgcgtttggccatttttttgtggtttgcccactgctcatactttcatgctcagataggattcattacagactgtcttgtttttgtcttgtttcatcatggtcagcatgacatcttccagtgtgaccatcctatgaaattgcttaagtagggaacaccacagcctagcagtagtaccaggccagctactagctgacaacgatcaagactgggctcccggccgggcacagtggctcacgcctgtaatcccagcactttgggagctccaggtgggcggatcacttgaggtcaggagttcaagaccagcctggccaacatggtgaaaccacatctctactaaaagtgcaaaaattagccgggcatgatggcacaagactgtaatcccagctactcaggaggctgaggcacgagaatcgcttgaacccaggaggtggaggtggtagtgagccaagatcgcgccactgcatgatccaccctgagcaacagagccagactctgtctcaaaaataaaataaaatgaagactgagctttccttttcttatcctcattttatagatggaaaatctgaggccaaaataagttcagtagttatgttgccaagcctgggcggaactgtagagcttctcagactgtcagggctgcagggccagctttgctttgtcttcttttgtttgccaatccatcgtgggccaatacgttcataaaatacaataaaagcaaattactagaataacgatcatgcattcagatgttttaggaatgttaaattgctatccttctaaacaggtaccctcaagttctgtcttatctggtctcagacaaggaacagttctcaggccattactgaccacagaccacactttgggcagctttagaagttgtctgatcaagagttttccaggttgggcatgatagctcacacctctaatcccatcacttttgggaggccgaggcgggcagatcacttgaggtcaggagttcgagaccagcctggccaacaatgtgaaaccacatctctactaaaaatgcaaaaattagctggacatggtggcaggtgtccgtaatcccagctacttgggaggctggagaatcgcttgaacctgggaggcagaggttgcagtgagccaagatcgtgccactgcactccagcctgagtgacagagactgtccaaaaaaaaaaaaaaaagaggtttccaaacttcatgcattggtacatcttcatttttgccatttctattgaacacctctactattatttacttaatattatcttgaaatatcctcatctcatatcacctcacacccattatgatggccacaattaaaaaaaaacagaaaataacaagtgttggcgaggacgtgaagaattggaacttctgtgcacagttggtgggaatgaaaatggtgcagttgctacaggaaaacggtatggaaactcctcaaaaagttaaaaatagaaataccatatgatccagaaattccatttctgggtatatatcccaaaaatttgaaagcaggatttcaaagaaatatttgcacacccatgttcattgcagggttattcacaataatcaagaggtgaaagcaacccaaatgcccattggcaaatgaagggataacgaaaatctgatatctacgtacgatggaatgttattcagcctttaaaaagagggatatttggccaggcacagtggctcacgcctgtaatcccagcactttgggaggctgaggcgggccaattgctggagctcaggagtttgagaccagcctgggcaacatggcgagaccatgtgttgcatcatttagaaacatttatagctacaaaagcttcagagatcttgtatttcaatgtacaaacaaactgccaaatgccaaaaaaaaaaaaaaagccaggcatggtggtgtgtgcctatagtaccagctactcaggaggctgaggtgggagtatcacttgagtcgagggagcagaagttgcagtgaaccgagatgatgccactgcactccagcctgggtgacagcgtgagaccctgtctttaaaaaaaaaaaaaaaaaaagagagagagagggaaatcttgtggggtgctgcaccatagacaaacctcgacgactttatgtgataagccagtcacaaaaggacaaataccgaacaattccactccaatgaggtatctcaagtagtcaaactcctagaaacagaaagtagaatcatggttgccaagggctggaggtatttagtgtttaatgggtctagagtttccgttttgcaagatgaaatacttctacagatctattgcacaacgtgaatacacttaacacaactgaactgtacattataaaatggtgaagatggtaagtacaatgtcatgtccttttcagcacagttataaaaagaagaaaagtcctcatcctaggcaataataacccatattatgtattaagatggctagttctatatgttttcttttatttttttaagagatagggtcttgctatattgcccaggctggtccggaacacctggactcaagcaattctcccacctcggcctcccaaagtgctaagattacaggtgtgagccatcacacccagctgagttctatatattttcttatctgcattaacataaatgtttaactgttaaataataaaatgtttttttccatgaacgaccgaaaatcgttttgtgtaaacattgatctttgaacctcctgtttcttcaatgcctatcatctgaggcctgacaagagaagggacttagaaccactcccagccttcaaggagtttgcaattacactgaagggtgaagacactctccccccagaaggaaggcgggaaaatcttaaaagaaatctatctgttccttgaaggccagctctgtgtgttcagtgctctctcccaagtccctagcacatgccttgcccacagtggggtctcaacaggtatttgctagagtctatcaaattaagagaaacacgaaacaggcccggtgcagtggctcacacctggaatcctagcactttgagaggccgaggcgggtggactgcttgagctcaggagtttgagactagcctgggcaacatggtgaaaccccatctctacaaaaaattacaaaaattagttgggcgtggtgactcatgcctgtagtccctgccacttagtgggctgaggtgggaggattgcttgagcccgggaagcagaggttgcagccagctctgatcgtgccactgcacttcagcctgggtgacagagtgagactttgtctccaaaaaaaaaaaaaaaaaaaaagagagagagagagagagaaatactaaataagcagcacaaaccaatggggtactaggccagggctcccaacttgaggtttgtgggtagaattcagagggtccataaacctgcctcattttctctgattgctaactaaaatttagcatttccttctattataaatggaagcaacaaaccacagtagtatttgcaatatctgtgatttttgtcaccgatataaatcacgatattttcatatctcattacaatcatagcagacatctcattatattgtacgtgtgcatcactaattggaattacatagttattagactcaccactaaatcttgttatttgatgcattagtaaagattcacatattactatgacacaaatttggtgagtttttttatattttgataaccatattttagtataattggtttcctttgtaattccatgcactttattttttgcatagataaataatttaaacaatattacaaagaacaatcaatcaaatctagtatagaatatttcatagcctaaataacattttcccaaaactgaatggaccaaaaataaaaagtgctaatggttaaatattgttttggagttagaaagatttatatatataaaaaaggaaatatgtgaattttgggccttaatttaaacaaacaaactgccaaagggaatctttaaggcaatagggaaaatttgagtataactagtatgatgatacttaagctatagttgtctaatatgaagattactaagtagaagaagttatataatatgtttactagcagatttataattgtaaacatatttacctataggttgagataaacgtctgacaccaagaagatctcagtttaaataaaataagggcatgcaataatactttaaaaaaagtaagttatattgagaacaagttatgttattcagtttgagttgaatagaagatcaatattagtaggcatatttaggtttgttgcccagaaagctaatgtaatcatccattaataaacatatcttctccaaaaaaaaaaaaaaaaaaaaaggatattgttctcagaaggaggtcatagactccgccagatgccaaaagggtacatggtaccaaaaagaggtcagggtccagcgtggggttaattcagtgggtaactgactgggcctaagaagaaacagactgaaccaaggacaagcccactgttaccaccttttaggagggaaacactaacttaccatcggaaagaacggtgaattcaccggctaacatttgtgtgcagaaatcccctgacaaccgcaggattcaatgttcctaaaaacatatgttcattggcaagatcgaggtctcagaggaaattcagtgttgagcactaagtgatctcacatctgctgggttcaaagcatggactctggagccagactctctctgtttgtatccaagctccaccagttaggacctgtgtgaatttggatgagttatttcccctcgatgtatctcagtttccttgtctgtaaaacaggaaccaaagagcctagtggtggctggcagaataatgtcccttcagagatgtctgtgtcctaattcctggaacctatgaatatgttagattctacagcaaaagggaatcaaagttgcagatggaatcaatgttgaccttaaaaccaggaggttgtgcaggtagaaccgatgtaatcaaaagggtccttaagtgtggaagagggaggaagaagagaatcagagagagatttaaagatgttatgctagtagctctgaatatggagaaagaggccacaagccaaggactgcaggtggtctctagaatttggaagaggcaaaggttctccccagagcctccagaaataatgcagccctgtcaatgccttgatattaaccaagtgagacctctttgggacttctgacctccaacactgtaagataataatttggattgttccaagccactaagtttgtggcaatttgttacagcagcaataggaaatgaatacacagttttaaagatttttgtgaggatcaataaatgcattcatttatgtaaagcccttagaacagttcctggcacataattggtgcaatataccattaattttatagaaatggtgaataaaaattagagaattaatcacttccaaaataaactggatccactcaagtcaaagccttgctctgttttgcaacccttaatgaattcatggatctaggcattatcatacagcagatagataacatcacaaatgaggctgggcatggtagctcatgcctgtagtcccagcaaattaggaggccaaagtgggaggatcacttgagcccaggagttccagaccagcctaggcaacacagtgagaccccatcactacaaattagttttgtaaaaaactaaccgggtatgttagtgcatgcctgtggtgccagctactcaggaggctgaggtaagatgactacttgagcctgcaaggtcaaagctgcagtgagccatgatcatgccactgcactccagcctgggcaactgagcaagacaccatctcaaaaattaaataaataaataataaaaataattttaaaaaataaaaacacaatgggagataaccagacatcagttacctcctcatggaaaaacataacaatctaaaaagtggtcttgctaaaaaaaaaaaaaaaagaaaaagaaaaaatcagacctaaatctgataaaaatgtatagatacaacttatcaacttacagaaatgtggacaatgggccaggcacggtggctcccacctgtaatcccagcacttcgggaggctgaggtgggtggatcacaaggtcaggagtttgaaaccagcttggctaagagaccagcctggccaataaggtgaaaccccgtctctactaaaaatacaaaaattagcggggcgtggtggtgggtgcctgtaatcccagctacttgggaggctgaggcaggagaattgcttgaacccgggaggcagcggttgcagtgagccgaagatcacaccattgcactccagcatgggtgacagagtgagactccaactcaaacaaaaaagaaagaaagagagaggaaaaaaggaaggaaggaaggaaggaaggaaggaaggaaggaaggaaggaaggaagggagggagggagggagggagggagggagggtaggggagggagggagggaaggaaggaagggaggaaggagggaaggaaggaaggaaaagaaagaaggaaggagggaaggaaggaagggagggagggagggagggagggaggaatgaaagaaagaaagacagaaaggaaggaagagaaaaagaaagaaagaaagaaagaaaaagaaagaaagaaaagaaagaaaagtggaagatgaaggaatgcactaaaggacaccacagagatgcaactggcaatgtctagactgcgggggactctacagcagtgcttctcaaacttaattgtgcatacaaaacacccagggaccttgtgaaaatgtagtttctaacccaggaggtctgggatgggatctgagatgctgcatttctaccgagttcccaggtgatgctgatgatcctggttcactgaccacattttgaattacacaagatgaataacctatttttccagcaataaaagaactgaaggggaaacctatagattaaaagacacatgagccaatcactatgtgtaggactttagttggattctgattcaaagaaattattattaaaatgtattaggcagagccgggagtggtggcttatgcctgtaatcccagcactttgggaggccaaggcgggcggcagatcacttgaggccaagagttcaagaccatcctgaccatatggcaaaaccttgtctttactaaaaatacaaaaactagactagccaggtgtggcggcatgcacctgtaatcccagctactggggaggctgaggcacgagaatgacttgaacccaggggaaagaggttgcagtgagccgagattgtgccactgcacttcagcctgggtgagagagcttactgcagcactatttacaatagcaaagacttggaaccaacctaaatgcccatcaatgatagactagttaaagaaaatgtggcacatatacactatgaaatactatgcagacataaaaaagaatgagttcgtgtcctttgcagggacatggatgaagctggaaaccatcattctcagcaaactaacacaggaacagaaaaccaaacaccacatattctcactcataagtgggagttgaacaatgaaaacacatggacgcagggaggggaacatcacataccggggcctgttggggggtgggggtcaaggggagggagagcattaggacaaatatctaatgcatgctgggcttaaaacctagatgacgggttgataggtgcagcaaaccaccacggcacttgcatacctacgtaacaaacccgcacattctgcacatgtacccaagaacttaaagtaaaataaaaataaaaaagaaagaaaaaattgtattaggcagtaagtaacctgaacggtgactggatagttgatgttctaaggaatcattgttaatgttttgggtgcactgatggtattgtgcctatgtttttaagagtttatcttttcaagatacacattgtaatatttacagatgaaatggtagtgactggaattggcttcaaaataatgtatgtggggaaaacaggtagaggtataagcaaaactgggcatgagttgtccattgttgaagccaggtagtgagtcctgagaattcattgtgctattcttctactttcatatacctttggaatttcccatcataaaattatttttaagacatatttcttaaaatcttctctgctagctaatccttctcttgaaccacattcttcaaaggttctcctgcggcccataagttataaagagctcataagttataaagagtctgtgacttttagcagttacagacttgaaatctcatgtttttcatgctggcattccctctggtttcctttttgcaagtctcagcaaaatactttgtgtacccacctaattatcacagtccttaaggcacgtaccccttgacccagtcttctgtctgttaccgggatgtttctggcacctgaaatgcttttctgcagaactgctcatggcagctcctccctccccttctgttcaattggccctgctcagaggggcctccactgaccactcaatataagcagacatcccagtgtctctctgtggcaatgcctcagggcactctcagcatctgagatgatcttgttcatttattcatccgctttattttctccttcttcacacaacactccctcattctccccttataatgtattcaacaggaagacagggaccttgcctgttcattgctgcagactcagaatgtaacacactagcaggcacagcacagaatgagtgagtaaatgaatgctatagctgtgtgcatagctccatagacctagaaaatcaactgcattcttgctaagaggcatatacacatccatatatctggatcacacgtttgcagtctttctcatcaaatcatggaccaatggagctgcacatcccaggccaatagagctctatagcccatttctttcaagagaagagtagctccctgcgaactttcattggacacctgagctcttgactcacaataattggtcacaagaaggtctctgtgcaaatcagagatggtgggactcaaaatgtctgtggtcacagatccaaatgcactactccattatttagaaggccctcaatacccacctaacaaaccctatgccagggtctaatcaaagaaccgggtactgcattgaaagttgggatttggactggtctattggaaaagaagggttttcagatagaggcttcactctgtatttcagcttcatcagctatgggctggaaaatggttatagtgtcctggagactaatgaacgtggatttgaatctctgcttctcctttattagctgtgtgaccttagctaagtgatatcacttctatgatcctcggtggcatttatataatgggaataacaataatgatatctaccttgtagatttgttgtgaaaattaaatgagatgatagaaataaatatttcatctagtgcctggcatagagcaaatgtaataaaatttatctattactactactgctgctgctactgctaccactatcttctgatcttggaagagtcacttaattcctccaattctcagtagactcttctctaagaagaaataacaatgtcctagatccacagaaagtctggtgcttctctcccttattttctttagttctctgctcagataccacttttgcaaagagagcttccctgaccagtgtccccctcccacataaaatagtccacactctctccatctcattactcagcttggtttttcctcctaggacatatccgcctgatttgtacttacctgtttaatgtctgtcttgtcttccttgtcagaaagtcagccccaagagagaagaggctttgtccattgtgttcaatgcttattcctggggcccagaacaatgtctggcatataaagacactcaatgaatatttcttgtggaatgaatgaatgaatgaatgaatgaatgaaattaggtaacttgggaccataactatccagtccctgcattgctgttcaatagatattagcttccttccttccctccttccttccttccttccatccttccaaggccagaaaaaagaacaataagtgagagaaaaacgcctatcggcctcttttttccctgcttctcctccaagcatcatgcaaacaatcaaaacaaaaatgcagcagcaggtgccaagaagtcaggtgcatccttcatccccagtcagtctttcctggctctgaaatgtttgcaggagcaaggtgcccccgaggcacactgctttaaatgagtccaggcaggatttagacagctgctctgtaaccccaataaacgatgtctgtctaactttacgcaggggcactgagggttagggttgtatggctcttggggtctctgaagtagaaaatcaatgggtttgatgtatggccccatttatggcacctgaaacagaacatccactaccaggtcggctaccatcaaacctctcctaatataacaatacaagccatctctgagccttgaaaacctctttacaaagccagtggtcaaagagtagaaccgtctttttcaacagcaatcagtgaagatgatcatgtcactctcctgtggccaaccctcccctggcttctgatcgcactaggaatgaagtgcaaactcttctcccaggatctcaccaggtcagcacagcctggcctcacgtgtctcttcaccatctcagaccattctcctgtcttgctccactccaactgcattcatctctgtgttcccaggcacgtgccaccacacctggctaatttttttttttttttcttggtggaaacagattctcaacatgctgctcaggctgatctcaaattcctggtctcaagtgatcctcctgcctcagcctcccaaagtgcaaggattaaaggcatgagccactgtgcccagctgcattttattttatttgattttattattattattatttttgagatggagtttcactcttgttgcccatgctgtggtacaatctcggctcaccacaacctccacctcccgagttcaagtgattctcctgcctcagcctcctgagtagctgggattacaggcatgcgccaccacacccggctaattttttatttttaatagagacagggtttctccatgttggtcaggctggtctcaaacttccaatctcaggtgatctgcccacctcggcctcccaaaatgctgagattataggcatgagccgccatgcccagcctgcatttcatttttctaagacaaaaatattctggagatggatggtggtgatggttgcccaacaatatgaatgcacttaataccactgaactgtacgcttaaaagtggttccaatggtaaatattatattatttgtgttttaccacaataaaaatgtgttttaaaaaaggaagaaattctgaaacatgttacaacatggatgaaacttaaagatattatgctgagtgaaataagccagttacaaaaagacaaatatcatatgattccacttatatgaggtatctagagcagctgaattcatagagaaagagaatagaacagtggttgcccagggatggggaaatggaggcatagggaattggtgtttaataaggacagagtttcagtttgagatgatgagaagcgtctgaagatggatggtggtgatggttgcccaacaatgtgaatgtacttaatgccacttaattgtacacttaaaattgtacacttcaaaatggttaaaatgggcctggcgcagtggctcacgcctgtaatgccagcactttgggaggccgaggtggacggatcatgaggtcaggagattgtgaccatcctggccaacatgctgaaaccccgtctctactaaaaatacaaaaattagctgggcatggtggcgcatgcctgtaatccaagctactcaggaggctgaggcaggagaattgcttgaaaccgggaggtggagtttgcagtgagtcaagatggcaccactgcactccagcctggcaacagagtgagactccatctcaaaaaaaaaaaaaaaaaaaaaggttaaaatggtaagttttatattaccctatatttttatcacgattaaaaaaaaaaatcacactatcccaggctggacacagtggctcatgcctgtaatcccagcactttgggaggtttgggaggtcaagacagatgggtcatttaaggccaggagttcaagaccagcctgaccaacataacaaaaccccatctctactaaaaatcttttaaaaagctagtcagatgtggtggtgcacacctgtagtcccagctattcaggaggatgaagcacgagaattgcttgaacctaggaggcagaggttacagtgagctgagattgtaccactgcactccaaccgggacaacacagcaagagactctgtctcaaaaaaaaatttttttaatcatgctacctagcccaggcaacacagtgagacctgtctctacagaaaaataaaacaattcgctaaatgtatgctactctcagctactcaggagtttgaagtgagaggattgctggagcatgggaggcagaggtggcagtgagccaagtacctctgcactccagcctgggcgacagagatcctacctcaaaaataaaaatcgcagtacaaaaacaattttaagaggaggggtgtagagtattttatccaaaggcatgagataaactagctcattgatccattttctttctttgtcctgggtgatctctgagcctcacctagtaagagttaatatttatgccaggcaccattataagcacttcgccagtgtttccttcatttaatcctctctaccgtcctacaagatggggagcctaatcatctccatttaaaggatgagaaaacagaggcccagagaggtttcgtgacttaacctacaaagtctgactccagagtctaggcaattttccagaccacttttcccacaagacttgacctcaccctttgatattcaaaataggctcctcagatctacataaaatattctaaagtatcaggaatgtataagtcaggttaaggagaataaacttttttttctgtattcaccccatctttgttgaaaaagtgctgttactggcttcaaggcctgcaggctacattgcttaacacaggtgtactaagttaaagttcagcaaacttctgtaaaactccataaaaattaatctttgaggctttaggggcagatggcgtatgttgcaactacttgactctgccgttgtcgcacagaagcagtcatagacgagaagtaaatgaatggccttgaccgtgtgccaataaaactttatttacaacaacaggcactgggtttggtggctcctgaaagggttaaacacagaattgccatatgacccggcaactcccctcttaggcatgggccgaaaataattacaaataggagttcaaacaaaaacttgtacacaaatgttcacagcagccctatttatagtagctaaaaggtggagacaatccaaagatcaatcaactgaaaaatggatgcacaaaatgtggcatatgcatccaatggaatagtattcagccatgaataggaagtatggacgcatactgccaggtggataaacctggagaacaatatgctaaatgaaagaagcagacacaaaaggcaacgtaggccgggcatggtggctcacgcctgtgatcccagcactttgggaggttgagtcgggtggatcacctgaggtcaggagttcaagaccagcctgaccaacatggcaaaaccctgcctctactaaaaatacaaaaattagctaggtgtggtggcgcatgcctgtaatccccactactggggaggctaaggcaggagaatcacttaacccaggaggcagaggttgcagtgagccgagatcgcaccactgcactccagcctgggcgacggagcgagactccgtctcaaaaaataaataaatgaataaaagaccatgcaatgcatgactctccattgatataaattgtccagaataggcaaatccacagacacagaaggtagcttggtggttgccgaggactgaggagaagaaaattgagaacacctgctcaacagttatgggctttctttttggagtgatgaaaatgttctggaactaagcagatgtgatggttacagaatattggaaatgtggccaggcatggtggcgcacacctacaatcccagcattttgggaggccgaagcaggtggattgcttgagcccaggagttcaagaccagcctgggccacatggtaaaaccctgactctacaaaatactctactaaaaggtggagacaatccacctttgttcaaaataaaataaaatataaattaataatacaaaaattagttgggagtggtgacacatgcctataggcccagctactcaggaggctaaggtgggaggatcgcttgagcccaggatgtcgaggctgtagtgagccaagatcacattactgcattccaatctgggcgacagagtcaaattgtctcaaaaaaaaaaaaaaagtgaatgtcctaaatgccactgaattgtatgtttttaaatggttaactttacgttgtgtgaattttctctcaattttaaaaaatgttttaaaaaaacaggtggctgattgcttttggcacacagaccaaagtttgttgccccctattctaagccaaacagccaagaaggggagaaacagaagcatactatgacctatatgcaaaatattcaaagccattcatttaccagtgcttggggaagaagcgcgtatcgtatgcagtcttatacctccctgaaattaacatcaggcaccacccttggacctgagaagataggaaagctcctaggactcggtgcccacactgaagcctgaatcagggaggagagggcatttcatttacagcacatgctatagcttgaggtgaggtggcacagtctctctgcaaaaccaaaacaagtttaatacgatcagactgcagaaggagatggagtgaggagagataaagccagatgaggaaataagggtcatggcattaagacatgataagaaatctggattttatcctgagcgcaatgggaagcctatcaaggtttttcagcaaaggaggtggaaagccagacttgctttttagaaacatgattctcagtgtatccagataatggattgggagagagagatgctagaaaccaggagaggttttgcagaaaatcttgagtggcttacggtgcacaaataaagcttcaagacaactcaggaaagttggcctaaggcaggaggctcgcttgaacccagaagtctgaggcagcagtgagccatgatagtaccaatgcactccagcctggatgtcagagcaagacgctgcctctaaaaaaactttaaaaattaaaaattaaaaaagttggcctattgaaggttttccacctctgacagactcctctttcaaacaggagaataaagaaacttctttatttttccaaaaaaaaaaaaaaaatccaataaggacctcataaggggtccagctgccaagcataggagttgagcagagcaaaaatgacagggaaataaaacataaaatgagaatctatttcgcacttttaaccgaggccaatagatagaaaagagcttgcagttttccatgaataacaactgatgcaggcaataatgctaattattattattacgtatgttaataatgatattcaattgaactgcttaaacagaggatgcctcggagggcaaagatagtctaaggaattccattatgaaaatttcattttcagcccatagcctccttaatatcactaattaatattctttccctaaacaaatgcgggtggaggaggttggcaaagtacagaagtagcacttatcacaggaaacggtagagaataaacaggataaaaggactgaggtcacatttgtgattattatcataataaaatgcttcggaggaacgacttggcaaagcttacctgcaccatatgcctggcagactagcagcttcaaaacaatcgcaaaattaaaacaagtcttagggtcagttgctgagtttaaacattaggaaaacacttattttcctccagtaaccaacacatggcaggtttttgtattctgggttttggggattcggttttggttttgttttttcattagcttggttttgattgtatgtttgctttacatgctggcatttaattctgtaaccaggtttcctctgtctcgttcacaatctttttcaaatatacacctgagagcagcggattcctggtgccgctgaggcagtgactcacaggagttaaaagtgtgagctctagagtctgtggaatgtgttcaacttctgattctgctctttaaccagctatggccttaatcgctccatgcttccatttcctcatctataaaatgggtatgacaggaccatctaaccttgtaggattttaaaggataattgtgctgagacaatttagcctggcacttgacatacatttcagtaagtggtagttattatggaattattatgctgcatcccttcccctgcccacattgacaaataacccacactaaatcagatcctacacctagaccactggctttcaacaaatgtgttttttgtatatgaaagaatacatgatcctggcaactattctggtcacttcaaatcctcacccagcttttggaaccatcttactttcactagtgtaaataataagtgggtggtcctgtgtgtcaatcatataagtcccatgtcacagagagagagagagagagagagagattaaatctctggaaagggacaaagatggaacagagcctcagaccattaacctagagagcaggggtcagagggaagggaaaatgtcaatcatttcttaagtgtgctctgggaagaaagtttaaaatatagatagtaaaggattctttggggctttagggcaacagtaaatgttgccattcattactaataataaccattataataaccaccacccatcacgtgtttactatgtgccaggtatttctttggcttagtgctttaaatacattatctcatttaatcgtcatgacagtactatcaggtctagatttattatattctctatcttattttaaggaaattggaagcctagagatgatgagtaattttcccagattatccgcctgggtgtctggttctaaaaacccaagtatttaaccactatgctatatcacctctcaagtaaatagagacctttagacaaacatcgtgagagtatcacctatattagtttcctaggacttctataaaaacaaagaccacaaattaggtgacttgaacaacagaaatgtattgtttcacagttctagaggctaggagtctgagatcaaagtactggcagggtaggttccttttttttttttttttttttttttttttgagacggagtctcattctgtcacccaggctggagtgcaatggtgtgatctcactgcaacctccacctcccaggttcaagcgattctcctgcctcagcctcccaagtagctgggattacaggtgcgtgccaccatgcccggctaattttgtatttttagtagagacatggtttcaccatgttggccaggctggtcttgagctgacctcaggtgatccgcccgccttggcctcccaaagtgctgagattacaggcgcgagccacagcgcccggccggatagtttccttctgtgggctgtgagaaagaatccgtcccgtgcctctctcatagctttggtggtttgttggcaatttggggcatttcttggcttctagacctctgccttaatctccatgtggagttcttttgtgtgcgtctgtctccaaattccctcttttaatgaagacaacaatcatattgaattagggccccagcctactccagtacaacctcatcttcactaattatatccccaagaaacctattttcaaagaaggtcacattctgaggtactgggggatagaatttccacatacaaatttgggtagatataattcaacccataacctcactcataagcatttgtctctgctgattattccttcatcttccaacccaggggcacaggggagggggcagggaggagcccagggtctccacacacgcacttgctgcaagacataactcttcatttcaaaccccacagtgccgtttgtcctacatgagaaaggagagttgaaaagggatacagtgcaaaagatgtcaaacccaagataaatgtttcctcagatgcaatgacttccagagatttggagtcgtaagtttttgaaaaatggacacatgaggaacaaaggttgagttttctgaaatcattgataacccccaagacaacacccagctttctcccatgattataaatggggggatttgaaatggaacttctattgtgtggctttcaaagcccacgatggcccaggagtagtgaatcatttctaaggtaaagcacttcctctgaactcaggggaagcagaagtaggcagataagaaatggtaatgcaggaggcagatttatgaacaacctgaaatgtgaacattttttttcatattccataagatggaccagtcctgtggcccatgtgggagtataagattaaacaccaaaaataaaatgtcttagcatttcccaaattcacacaggcaatgtcacataggcccctccccagtaaacaatagacatgatgtaaaatgcagattcttttgtctggcaatgaacataagcagatgaacatttgttcattctttcaacaattgcttcctgagtgactgtcatatgctgggctctgtcccaggtgctgaaaataaatatctcgagtagggtttacagattaggtggataccaaactctgaataattaaatcatagctctacaaaggaattcagggcagtcatttatgcagacagaagaatggaaagggagatagaggaaagtgcatcttgtgtatttctatcaggtgttatctaatgaattcctcacagcatcctttcaagatggtgtctttcctgcaaaccattattattaatctcattgttaccattctgtggcaaccctcagtgactgaatttctcctcttttggtctagcatatataccactaggaactatcattttgcttttgagctcctcctatctagctgaagacaaagttattcaaggaagaagctagctccctgccttggagaaacagtcttgaagaaaccatagatgtatgaaaagactatttccattaacaaagggaataagatcaggaaatatttttgatcttactatatgacctaagcatatatcccagagaaattttttaaaaagtactcaaacaaatacttgtacatgaatgatcctggtagctctattcacaatagccaaaagatggaaagagctcaaatgtccataaatggaagactggataaatacattgtggtataatacatacatacaattaactattacttagccataagaaactaatatatgctacaatggggatgaacctcaaaagtattataagtgtaagaagacataaaaggtgtataattccatgtatatgaaatatccagaataggtatatccacaaatgcagaaagcaggttggtagtacccctttctggggaaagagaaaaatgaagagtaactgtttaatgggtacaggtttttatttgggggtgatgaagctattttggaaaaaggcagaggtggtcatataacactgtgaaggtactaaatgccactaatttgttcaccttaaaatgatcaattttgtcatgtgaatttaacctctataacacagggtacttcaaaaaatagaccttcaataaatgtttgtagaatgaatgaacaataaacaaaggaatgtatgtggtcttggcaaacggctcatactgaaaggtggtctatgaaaagagactttgtaagtggagatggtgttgaccagcagagtctaaaatgattcttagtggccttggctcggttttattattctgttcatggagaacaggaatcagagcctagggttctatccaggaggaaaaaaatcttcctgtcttggaattttcagaacctagtgtcttcctacatagcaaaagacatttctggctgccaggagggagtaaagccagtgggagttagtcccatctgcctgcagagaggcagaaacattatctgtctaaattcttcttcatcagaaagtcttatggctgggggcgcttcccagctctcattgtgacctagccttaggaccacattaaagagcactaccatgccgcagagagggggttggagggaggagactggctgccagactgaaactaaattaaaaataaagctccccttattaaattcataattattgtgaagctgtgaaatcttattttaaacctctggctcctttctttgtccagagtagaggctgcctgcttctgaatccctattttgctttatggacaatttctttttagcattctgagcatttaaccttgaaaaatagtgttgttttgctgctgtattttctgattgttagtctccaggcatctccatggcatctttataaatctgcaggagctggtaaatatttcttgccgaccagccgctgaaatctgaaaataccagctcactttttagctgtcaggcaattaatgtaattcaaaggaaatgaaaggtgtgggcaactgggactgcttttaataacaggagggttcctggctcaggcttagaaacacaagagagaagaatcaataaaagactaacagaaagggtagaagagggcgtggagttctctagaaacattttgtcagcatcctggcaatgctgcaaatctgtgccaagagaaactgataaatgcagctactgatgatcgacttggagatgagtcaaacttcgaggcctgggccagggcatccactggcctaaagggtgcctttgtgtaaaatgggaaacgataccccatctgggtagctgaattaggagaaagtgctccctgagtatagatgcagccccacgccaaggcacacagcttggtgggcagagtgctactggatttcagccttcttcctccaaatttattcttatggccagcagccttcgtgcagcgtacaaactgaacatcgctatccagatcaattcccacttccctgtttcttggataatattggttttccattcttccctgctaagtcaggaatcaactacattggctttggaccccaaaggtgatttaagtgtagttggattcataggaggagatagactatggagaaggaggaggagctctcacatatggcaatgctattttgtttctcaaagacaacaggctagaagaggaaaaagtctttccttctagtgaggtatagactagtcactaaagaaatacaattttccaagcatgggaatgataattctatcaatatctgccacctttcatatacttctttttttttaatatacatggagtctcactctgtttcccaggctggagtgcactggcacaatcttggctcactgcaacctctgcctcctgagttcaagtgattctcctgcctcagcctcccaagtagctgggattacaggcgtgcgccaccatacccggctaatttttgtatttttagtagagacggggtttcaccatgttagccaggttggtctcaaacttctgaccttgggtgatccgcctgcctcagcctcccaaagtcctgggattgaaggcatgagccaccgtgcccagctcatatacttcttacatggcagtcaaggttacacaatgcatagagcacaaatcatattctactgtatataaataatgcctctcctgactacatggattacaatgtcattgctgcccccggagttgtgcaatatggcaaccttgagtcccataggcagtgcatcgggggaggcctacagagtatattagggtacatggatgaacctacttcccaagagaaagcaagatttcaaaacccagttgatcaaaataaatacaaaatcatcaaatgtattttgatatatcaataaatgtttagcaaacaaaaagtccatctataatcatatttttaaatcaaatatccaggagtaaatctagcaaaatatgtgcaagactgcttcatggaaaactctaagatatttttgataaaaatgtttaaacacctaagtaaatgaagggataaaccaaggtcctggactgggggactccgactccatgctgtagtagcactgtagtaatattaattgtctgcaaactgatctacagatttaatacaactccagtcaaattcccagcctgtgctgtttgtttgttttggaaattagaagccgatttttaaatttatatgtaaaggcagagtcaagactagccaagacaatcttagagaatgacaacgtagaaggaaacgctctaccaggtattaagacttattacaatgatagacattaagaaagtggtactggtggctgggcatggtggctcatgcctgtaatcccagcactttgggaagccgaggcaggcagatcacctgaggccaggagttcgagaccagcctggccaacatggtgagaccctgtctctactaaaaatgcaaaaattagctgggcgtggtggcgtgcgcctgtaatcccagctactcaggaggctgaagcaggggaatcacttgaacccaaaagacggaggttgcagtgagcggagatcgtgccactgcactctaacctgggcaacagggcgagattccgactcaaaaaaaaaaaaaagaaagaaagaaagaaaagaaaaagaaagtggtgttggcttgaaaacaaacaatggaagataattgagtccagaaatagacctttgcatctattaacatgtgatttatgataaaatggcagaacagtgaagaaataagtcttttcaataaaatggtgctgggtcaactggataaaacatggtaaaaaaacaaaacttgagcccttcttcacatcatacctaaaaacaaatcccaaatggtatgtaggtttagatgtagaaggtaaaacaagcttccagatgataacatcagagtgtatctatcttcattactttaaggaggaaaagatttcttggacaagccacagagagtactaatcataaagcaaacaactgataaacttttaattttaaaattaaacttttgaaattaagaacatttgtgtattaaaaaaaaaaaccacactattacaaaagtgaaaagggccgggcatggtgactcacgcctgtaatcccagctacttgggaggctgaagcaagagtattgtttgaggccaggagtttaaggccagcctaggaaacatagcaagacccccatctctacaaaaataaaaattaaaaactagccaggtgcggtggcacatacctgtagtcccagctactcaggaggctgagttgggaggattgcttgagcccaggagttcaaggttgcagtaagctataatcacaccactgcattctggcctagatgacaaagcaagacccccttctcttatttaaaaaaaaaaaaaaagtgaaaaggtaagccttatagtgggaagagataattgcaacatgtaaatgaaaagggattcataccagattacaaaataatttctaaatcaaaacaaaaaactacagaaaaatgaaaaaaagacttgaacagacaacagatacttcacaaaacaaggatacctaaattgccagtaggcagataaaaaggtgttcaacctcattagtctttggcaaatgcaagataaaatcattatcagatgccactacatacccactagaatggctaaaattttaaaaagactaacactatcaagcactgagagcaatgtagaggaactagaactcccattatgcttctagtgggagtttaacacaagcactttagaaaactgtttagcagcatctactacatttgaacatatgctaattctatgactcagaaatttatattctagatgtatgtccaactatatttacatatagccaaaaattaaatataaattttttcatagcaacactttaaataatagtcaaaacactggaaataacataaatatacaacaataaaatgaataaataaatggtagtatagtcacatgatggaatactacacagcaatgaaaactgactatggctacatgcaaatacctggacgaatctcataaccatgtacaaaataagcaaagacaagttgattcatatttcttgattccatttatattgtttttaaagtggtaaaaactagtatctgtgttaaaactcagcatagaagttactttttgagaaaagaggacactatggcatttttgagatgctggttatgcaagcatgttcacattgtgataatatattgagccatatccttatagcttgtgcacttttctttaaatagattatattttacttaagtattttttaaaaagatttttaaacccatttcaaaggccatatctgggaagccttcccagaacatgcagatagatttaattactccctcattgatatcttggacttatttaggttgttatacttcgaacagtctattataatttgtgttcttccatgcagttcttccctgttacacatgaaattcttgagttaagagcaatatggatatttattgggatgtttggttgccattgtttgtttgcattgttttttgcccacagcatcatatgttttcccattctaacagagccctagtttttctttgagaattcattcttctacatataaggtctgtgtgatttgagtgaggctccattcctagtcacacaggtagaggaggtgacccaggtccaagacaatcactgtgtatcacatgatatattagtctattctcacactgctacaaatgaatacctgagactagctaatttataaagaaaagaagtttaattggctcacagttctgcaggctgtacaggaagcatagcagcttctgcttcttgggaaacctcaggaaacattcaatcatggcggaaggggaaggggaagctggtatgtcttatgtggctagatatagagaaaagatgggaaggtgccacacaattttaaatgaccagatctcataataactcactcactctcatgagagaagcaccaaggagatggtactaaatgattatgaaggaccatccccatgatcccatccccttacacttggccccacctccaacattgggattacaattgaacatgagatttgggtggcgcacagatccaaaccatatcacatgacctaaactgatctaatcagactgaaattcattctggattagaatcaatttcaggatttttgtggaaaataccaagccacagatgctcatcttttactgagcatgaaactgaaaaatgaggtttcaggagctactgtcagacaccttgaaaccatgagaaagagtcttcctgaaaatggagccaacactgaggaaaagtcaggatagaaagccccgaaggaaacccatgcttgtttggtcaaccgtgtttcagaaatgtgtgaggtggccagacgcagtggttcacacctgtaatcccagcactttgggaggccaaggcaggcagatcacttgaggccaggagttcgataccagcctgaccaacaaggcaaaaccccatctctactaaaaatacaaaaatcagccaaatgtggtggtatgcacctgtagtcccagctatttgggaggctgaggtgggaggattgcttgaacctgggaggcggaggttgcagtgaactgaaacaatgccactgcactccagcctgggtgacagagcaagactctgtctcaaaacaaaaacaaatgtgtgaggcaatttagtagagaaaggattgtcttttcaaaaatggtgatgaattggataactatttgcaaaaaaaaataaagaactaaacctcaacaaacaccttatataaaaattaaactctaagtggattaaaaagctaaatgtaaaatctaaatctataaaatttctagaagaaaacatagaataaaatttttatgaccatgatttaggcaaagatttattagttagaacatgaaaagcatcatccataaaagagagaatggataagttggacttcatcaacattttacacttctgctcctcaaaagacactgttaacatattaaaaggcaagccacgttttaaaaatgcaagccactgggataaaagtatttgcaaaatacatatctgataaaggatttacatctggaatatatttttaaaactctcaaagcccaataatgaaacaataatacaatttttatctaatgttatgttattttatgtctctggagctctatgttcatttacatgttttagattttttttaacaagttcgacttttattttagattcagggggtatatgtgcaagtttgttacatgggtatcttgtttaatgctgaggtttagggtacagctgatcccgtcaccaaggtagtaagcatagtacccaatagtttttcaacactcaccttcctccctcccccacccagtagtccccagtgtttattgttgccatctttatgtccatgactacccaatgtttagttcttacatatgagtgagaacatgtggtatttggtcttctgttcctgcattaatttgcttagagtaatggccttcagccacatccacgttgttgcaaaggacatgatttcattcttttttatggctgtgtaggtttttttaaaataagcctcagtttctagttattgttgtttctacttgctcaaacaacttatgagggttctatctaagaataacatttatcccctgttagatttttcctgctttctcttgcgggcatttagtggtataaatttccctctacatgctgcttttaatgtgtcccagagattctggtacattgtgtctttgttctcattggtttcaaagaacatctttatttctgccttcatttagttatttacccagtagtcattcaggagcaggttgttcagtttccaggtagttgtgcggttctgagtgagtttcttaatcctaacttctaatttgattgcactgtgtccgagagatagtttgtggtgatttctgttcttttacatttgctgaggagtgctttacttccaattatgtggtcaattttagaataagtgggatgtgatactgagaaggatgtatattctgttgatttggggtggagagttctggagatgtctattaggtctgcttggtgcagagctgagttaaagtcctggatatccttgttaaccttctgtctcgttgatgtgtctaatattgacagcggggtgttaaagtctcccgtgacaccctaacatcacaactaaaagaactagagaagcaagagcaaacaaattcaaaagctagcagaaggcaagaaataactaagatcagagcagaactgaaagagatagagacacaaaaaaacccttcaaaaaaatcaatgattccaggagctggttttttgaaaagatcaacaaaattgatagaccactagcaagactaataaagaagaaaagagagaagaattaaatagacacaataaaaagtgataaaggggatatcaccaccgatcccacagaaatacaaactaccatcagagaatactataaacacccccacgcaaataaactagaaaatctagaagaaatggataaattcctggacacatacacccttccaaggctaaaccaggaagaagctgaatatctgaatagaccaataacaggttctgaaattgaggcaataattaatagcttaccaaccaaaaacagtccaggaccagacagattcacagccaatttctaccagaggtacaaagaggaactggtaccattccttctgaaactattccaatcaatagaaaaagagggaatcctccctaactcattttatgaagccagcatcaacctgataccaaagcctggcagagacacaacaaaaaaaagagaattttagaccaatatccctgatgaacattgatgcgaaaatcctcaataaaatactggcaaaccgaatccagcagcacatcaaaaagcttatccaccatgatcaagttggcttcaaccctgggacgcaaggctggttcaacatacgcaaatcaataaacgtaatccatcacataaacagaaccaatgacaaaaaccacatgattatctcaatagatgcagaaaaggcctttgacaaaattcaacagcgcttcatgctaaaacctctcaataaactaggtgttgatgggacatatctcaaaataatgagagctatttatgacaaacccacagccaatatcataatgaatgggcaaaaactggaagcattccctttgaaaactggcacaagacagggatgccctctctcaccactcctattcaacacagtattggaagttctggccagggcaatcaggcaacagaaagaaagaaagggtattcaattaggaaaagaggaagtcaaattgaccctgtttgcagatgacatgattgtatatttaaaaaaccccatcgtctcagcccaaaatctccttaagctgataagcaacttcagcaaaatctcaggatacaaagtcaatgtgcaaaaatcacaagcattcctgtacaccaagaacagaaagagagccaagtcatgagtgaactcccattcacaattgcttcaaagagaataaaatacctaggaatccaacttacaagggatgtgaaggacctcttcaaggagaactacaaaccactgctcaacgaaataaaagaggacacaaacaaatgaaagaacattccatgctcatggataggaagaatcaatatcgtgaaaatggccatactgccaaaggtaatttatagattcaatgccatccccatcaagctacaaatgactttcttcatagaagtggaaaaaactactttaaagttcatatggaaccaaaaaagagcctttagagccaagacaatcctaagcaaaaagaacaaagctgaaggcatcacacacctgactttacactacaaggttatagtaaccaaaacagcatggtactggtaccaaaacagagatacagaccaatggaacagaacagagtcctcagaaataacaccacacatctataaccatctgatctttgacaaacctgacaaaaacaagaaatggggaaaggattccctatttaatacatggtgctgggaaaactggctagccatgttcggaaagctgaaactggatcccttccttacgccttatacaaaaattaattcaagatggattaaagacttaaatgttagacctaaaaccatgaaaaccctagaagaaaacctagacaataccattcaggacataggcatgggcaaggactttatgactaaaacaccaaaagcaatggcaacaaaagccaaaatagacaaacgggatctaattaaagagcttctgcacagcaaaagaaactaccatcagagtgaacagacaacctacagagtgggagaaaatttttgccatctacccatctgacaaagggctaatatccagaatctacaaagaactcacacaaatttacaagaaaaaaacaaacaaccctatcaaaaagtaggcaaaggatatgaacagacacttctcaaaggaaaacatttatgcagccaacagacacatgaaaaaatgctcatcttcactggccatcagagaaatgtaaatcaaaaccacaatgaaataccatctcatgccagttaaaatggtgatcattaaaatgtcaggaaacaacagatgctggagaggatgtggaaaaataggaatgcttttacactgttggtgggagtgcaaactagttcaaccattgtggaagacagtgtggcgattcctcaaggatctagaactagaaataccatttgacccagcaatcccattacagggtatatacccaaaggactataaatcatgctgctataaagacacatgcacacgtatgtttattgcggcactactcacaatagcaaagacttggaaccaacccaaatgtccatcagtcttgactggattaagaaaatgtggcacatatacaccatggaacactttgcagccataaaaaaggatgagttcatgtcctttgcagggacatggatgaagctggaaaccatcattctcagcaaactatcacaaagacagaaaaccaaacactgcatgttctcactcataggtgggaaccagacaatgagaacacttggacacagggcgaggaacatcacacaccgggacctgtcggggggtgggggactgggggagggatagcattaggagaaatacctaatgtaaatgatgagttcatgggtgcagcaaaccaacatggcacatatatacctatgtatcaaacctgcacattgtgcacatgtaccctagaacttaaagtataataataattttaaaaaagaataacatttatcctcaaaataggtaagtacacaattattaaaatgggaaaagatttgcatggacacttccccaaggaggacatacagatagcacataaacacattaggatgactgacatcattagttatcaggaaaatgtaacttaaaagtaccttgagatagcactgcacacctattagaatagctaaaataaaccttaaaaggtgagtgagaacaagtactggtgagaataggaagtaacttttattttattttattttattttattatttttagtagagatggggtttcactgttttgaccaggctagtctcaaactcctggccacaggtgatccacccacctctacctcccaaagtgctgggattacaggggtgagccactgtgcccagcactggtacaacccattttggaaaacaaattggtagtttcttgtaaaattaaatacagatttactgtatcactaagcaacttccctactaggtgtttaccagaacaatgaaaacttacattcacacacacacaaataaaaaacatatgcacaaacgtttctagtagttttattcacagttgccaaaaatggtaacaaatcaaatgtcctgcaattggttaataggttttaaaaatcactgtacatctgtacaatgggctactcagtgataaaaagaaatcagaggtgtgattacacagatgactcctacacaaaggcaggatagtgagtaacagaggccagacacataatcttacgagtacatctagactacttaattccatttaaaagatattctgaaaaaggcaaaactataggtactgaaaagagatgagtggttgtcaggggctgagggtagcaggagaagttgactacaaagggacaagaaaaaaattagggaggggggattgtggaaatgttctatatcccgattatgttggtgagtacacaactgcacgtttatcaaaactcactaaactgtgtacgaaaagggtaccatacccaagttacgtctcaataaccttaaccaaaaaagtaaacaaataaaatattttgctgaagccctgaacccagctacacctgaagtgaaatttactcttggagttttcagctgtataagctaatacattctctctttccttaaccacttgagttggattttctgttgcttgtcactaaaagagacccaactgttacacgggctcggtttacccaatgttataggccagcatctagatttaatgaggataaatggtctccctacagtttaaacttctcagaaaccagagtttgtagttaggaatagcaacggtatgatatatgcacacgttatccctcctctttggcccatgatactcaatgatcacaacatccttcagagtaaattcagcttcagagatcttcttatcaagacagtgtactttctctcattactacttcactgaaatcattacttctctcttcctgtagcaggtagactctaagatgtcccccgatcatcctctcctcttcaccttcgtatctttgcatggttcctttttttttggtatggacaggacctgtgacctacttctaatcaatagaatatgtcaacaatgatgggctgtcacttctataattaagttatgtaagattgtaacttccagccgggcacagtgcctcacgcttgtaatcccagcactttgggaggccagggcgggtggatcatgaggtcaggagatggagaccatcctggctaacacgatgaaaccctgtctctactaaaaatacaaaaataaaattagctgggcgtggtggcgggcccctgtattcccagctacttgggaggctgaggcaggagaatggcatgaacccaggaagtggagcttgcactccacttgccgagattgggccactgcactccagcctgggcgacagagcaagactccgtctccagaggaaaaaaaaaagattgtaacttccatcttgctagcagactctattgtcttcttggcttgcatggtttgatgaagcaagctgacatactagagaggcctccatgccaaggaactgagggtagcctctagacaacagccagctaagaactgagggcctcagtacaacaacccttgaggaactgaaccctactaacagccatgggaacttggaagggagttcatccccagtagaaccttcaaattaaacctcagccaggttgacaaccttaattgcagccttatccaaagactcttgacacagaacacctaactaaattgtgcctacatttttgatcatggaaattgtgagacaacaaatgtgttttgtgttaagctgataagtttgggtgtgattatcgtgtagcaacagataactaatacacatccccatcataaacaattccaaaagatgtaggtaactatgcacctcacagagagaatgtttcatggtgttttcttgactgtacacttatctgacaatgattaaatctcactctgctaacctccctgcagcctctaagttttgccctaattaactgtggactgattttctcaaatgaaagcaagtcatcttcaagcacattttcttttctttctgcttattttttgataccctaataaagcaagctaatcttggaagctaagtggataattctcatcttatagattaaaattaattgagttgcagggagagataaaagcttgtccttttatttggatgttctggcaagttgtaccaggaatgccatggtaaccaaaactacattacagaattttttctcttaatcccactgtttaggtagaaaaatttccatctctattttccctcttttagaaaattataaataaaaagaaactgagttagctgggatggaaaagtaaagctggtttttgcctaatcatcctcattacttcacacaccacagctctttcctctggctacttcttcacattaagcatttggctaatggcttctgtttcatgtagaagagcatttattgctctggtatttccctttaacacttcagctggggatatcatagagcagagatttgcaaccacaacccatgggccaaatctggcccaccacatattttataaataaaattttattaaaacacagtcacatccattcatttgcacgctgtctatggctgctttcagactgtaatgggagagttgagtggtggtaacagacagatggccaacaaaacccagaataatttactatcaggccttttgcagaaagcatttgctgacccttatcattaaaaaaaaatttgagaagcttcagagagtgaacatcctttggctacagggcattgcaaggaacatgaacagggatcaggagaagtatattctaggtctagccctatataaccctgcattagtcagttctctgtgcttccgtttacccatcaaaatttcagtaagtggactagatcaagtttcttctggttttgagtaatatatcaactcaaacaacctggggtattttgttcatgtgaatagcccaactattttcatctgaaatcttattattttgtttttcttttcttggtttaccgtgctagacagcttaaacatgatattaccaacttagagtctaaattcaccatgtcttcaaagaaaataagaactaattcctatttgattgggctttgagactaaatgggacattaccatttagtacaaatgaaccagaagaaagaagggagtttgtgtagagtaactttaattatcacaatcatcatcgtcacatatattgcacgtaagatgttccaggtactgttctaagtgctttaaatattttaattcctttatactctcacaaaaaccttatgaaataggtactattattaatcccattttacagatagggaagctgaggtacagagatgttaagtaacttatccaaggtcaagaagctggtaagtagcagagccgggattcaaaccccatgcagtctggctccagagtcctttctattaactgacatcccatataaaagaaagaacattcctagccttgacaacatgtcttcagcaaaagcaaaagaaagagaacagtttctccatctgccccaccccttccagtctaaaacagtattccccaggtctatgggcaggagagcagatgagaaagagatccaagagttaggaattatggctgaactaaaagcaacttcccttagatttttgtttcttgagctcagacttccatctgctgggggcagttttcacataccccagagctgtgtagcctacagacggtctcagtcaagacactccatcagctgtctatccagcaattgtccatctatgtccaaaattttgctcagtctgtctgaaccaaatgtagaaacagtccctggacatttaaagggtagaagtgggggaggaagcctctgaactgtatttctgaaaggctgaatggagacagtttgagggcacactcttccaagttgggccacgggtctatgcaagccagaacctcagcaaaaatgagaatttactgaagaatactgaggaacacaagaaactcgggtcctgagttgaattacaagttttggggactttagcggcaggaatgcattcttacaatattcagtgagcatctactgtgtactgagcactgtgtgaacaccggaaatcctgagatgactaatacttttataattccctaaatagcaatgctccctcacccctaagcctttgcatagccttgtctctcttcctggagttccttcccctgactccttcatctggccaaatcctcacagtcatgacattgctgggccttgcctcctccaggggggccacgttgaggctggaattgtgaacacttggtagccttatgttctttcatgagttatagtttctccttagctcaggcttttcaatggtaaaatgggaatcctcacagatgcatctaaggtcatttggaagactaaacgaaagcattatgtaaggttttacctcagtgcctcgttctttaattgctcccacattgtcttgagatctcccttccagaccaggggctgtgtctaattcatttctgtatccacagatcctatcacagggtctgacgcttaatacatgtttgatgaaggaagagagggagagatgctactcttgactcaaagttttcccagtataaagggaaagacggatatgtacacaaagaatgagagcccagtatgaaaaatgctataaaagaaacattaaaaagagcctcacagaatcaaagaagaaagggccatcgaggctggtgatcttgagaaatactttgcaaaggtaatagctggttgaggactaagagcttgccaagcatagcagcaggcagattagagcattctaggcaaggagaattgtacacttcattcccaagcacaaggattaaattcttacagggaatggtaggttggaacaaaaataagtgaaagagatagaataaggaatatatatccttaacataaaaatgagttacaaggacaaagataatgtatgtaaatgtgtgactattttacctttagtaaataacagagaaaaaagtggagaacaaaaagaggccatcagtgatttttatatgtcttaaattagcagcaatcagtactatacaacccattttctatttactgcctcaagacggcaggaaatttttcaggctctccctctgcttcatctgcaataagaagctcacaaatttgttttgctttgttgcaaataacatgtatgctgagaggcatttttcctctctataactgtacagccatctaaatgggtcttttctggttttacaacttgaatatgttaacatgcacccctcagggtcccccttgtatcccagaaacagcacgcttgtaaaaccttattcatgtgatatccttaatagctgctgacatttattaagtgtttaagatgtgccaggcatggtgctaagtgtcttagaactcttccagcctgtaatccccgagcctccctgtgaaaatacaagcatcttaagaatgccccctactctggcatttaccttcagatgaccgatgaggaaagtgaggatcagaaacatgaacttatcctaggccagcccactagcaagtgatggaggcagcatttggactcagggctgcctgattccagacaaaaagcctccaaccataaagctatgctgccaattccacttggcccgggtgagtagctctgtctccagtctcctcaatactcagattctagagccttagctgtccaggtgataacttcaggccggttaatacctggggcactcagcacctgtgacacacagagttcaggaacctccttctatagacaggggtttcagtgccaaagctctctcaggcatcagtttgttttccgcctccaaggctcattgcagaaatatctgcttctgcttcactatcctccttaccactcttttccactcaaaacctccaatttcctcttctccaattacacccaacagagggggctcacatttacctagaaccaaaattcctcttcttccaagaaaatgttcagtgcctttgttattttacaacatggatattcatgtctgctgtggcctaagagaagcagagttgcaataatctctgggtggtgtcatgtagttgaccctcttaataacagcatttttaagcagttactgtgtctgaactgtgcttagtgctttgttggcattagcacctggaactctcccaactactgtaggctgtaggtattcttagagccccatcttacaggtgaggaaactaaggcacagtcatacagcaagcaaaaagcaaggagtgaaaagtagcagagtaattggagaatacgaataaaacaatgctattctcccctgcaagtcggtgctgagcagatagcctctacttgagcaggtcttcaaaacatgagccagccttggggaaacaggcactctcgtttattgctagtggaatcgcaaaaggctactatcaccatggaggataatttggcaacatctatcagaattacatatgcatgaaaagttgacccagaaattccatttctagaaatttatcctaaatatatgtaaaagtatatgcacgtgcctcatgcaagtacaagtttattccttacaatgtgtttggcctaagaaatagttggaaaaaatccaatgtccctctatagcagattggttaaataaagtatggtacaacctacaacaggtagtatggggctggaaataaagaatgagggagctctctatgtgctgatttggaataatctccaggatatattggaaaataagaaacaaaagcaaaagacccacggctcaaaactgtgtgaaatgagtcaaaattagtatttgctgatatatacaaagaaaccctgaacaggtacataaaaatgatcatgacgtcagtgattacttctggggacggagcactgtaggccaaaaaagacagagaaagaaggaagggttttcgctgtattttttttttttttactttttactttttgagccatatgaatgtattatctatattccaaaaatatagaccaggtgcagtggctcatgccttgtaatcccaacactttaggaggccaaggcaggagggttgcttcaggccaggagtttgagaccagcctgggcaatagagcaagaccccatctctacaaaaaaaattaaaaactagccagtcatggtggtatgtgtctgtcgtcctagctactcaggaggctgaggtgggagaattgcttgagctcaagagttcgaggctgcagtaagtgataattgcaccactaaactcctgcctggatcacgagcaagaccctggctcttttaaatgaatgaatgaatgaatgaatgaatgaatgaatgaatgaaaatgtgttcacaaaaggaagtcatcctgagtttcaccaattaaaaaaaggtatccagagatcagatatttctacatcagattttacacctctcccaatcacaacacccattcttaagtggaaaattagagctagatcctctaaaaaattttagcaaagggaacatggttaaattcctattttgtacatcagatgcttttaagtagctttacaaccccctccaaatgctgatattactgaaatgtaaatgattatgttaatagcagctgcatcttaataattgatgatctgtttgcttaacattcagttattacttgatgtaagaagtctctagtgcaaaatattctctgctaatggcccaaataaaattgatcacgtgaggtgaatggtttgtttttcacttttcctattcaaacaccaccgtgtgtgctgagttctttatctgtagataagaatatttcagaatatgtacctgtgacaatgcttttggcccacagatgaaaactgtctgttaggaaaataatgcttgcatcctcaaataaaatggaaaagcctatcaccacttaactcataaaagtttcaacccttaggattattcacagaatggtcaaatcagaagttgagaaaacaccatttagataagaaatatggagagaagtttccacaggcatccaaagggatggtttatgcattccgagatgctatccaggtgtttcagtcctgaagttcttctctgaacctctgtctccccacatacatctgcaaggccacccttagacctgagcaacaggggctcctgtcctgggccactcagtcacctgggacctggacctagccctgacaaaacgcattgattactccaaacacccaccctaatacataacaccattcaggccccagagaagcactgcctcccagatcttgatctctgtcctcaaaacaaaaggcaactgtgcccaaacaccttgaaggttcatgtgcagtactacagcctaaaggagagatgggtactgctctggtgtgcaggggtcacaaaagcacttaggaaagaaaaggacaaattaacttgtcaaatatttcctctcaaatagagtgggtaatagattcttgcagagcagaacataatttccccatagtgctgactgcctgtttcttgcttctctttgtgttctaatttgtggttctagaatcagtatggcatttttgacagttgcatattacggccacggaaaatgttgcagtagaaagaattcatggccaggtgcggtggctcacacctgtaatcccagcaatttgggaggccgaggctggaggattgtttgagcccaggagttcaagaacagtttgggcaacatgatgaaattccatctctacaaaaatgcaaaaattaaccaggcgtggtggtgcacacctgtagtctcagctactcaggaggctaaggcagaaggattgatagagctcagagggtcaaggctgcaacgagccatgattgtgccactgcacttcagccttggcaacagaatgatgccctgtttcaaaaaaaatgtactcttaattatgtatattcataaatctggccataatactgaatgactcttgaaactgacaactgaacagacatagaaaactagaattatgaatagtttttaaataaaaatatgtaataagatctaaatcaaatttcaaaaattaaatttcaactttcatttttttaattgtttaatatttaattgttaatactaacataattttcattgtaccttttaattgtaataaataatttcaaatacctaaagaaaaaataatgttttgaaaacatatacgaaaaataactttaatttttccattttatctttactatgatatactttcttggtgaaaatatatccaaatagttttaatccaataatattttattttgtaatgactaaatcattgctgtcaatagaagcaaattggtagaactcttgattataaaaacattattggctgggcacagtggctcatgcctgtagtcccagcaacttgggaggccaaggcgggtggatcactggaggtcaggagtttgagaccagcctggccaacatggcgaaatgccgtatctactcaaaatacaaaaactagccaggcatggtggcttgcacctgtaattccagctactctgaaggctgaggcaggagaatcacttgaacgcaagaggcagaggttgcagtgagccgagatcatgccagcctgggcgacagagtgagactcggtctcaaaagcaacattattagtgactttgataaaattaaagccagagaaagaaattttatgaaatatctaatttgtgaattatatgtgtcttttttcttttattcatccaaacattgccagccagtccaccaacagaatatccaaaaataacaggggtttaattgagtgatgtttgatattgtgtcaacttccagtaacattagagctaaaccttagctctattgtatgttttaatcttatcattatggagttttgccaaggtaagaggatatgacatatattggtttatgcttaaatgtgtaaacatacagtacacaagcctccattttttttgttgttgttgttgtttgtttctttgtttgtttgtttgagatagggtcccgctctgtcgtataggctggagtgcagtggtgcaattcggctcagtgtagcctcaacctcccaggctcaagagatcttcccacctcaacctcccaagtagctgggaccacgggcatgtgccacaacgcccagctaattttgtttattttttgtagagccaaggtctcactttgttgcccaggctggtcttgaactcctgggctcaagcaatcctcccacctcaacctcccaaagtgctgggattacgggcatgagacaccgtgcctggacagattgtacactttaaatgagtaaattgcatggtatgtgaattacatcgcaatgctgtaggaaaaaagagagagagagaaagaaacaaacatccgcaggagaagcaaggataatcaaatgattttgtctttgttgtaggtcggggggccgcccaactttgtccttggcctgattccccgctggctgtctgcctcctgatgtcagaactccccaccctgggaagaggggaaaaaactccactctaacctcaccacaatttaacagaaaattaaactgaaatatgtgtgtgagcattaaacctagcccagcacatcatctcccgcagattaaaaagagccagcgaaaatgaaatattgttctctaagctaatatgtaatcttcatagacaccatcttattaaagtttgagaagccatgccttgagggtaagcccacctatcgatttacgggcctggctggaattcctgctattaggtctctcatatttgttttgctccctgtcttgatgccagcactgtctacctccacctccccactcccaaagctggccccctgtaactctctaaaatctccctccttggactaggggtggggaccactttccctgccaacgtcaggcctgtgcgtattaacggggccgtgcgcttggatttgatggaagtggcagcttagacacataagctcctcatatacagatgaataatcacagataaaaactactttcaaatatgattaggctctaacagagacagacagaggccagagggaacgcagctctcaaagagcaaggagctaccggcatccgaagcccagaataggagattaaggcctctacaagaacccctgggactttcctagggaaaatattacagtgattcgcagcatcctctgctcctcctctctttcctcgggacaccgtctccccgtcctgaagctttgtgctatttctttccgtgggctgtcatttgcctctgggaacaggacagctcttcccgctgtgacttctcgactctttaatccaggccgcctgtcacggaaacgcacgtggaaatccagcagggtttttatttaccatgctttcttctcacagatgataacatgtttctttactgacaggcgtgcttgttgcctgtgtccccactgtatcccaaccccatgataacagctaaaacacgagaactatgtaccagctacttcaagccctttcaaaatattagcttagtaaaccttcatcataatgatatgagctacaaactatcattatcccattttacagatggggaaattaagccacagagagggtaaggaatttgcccagtgccacacagctagggagtagcaaagttgggatttgaacccagacatcctggcactaggaggcccaatccttaaccatgaagccatagagtctctcaataatgactatgtctcgtatgtcaactacatgttaggccctgttctgagagatttgttgcattaacacattgaatcctctcaaaaagttgatgaggtagatatatttattatccccatttcacagatgaggatactgaggctcccccagaagagcaggaattttgtattgtctgcctctattctgtttctggactgatgaatagcagttccttaaataccagagtgaatgtcctcccatcaaccactacccttttcccaggagcttctcaggacatttatttatagctaacctattttgggaaaagatttgaggcatgtagggttctaattctggctctgtcacttatgagctgtgtgactttgggcaagtcactcaacctctctgggcctcactttgctcagtttagaccagggataataataaagcccacatcaaggagctggagtgaggattcaatgagatagagcaggtaaggtgtttagcatctgtgtggcacagaacaggtataaatgctggctgcctttactgttactactgtcagagctattgtttaccactgctacaggccaaaatgagttttaaaggggtgaaaaaatacaataaggggaaataagggaactaagttcttgaaattctttctgaactggtgctagggttcccatcctcctggttttcctacctaaccagctgccccttctgtgtcccctaatgcctttcccaatcctaggtctcctctatctaagggatcttatcccctcttgtgatttaatcagctatagaccaataactctcaactatctccaggctcgtacctcctacacctgcctactccatgtcactgagatgtctaacaggcatctcacacagggcatgtatccatcataatacagttgttgaggcttctttcataaaccgaggcctctgagggtcttcccccaacatggctcccacccacagattattcagcctcgagaccttggagtcatcctcaactcctctctttccttcccatccacatataattcaaaccctgggagttctaccttcaaatgtatatgccagctgcaaccactcctcaccccttctgctgacaccacatcatttcttgcatcagatgactttggaagtccccttgctggtctccctcttccactgtgaccaccccattgccaacctactcctgccacagtagcaggcagaatcatgttaaaatagaaaccatcttacctcctttccattccaaagactgtcatggtttccccccacacttaggataaaatcctagctcctccttaggacctacaaagcccaacatgccctgggtctgtcatctctgaccattctcctcctctgtccagcaaccgagatcttcttgctgtctctgaagcaagccacagggactgcactgtcccctccctctgcctgcaacacccttccccacgctttcttcctggtggcttcatctcatcattcttctcttgctcaattgtactttcttggggaagatgattcttacatgaatcaattattattagtattagtatcatttgaaacaaagtcttaccctgtcacccaggctggagtacagcagcacgatcttggatcactgcaacctccaccacctgggcttgagcgatccttctgcctcagcctcctgagtagctggaaccacaggtgtgcaccaccatgcctacctaattttttttatttttagtaaagacgggtttcaccatgttgcccaggctggtcatgaatcaattattacaatggggcttgaaacatgatttttattttattatttttttttagagacagggtctctctctgttgcccaagccagaatgcagtagcacgatcacagctcactgcagcctcagcctccccaggttcaagcgatcctccctcctcagcctcccaaatagctgggactataggtgtgtgctactatgcctggataatattttttattagtagtagtaatgagggtctcactatgtttcctaggctggtcttgaacttctaggatcaagtgatccatccacttcagtctcccaaagtgctgggattacaggcacgagccaccactcctggccatgatttttaattctaccgatccttttacaaggattagttagctccctaactaagagctttcctccttcacttctccctttctctttagacacactattgactcatgggtttttatttctccagtgtgcgacattcagttacatcctttttaccaatgctcaaattgcccctaatttaacctgaccattctatttaaaagagcagcccctaggcttcaactcagtcattcagcattccagcacccagtttaattatttttcatggaacacatcatcatgtgtgaaatgatattattcatttacttctttattgtctgtctctagtcaaatattcattcatttatagtaagcttcatgtggccaaagatattgtcagtctcactcactgtgatattcccagaatccagaatcatgcctgttacagagcaggaattcaataaatatgaagcaaaattaagatgaaaccaggaataatgcccctagatcagggactggccaactccatcccacagccccaatctggctcgcctcctattgtaattttttttttttttttttgagatgaagtctcgctctgtcacccagactgggatgcagtggtgtgacctaagttcactgcaacctccatctcctggattcaagcgattctcctgcctccgccttctgaatagttgggattacaggtgcatgctaccatgcccggctaatttttgtattgttagtagagatggggtttcaccatgttggccaggctggtcttgaactcctgacctcaactgatctgccctcctcagcctcccaaagtgctgggattacaggcatgagccactgcacctggcctgttgtaaataaatttttattggaacaaagctctgtccattcacttaggtatttcccctggctgctttcactaccacaaccaacttgaataattccgtgagagaatgtatggcccacaaagctaaaaatatttactatctggccatttccagaaaaagcttgccaattcctggtctagatcattccaagtgctaaatagggctgacccttcaggatcctattagcatagggtcccattggagccattcaacaagtcattattcatacatttattcaacagatatttattgagcacctactatgtgctgggcactgtgctaggtgttttggatatttacagggatgaacaaaattaggcaggcttcttgcccttatggagctcagcttctagggagggtaggggagactaatataataaccacattaaaaatgaaaaatttccgttgtgatgagcccttacaaaaagaaccttatgtggtactttgagaacatttgacagcagtattttgtccaaactgggatggggaggacagtctaggaagacacccttcaggataggaccccctagtgaataccagaagtgtgagaaggggttagccgggtgaggcagagagtgatgtgctccaggcaaggataggacagagggagcacggtgcactccatgcagtgaaagatggccagcatggctgacctgcaacaggaaagaggagaatgtccaagatgactccagggaggtggccagggccacagcatgcagggccttgagagcacctaagagcagttgcataatgtcctgctctcagggcagctgatgcttgagtgggggctcaaatgatgagaaagagccacgcaaaggaagaccacagagaggcgtgttccagacagagggagaagcctgcatattatgcactaattccagaggggaaatgtacctttgcaatggagaggtctggtgttatgtccctagccaagggctcaaacttggcatcaccaagtggggagcaaagaaatacatgtttcctggcatgatgcaatgtgaaagatatggcatcaccttgaaggattcttgccagaaatgtttcaccccaatcaaatcaagcctctgaaactaatcttcaggacagaagaaatataggggagagaggaacaagttcaataacacccagaggaaacttcggacaaatccaaatgtgggacattctacaagacatctggctgagatttttcaaaagtcaatgccacatgctgcaactttaaaaggaaggattttaagccaatttcatttaaaaggggaagtgagtttggtgttatcctgtggaccaaatctggcccactacctgtttttgtaaataatgttttattggaatacagccatgttcacttgtttacttactgtccatggctgcttttgtatgaaaagagcagagttaagtgactgcaacagagatgatatggcctgcaaagccaaaaatatttgctacccggccctttctagaaaatgattaccaaactttgttatagatttagactaaaaacacctagtgaccaaatgcagtgtgtaagccttgattatatctgggttcaagaagaaagctataaaaatatttttgggccaatgaggaaagcatgaatatggactatatattaaataatatcaggctctattgttcattttctcaggtgtgaaatggtattatgattatgtagtagaagttcctgttcttagacaacgcacactattatttaagagtgaagtaccatgtaatctactttcaggtggttatatacatacacatgcatgcacacatggcaggtggcatcctcagttacccctcaactcatgccaatatttccaaaatatgacatgcacactgctggtacttcctgggctgtttttaggtggcagaagacaggttttattttatttttatttttttcatttactaaaaccaaagaaaactttaatattaggctgggcacgatggctcacacctgtaatcccagtactttgagaggccaaagcaggcagatcatttgaggtcaggtgttcgagactagcctggccaacatggtgaaaccccgtctctactaaaaacacgaaaaaaatagccaggcatggtggcacacacctgtaatcccagcactttaggaggccgaggcaggcggatcatgaggtcaggagttcaagaccagtctggccaacatagtgaaaccccatctctactaaaaatacaaaaaattagccaggtgtggtggtgtgggactgtaatcccagctactcgggaggctgaggcaggagaatcgcgtgaacccagaaggcagaggttgtagcgagccaagatcacactattgcacttcagcccaggcaacagtgtgagactccctctcaaaaaaaaaaaaaaaaacaaaaacaaaaacaaaaaaaaaacctttattattaattgctaaaagagtagattttaaatgtcttcaaccctccaaaactaagtatgtgaggtaatgaatttttttaacttttactttaaattcaggggtataagtgcaggtttgttacataggtaaacttgtgtcacgggtgtttgactatttcatcacccagtacctagtactcattagttatttctcctgatcctctccctcctcccaccctccaccctctgaaagggtgtgttgttcccttctatgtgtccatgtgttctcatcatttagctcccacgtataaatgagaacatgtgacagctttcattttaatagttatgtatttattcttctgattagtttccatttctgataagtgatactggcttcccacttattgtaggaatataaggtcttcatttcaaataaatatatttaagtttaaagcaatatgagccaactaaaaaggaaatatgaagcagacactattataaggcaaggcaacaaccaagaaaggctgaatttggataaccactttgccttcaaagcattgatcatagtccatgattactttgttttttgtttttttgtttcttagatacaggatctcactctgtcacccaggctggagtgcagtggcgtaatcatagttcactgcagcctcaacctcctgggctcaagctattttcccaccccagcctcccaaatagctgggacttcagggatatgccaccaccatgcctggctaattttttctgttaggtagagacggggtctctctatgtttcccaggctggtctcaaactcctggccttgagccatcctcccacctccacctcccaaagtgctgggattacaagcacgagccatcgcacccagccaaagattaccttgttttaataaacaaaaacaacacctgtttactgtccattcttctctcattggattgcaagctaaacaggctccttgatgctctcatgtgatgtcacataccagcatagtgcccagcatacaacaggcaatcaatacatgtctgaaggcagagtgatgaaagtaccatccccaaccagaatccctaccatctgaccaagaaacaactatttgcaggtagggtaagaattactcatttccctccaatcacaggatacataatgacagttgattcctgaaacacaagataatcctaataactatgcacattttaacatttctaaataaaagttcaagctggctgggtagggcggctcatgcctgtaatcctagcattttgggaggctgatcgcttgagctcaggagttcaagaccagcctggacaacatggtgaagcttcgtctttattaaaaatacaaaaaacttagcaggatatggtggcacatgcccgtagtaccagctactcaggaggctgaggtaggaggatcgcttcagcctgggaggctgaggttgcgatgagttgagattgcgccactgcactccagcctgggtgacggagttagaccctatctccaaaaaaaaaaaaaaaaaaaaaaaatctgacaaattactgaataagacatatgaggactctgtgagactttctacatagagacatttgcagatccaaaaaaagcattttgtctaaggctacctggctgcatttctgaatgagaggttaccattcctgcatttttctttcaggacatataatctctgcatatataaaggacccatccctggccccatgctcctggggcagccaagattccaggggggagctaaaacacatctactgctgacttcgaggtcaaactctcccaggtaaatgcagaccactaggaaagatgaggaccactaggaaatgcctctggatttcatttttttccggcatcatcatgagcctagagatccagactgcttccgacactccattcttttatgtttagtttcctcttctattttctttaccaatgcaaacttttgaagaagatattgctttggggaggtttataagagctgcaaagatctctattaaccatcctttaacagtgagataaagaccagctgtttcactaattgcccttaactgcttgggcttggttattaatgaatgccctcgccttgagttcaaacagcttaattagctaaagttaagtgtttccaataaatttactaacctatgataagctttcctttaataggaaatgtgcagttcttaattaaatagaataatttacaactccacgtctattataagtaatggttgcccagttaccatgttacctaattaggtgatagtgaagtttctccaaaggggaacggagggttacagttgaacatgcccttggacaaaccaatttgttagcagctcaacagtagcggagctatgggcagcctctggcactggcatctgggttggaatgtcctctctgccatgcagaagggtccggctgcctcatctgtaaaatggaaactaactccctgaggggcctctcgggagtagattggatagcatttgcaatcatttaaatgaagaataaaaagacaagttaatacccccatttaatacctctaggggctaggcctggtatatcatgcctgtaatcccagcactttggaaggctgaggcaggaggatcactcgaagccaggagtttcagcctgcacaacatagtgaaaccacacgtctagaaaaaaaaagaattatctagcagtggtggtgcacacctgtagtcctagctactcgggaggctgaggcaggaggattgcttgataccacgagatcaaggttgcagtgagctatgattgcaccactgtactccagcctggggacagagacagaccctgcctcttatacacacacacacacacacacacacacacactctctctctctctctctctctcactcacacacaactctagggtcacatttcttttattttatcttatttttttagagacagggtcttactctgtcactcaggctgaagtgcagtggcatgatctcagctcactgcagcctcaaactcccagagtcaagccatcctccacctcagccccccaagtagctgggactacaggtgtgcgccaccgcgcccagctaattttttgtattttcttagagacggggttttgccatgttgcccaggctggtctcgaactcctgagtccaggcaattaacctgcctcagcctcccaaagtgctgggatacaggtgtgatccaccacgcccggcgggtcacatttatataggcaaaattattccaagaggagattagtctggataacacacacaaaaacaaactgctccagcataatctggagaaggcatccagcaaacccagatcggggaactttctacaggatacctggccagcacatctcgaccatcaaagccataaaacgtaggccgggcgcggtggctcatgcctgtaatcccagcactttgggaggccaaagcaggcagatcacctgaggtcaggagttcaagactagcctggccaacatggcaaaaccctgtctctactaaaaaaatatataaaaattagccatgcatggtgatgcatgcctgtaatcccagctactcaggaggccaaggcaggagaattgcttgaacccgggaggcggaggttgcagcgagccgagatcacaccactgcactccagcctgggtgacagaacaagacaccatctcaaaaaaaaaaaaagctataaaaaataatgaaaaactgtcacagacaagaaatgactgaggattcatgccaacaaaatgcagtgtggcaccctggattggatcgtaaaacagaaacagaacatgaatggaaaagtgaaagccatataaactctggaggttagttacaagcaatgcgccagttcccatctctgagtttagacaaaagtaccatggcgatgtaaggtgttagcagaggggaaactgtggtgggggtcaggggaggatttagcagtcaggttaagcaggtcatactttgaattttgccatggttgaggactacatttaatccaggcagagtgatttcaatagttcatctgaaaggatatcagctattaatgaggttggttattattatctgtctaatggataaaaccttattagacctagaagaataaaaaattatttgctcaaagtcacatcactggccacgtgcagtggctcacatctgtaatcccagcactttgggaggctaagacaggaggatcacctgagcccatgaattcaagaccagcctggtcaacatggacccagtcactacaaaaaatacaaaaaaaaaaaaaaaatagccgggtgtgttggtgcatgcctgtagtcccagttgctcaagaggctgaggtgggaggatcaattgagcccaggaggttgagactgcagtgagctgtgatcgcaccactgcactccatcctgagagacagagtgagaccctgtctcaaaaaaaataaaaaaaaaataaataaataaaatcacatcactattataagtatcatttgcatatcataataaattccaccatcacatatttgggcagagccttgaacattttcaaaaaagctttcacatcatccagtgaaattatcacacaagctgtattagtccattttcatactgctataaagaatggcccgagactgggtaatttataaaggaaagaggtttaattgactcacagttcagcatggctggggaggcctcaggaaacttacaatcatgacggaaagcaaaaaggaagcaaagcaccttcttcacaaggtggcaggaaggagaagtcctgagcgaagaggggaaaagagccccttataaagccatcagatctcgtgagaactcactcactatcatgagaacagcaaggaggaaaccacccccatgattcaataacctccacctggtctctcccttgatatgtggggattatggggattacaattcaagatgagatttgatttaggtggggacacaaagcctaaccatattacaagccctggaacaacaataagatggaattttgatctccatttatctgatgaagcccaggtaatttgggtttttttcttcttctcttttggcttaatccattctccctccacatcagaccacccttcctctttctgttaatcctcattgacaatttagaatacatccttccaaatttgtctctatactcataaatcacacacaaatatatgtattcacacacagtatataatacataggcatttgtcattttatgcacgcttccgcagctcccatttcctcattctgcaatatgccatggaaatccctccaaggcatctggtattgctctaattcatcgttttttaatagctgcagaaaattccatggtgtggatgtcctgtaatttgttcaatcattaatgggcattcactcgtttctccctctttggctactacaaacagtgctgcaataaacatcctttctacaaacatccttatgtaccatggcctttatgtctacgagatagaggcccaggatggggattacggggtcaaagagtatatgtatttctctttaactatttttaaaagagcaaagcaagagaacagggtagtagatacctctagagaaaggcggagaaggcagagaaagtggactagagagaagcttgcaggtggcttcaacagtattggtgacgactgcattcttaggttggaaatgggttcattttatcattattctatataatttatgtgtcttattacctatattatttgctatatatccagtcctatataatttccaaaaatctatatattttatgttaataaatgtggccaaaacacagctgaaataattctcattcccatcaacaatataggtgagattggtcttttccattttttttcccagcctgagagggatatctcactgttactttaatttacatatctctgacactggtgagtttgaacatctttaataaatgtatcattcatttcaatgaaataagtgacattttaaatcatctacaaaccctttcccattaagtaaaaaggggaaggctgatcttcactccttttcatcttacccctctaaaagataaagctcagagtttttaaatgccacaacaacaaaaaatcaacatgaattggttctcttttatctaaagttcaagatgccatgacgtcaaaatgcatgatgacatgcgctctcctcagggaaatccccaactggaacctcaaatcccctaaaactctgggcacaaatgtttctttcctatgagaatcaatgagactagcaggtcatggccgttggcaaggtgactgtgtctttttcagaataagaggctacctggacgcattgtgggagaacatgcaaccttgtccctatctagcctggctggtctcctaccctcccgttttctcttccctcccttacaggtccttaccctgacctgtaagttgacattttgacaaaactagaatcaagctcaactcctgtctctgctccttccttttctcactttacagcccaccacagacatgtctttggaaaaatagccagagatctaatttgtttttaatagccacataacatcacatagtatagctatatcaaattttatccagtcatttgctgttgacagacagtcaggtcgcttccaaaatgctctggttttcatttttgcaaacagcgtggtaatatattttcttgtatgtgcatcttttatcattctagaccagattcttcccccttcaactatatatatttaaccttttcaccataccttcttcgataccaaatgtatcgactttttttttagttggttggttggttggttgagtttctttggaccaaatttaaggggttgagaatgaaagggggaacttcactgtagtactagcttccctatctatcctctacataacagtcacttgtaattttatagccagaacataatttgtatagtttcccctccttctgatcaactgatttagttgttctttttcctccattctgaaattagctattacagagccataatataattttttaaatttcaaatcctctttaaacaattgatttcttgttgctatttgtaggcaagaagttgaatctgatatgagccctgccagaaattaatttacagtgttagagaaggattatgacatatataaatgagtacaattttaaaaaggtaaatatcacagtgtaaatacaaactcatgggattcagagataagggagatctcattttagacagagagatataaaggcaactggaaagacttggctttggagttagttaggccttgggacactggtccaattttgacatatggaaatagatggaaggaaaagaattagaaaagaacagagcaacaatgtatctttatgtgacattatgatttataataagaaatatatatatctttatctccagttcctggcagatagtgcctaaatcccttgcaatttcctgggcaatagagatgttaggagcatcttttgttccaatatttggtctttaaccctggttcctgccacagagttcctaatcccttgcaattttctgagtgatgggagcatctcttgttctaatatgggaactctcaatggggcttctgggtgggggctggtcaccagaaagaccaagccaagaatagaagcttggaactttcatccccactcccatcctctgagaaggatggagagaggctggaaattgacttaataatcaatcatacctatgtgataaagcctccataaaaatcaaggggtttgaggagcttctaggtttctgaacacatggagggtgtcttacccatacaggatgtattagttcatttttacactgctaataaagacatacccaaaactgggtaatttataaaggaaagaggtttagttgattcacaattccacatggctggggaggcatcacactcatgacggaaggcaaaggaagagcaaaggcacattcttacatggcggcaggcaagaaagcaggtgcgggggaactgtcttttacaaaaccatcagatctcatgagacttattccctatcacaaaaacagcatgggaaaaacctgcccccatggttcaattacctcccaccaggtccttcccacaacacgtggggattacgggagctacaattcatgatgagatttgggtggggacacaaccacactatatcagaagacatggaatctccacagcccctctccccataccttgccctgtgcctcatctttttcatctggctgttcatctgtatcctttgtaatatcccttataataaatgggtaaacattaagtatggtgatttcctgagttctgtgagccactctagcaaatcattagggagagggtggtgggaacccctaatttatagccagttggtcagttccagaggcccagacttgctattggcatctgaggtggaagcagacttgtgggactgagtccttatcttgtgggatctgactccaagtatataatgtcagaattgaactgaattagaggatacccagttggtacccatgggagtactgacatgtaaggaaaaccccacccatatggtcacagaagtgcatggagttgagtaagtgtagtaggaaaaaacagtcaatttgcttttttttttttttcctactacacactttcctttttaaatttctggccaggaataaaatcaaataaccaagaattacaaatattcattgattatgggtgactactgttgaaatgcatgcagggtaggacatactccatgaatacattacaaatgcattcatgtcttcattttctgagatatcagtcatttcataatgacagggagataaaataaggcatgactctgctgggtgtggtggctcatacctgtaatcccagcactttgggaggctgaggcaggaggatcacttgagtccgagagttcaagaccagccttagcaacatggcgaaaccctgtctctacaaaaacacaaaaattagtcaggcgtggtggcacacgcctgtagtctcaactactctggaggctgtggtgggagaatcgcttgagctcgggaggtggaggttgtagtgagccaagattgcgccactgcactccagcctgggtgacagagtgagaccccacatcaaacaataataataataataaggcatgactcattttcttggtctagctagattacggcgttacacaaaagtaaaattagtgtaatattaaaagaatcaagaaaaaagctaaaacttgtttcaatgaacttcattcattcaataaatactagatattgtatgtacaagaggcaacatggtgagagagacagcaaaaccaccacgcagaatgaggtttatagcccaatggggagcttgggaaagcttacagagcaataaaattaaagtttgtcaccacatcccagtcttcatttctcactattattctccaggaaccatggctccttggagaaatggctgtttgtggtctgggacagagaaaatacaagatgagcctgcagcatcttgtagtgatgaaaagtaaagacgtgctttaaaaaaacaaggggacgggccaggcacagtggctcacgcccatcatcccagcactttaggaggccaaggcaggtggatcacttgaggtcaggagttcaagaccagcctagtctctttagtagagatggtgaaaccctgtctctactaaaaatacaaaaattagctgggtgtggtggcagacacctgtaacccagctacccgggaaactgaggcaggagaattgcttgaacctgggaggcagagtttgcagtgagccgagatcgcaccactgcactccagcctgggtgacagagcaagactctgtctcaaacaaacaaacaaacaaacaaaaaaaggaagggacagcttatcacaggaatgcaaggcccaaaactcactatgattaaagctggaacaatttgagcaacaaaataaataacacagtgtaaggttaaaacccaaagtataaaataaatgattgattgaataaattaatgtactggggtaaaagaggcaagtcttcctaacaaagaactttaaataatatctgtagacaccccacacttaccgattccactccttttgagtgtaagcgggtcttagtaactggcttccaataaatatggagtatagcttgagtctagaaaagggaaataggaccaggtgcagtggctcatgcctgtaatcccagcattttgggaggctgaggcagaggacagcttgaggccaggagtttcagaccagcttgggcaacatagcaagaccttgtctctacaaaaagtaaaaataaaaaaattagctgggcatcctagtgcacacctatagtcctaactactgaggaggctgaggagagaggattgcttgagcccaaaggtcaaggctgcagcccagaagggcttccagccaaggccttcctggctcttttttccttgggatgggaggccagggaaggtaaaaataactggataatgttgctagaatcacaccactgcactccagcctgggtgacagagtgagaccatgtcaaagaaaagaaaaggaaaagaaagagagaaggggagagagagagagaaagagagacagaaatgaagaaagaaagaaagagagagggagagacagagggagagagagaaggaaagaagacagaaaagaaagaaagaaagaaggaaagaaagaaagaggaaagaaagaaagaaagaaaggaagaaaagaaagaaagaaagtaaggaaggaagaaggaaagaaagaaagagaaagaaagaaagaaaagagaaagaaagagaaagaaagaaagaaaaagaaaggaaagaaagtgggaaggagggagggagggaagaagggaaggaaagaaagaaggaaagaaggaaagaaggaaggaaggaaggaaggaaggaaggaaggaaggaaggaaggaaggaaggaaggaaggggacagtggagaggcctggcagacactgctttaattccacaatcaaggtcagcatcagtgataggccatgttgatagcatgtacctctgtgcaattcctcctaaaaatccattattccagtctaaatcactaggaaaaactttatacaacccaaactgagcaacattcaacaaaatacctgaccagtcctcctcagaatggtcaagttcatgaaaaacaaggaaagactgaaaagctgtcacagaccagaggaggctaaggaggcctgagactaaatgcaacggaatctcttgcacagggtcccagaacagaaaaggagcattcgtggaaaaactagaaaaataaggtccggagttttgtataaaaaaaaacacataaaaaataaagttgagtagatgctatttttaaaaagtacaaggtgcaatgtgtctgctaaaaattcaaataataaaagttaattgacttttattattattttatatttattgtgtttttaatcaaaaaatgagctttgtactatatgcacattaaggctgggcgcagtggctcacacctgtaatcccagcactttgggaggccaaggcacgcagatcacttgagatcaggagctcaagatcagcctggacaacatgacaaaaccctgtctctactaaaaatacaaaaattagctgggcgtggtggcgtggtggcatggtggcatggtggcatggtggtggtggtgcactgcagcctgggtaacagagcaagactgtctcacgacaaaaaaggaccagttaaacaatacaggaagatacagagacaaacttaacccttcccctgcccaccattattctccagccagtcctcttctagataagcagtttgtgttgttttctacaatctctttgtgtttacgtgagaaacacagaatatatataggagcttttcctcttttttcacgttttaactacaaaagtattatcttactactcattgctctgcaactggcttctttcatgcaaaaatatattttaacactgtatcataaatatcttcccagcacaatgtatataaattgaacctgctctttctttaaatcaactttgctgggataaaatttatacagaataaaatgcacccatttgaagcatacacttattatgtatgcacagatgtgtagacctggataaccaccagcacataacttattatttttaaaatcaaagtcatcaatcatcttgccaaatctagtgaaatttcctggctcttctttctttggggtaggaagccagggaaggtagaaataactggataatgttggagaatgaccattgcaagactttgctcctcacatcccaggtgcatattccaagaaaattctgattccccgggaaaattctccatgcttggcatagtgctggagccatgtgactttggaaaggtctgagggaggcatttaggcagagactcagctggggaaatcactggggggccctgcaccaacagacaggcgcccagagctgaggaggaatggcagcggggcctgctgagttaagcagaggccacagacatcaccttctggaggctccctctaccactgctccatgggcaagcctgctagatacccagaaacaagacaaaagtgctacactgcccaggatttacttttaaagatgccaaggagggggctgggcatggtggttcatgcctgtaatcccagcactctgggaggtcaaggcaggtagatcacttgaggtcaggagttcgagactagcctggccaacatagcgaaaccctatctctactaaaaatactaaaattagccaggcatgatggtgcacacctgtagtcccagctactcaggagcctgaggcacgagaattgcttgaacctgggaggtggatgttgccatgagccgaggttttgccactgcactccagcctgggcaacacagcgagaccttgtctcaatcaatcaatcaataaaatgaaataaaaataaagatgccaaggagaaagtgtgaaccacagacttcctcccaagctgtcccttgaacctaggcaccatctgtagaagcaagacagaaaaggaaggaatagccccaaaagagagttgaatgtttaaaccagctgaatatttacctgaaaaaaagattgttttatgggagggtaaaatgggaccactcaaaactttaagagaccgagacatctctaattggcaagtttagctgttttccttgttccttggcaggacagggacctctcaggaaatttgatttggttagattgggactttgcaatagaattataatgcaagccacacatatactttcaaattttctagttgccacatttaaaaaaccaaaagctggccagtggctcgtctgtaattccagcactttgggaggccaaggtaggtggatcacttgaggtcagaagtttcagaacagcctggccaacatggtgaaaccctgtctctactaaaaatacaaaaattagctaggcatggtggtgcacacctgtaatcccagctactcgggaggctgaggcaggagaatcacttaaacccgggaggcggaggttgcactgagctgagattgtgccattgcactccagcctgggcgacagagtgagacccgtctcaaaataaataaataaattaattaattaattaaatagcaaaaactataggacccagaaatcccactcctagatatatacccaagagaaatcaaaacacatgtccacactaaaacttgtacatgcatgtttacatcaggattattccccagagccaaaaagagaaaacaaaccaaatgttcatcaacaaaatgtagcatataatagaacattattcagcagtcaaaaagaacaaagtacctatatatgctacaacagagatgaaccttgaacacattatgctaagtgagagaagacaaatgtaaaaaaccaaatattacagtatatgattccatttctgtgaagtgttcagaataggcaaatccaagaagacaaagattagtgtttgcttaaggctggaagggttggagaataattagaactgagaagagtatggggcttttttgggagatgataaaaatattctaaaattgattgcagagataatcacacaactctttgaatatactaaaaatgatcaaattgtacattttcaatgttacgtgaatatctcaatggagctgtaattttaaaaagcaaaaagatacatacagcattaatttataatattttaagtcaatgtattcaaaacgttgtttcgacatagtatcaagaatttaaaattatttttgagatagttacattcttttcttaaaatctagtgtgcattttacatttgcaacacatctccatacagatgctaaattttcattggaaatactatatagttagatttcataaaatttaccattgaaagagtaaattcatacgcacaagttgttccaaaaatattttaaagtcttccaacagctgaattgagtagtgttagtgaggtagtttctagatatagctgtagatataaatgggtaaatatagttattcagcacagatacatactcagagtatggtatgttaaaatttaactcctactgtgaaaatggaggtcattacgttaagtgaaataagccaggcacagaaagacaaatatcacatgttcttactcatatctgggagctgaaaagttgatctcatggaggtagagggtagaatgatagataccgaaggctgggaagagtgtgtgggtgggggtaatgaagagagtctggttaatggggacagacatacagttagatggaaaaaatcagtactgcagttcaacagcatggcagggtgactgcagttaacaacgatgtgttctatacttcaaaatggctggaagagaggatttgagatgttcccaaaacaaaggaatgataaatgctcaagataatggatatcctaaataccctgatttggtcattacacatgtgagacatgtaacaaaatatctcatgtgtcccataaatatgtaaaaatattatgtatccatttaaaaattaatctctactatatacaccaaaaacaaaactaaattcctcatatggcctcaaaaccctacaacatctgccctcacctcgctctctaatctcacatcatatcactctccttttcttccacaatgctctagccatactggtctttctactcctcattcactccttccccagggcctttgcacttgctattccctcttcccagaacaccttccaccaagatcttctcatacttggctccttcccatcattctggtctctgctcaggagtcatcatcctcagagagttccctgtcttgttcagtgtggtctccatccatcactctttaacccattattctctttttttgttgcatgtatcaccaatggattgtctccttgtggttacatttttggcaagaatattgtacaggcattgtatgaggaagcatatgatgatcagcttgattactcagctaagatggtgcccacatatttctccactctgaaggtgccttactatgaaataataagttatctgtggggaaatatttcaagactggtaccatacccttcccagcaatattccatattccatcttactctgtcacccaggcaggggtgcagtggcataatcatagctcactgcagcctcaaactcctgggcttaagagattcttttgcctcagcccccaaggacatgggactataggtacacaccatcgtgcccagctaattcttttttttaaattttttgtagagacaagctcaggctggtctcaaactcctggcctccaatgatcctcctgcctcagcctcccaaagcgctgggattacaggcataagccactgcacccaacaagagtttgagtttctaagtctaattccttctacatttattagttgacattcttcagtaaataagctcattcccttctctctcccttgtctttttttttaatatcagtataaattcagggattccatgtgttgttttccatttctgtcattattaatttccatgcttagattaccccagatttggaaagcccaatctgaatattttgaccctgattttcaagttggactcccttcaagctggctcctatatcattgcgacatgcccctgtcattttttcttaccactccatacattctgatgagaaaaaaaaatttaggtgtaccttgtagttttcctgccccagccctggaatcagccatttctccaatggctaactattaatgcacaatggtatttaagaaccaagatttgtcacacctgtaatcccagcactttgggaggccaaggcaggcagatcacgaggtcaagagatcaagatcatcctggccaacatggtgaaaccccgtctctactaaaaatacaaaaattagctgggcatggtggtgggcacctgtagtcccagctactcgggaggctgaggcaagagaatcacttgaacccagaaggcagaggttgcagtgagccgagatcacaccactgcactccagcctggcaacagagtgaaactccacctcaaaaaaaaaaaaaaaaaaaaaaaaaaaaaaaaaaaaaaaagaaccaatatctgagcattaggcgtgcccattcctactggtatgccatgcaccaaggaaacaaatgcactcataacaaacagggcctgggaagtcaggtccaggcaactgtgacatcaacaggattcaatattgaaattaagtcttattctccaagtggagaagacatttgttggttttagttgcccagcatcgaatcattcttctggtaacagcaccccttttttccttttggagaattacctctcccttctgtgaagagacatggcgaactgtaaattaaggtatcctaaccctctccccatatccaaaagggaggcactatttttctaaatcagacaggtccctgatttagggatggagtgagacaggtatgaggataagggggtttgaccacatatccagaattgacaaagccaagtgcccttcaaggtgaaactgaacgcccctttccaaggtctgttggcctctcatttggtgcaaggctttatctcacacagctaaaacttccctgtctttgtagaaaaattctaacacaacagagcccatcttgaatttctttccccaggattggttgtttcattcatcctttccaattcatagaattcagttgttttgacaaatgtctagatagctagcaatatattttcatctccttcgaaatcctcacaacagatatgctgcttgtaaatctgcgagggttttttttctgaggaaaatcttctaaaactttgctcatcttgtgtcaatccctgcagggtttctttatttgcctgcttgctggtttagtggggagaaaaaaaaaaaggctgaaatcctaattttcacaccttcaaaatgcataagctctgtctacctttcatttttctttctttgaattttttccctctttaagtccttgttttctttcttctccagcacatggtgttaggcaaaatggcagatatagatgaaaagatggaagagagggaagagaagggaagggaagggaagggaagggaagggaagggaagggaaggggaaaggaaaggaggggaagggaagggagggaagaggaggggaggcaagggaagggaaggatgaaggaaaggagaaaggggaggagggcaggagaaagggagggaaaggaaggaaggaaaggatgaaggaaaggagaaaggggaggagggcaggagaaagggagggagggagggagggagagaaaaatcaaagaaaaatgcttaacactccccaatgcttcataatgcaagaacacaataaaatattttgcatctttcaatgcctgggttttctgagtcatccaacactctgccattggacttgtttatatcaaaaggagttaatcgtcatgtaatgccattgttctgggggagaggaagacacagagaggcaaaaatgatgaatgccacttgtctctctaaatgagtaacaggggatttgaactcaatatgagctttgggaataaacgtggtaaacgtggttatttcagggttacaggagagaccaacaagcaaagtctaagggcttctttgcctgccctgcccttataaatctgaacttataggacaagatgggtggaagttgagtctcaggtgatgagttcagctatgtatggaaagaaataaagcagcatagggaggagatgttctgtaaaagttataattggtttttctgaagtttggagcaatagatgtacaatcaagggccttgcttaatttcccactcactaaaggcacttttagctcatcaaacatttactgagggtcagtgctatctgggaaggcaaaaataatgcagctctcaagtttttgctcataaacaagcaagggaaatggcaacctatcccctcacaaatgtaatagtttaggtttgtgttgtacaatgtttataaccaatggtatgctacaaactcttctaggtgcactgccaagtttgggtccttgtgcaaacgttattgtttgggttttttcatttgtttgtttgtttctacagctgcgggtacttactgctagtgattgttgtatgacttccgttgagttgcatgggtcatgtgagactgcaggaggtggagtctagttgagacaagtaaatacaagtgtagcaaaacatcaagagagccaccagaaaagaccatgtttcctacattcttgctactaaatgtgatacctgcagcatgggtatgacctgggagtttgaggaaaatgcagaatcaatctccagtcctgcgtcagacccagtgaatcagaaactgcactttagcaaggtccttgcatgtaaaaagagaggcagtatcttccagtatagaaaccctttctcatatggatgtataagagatcttcgtcagggcattaaacagcccaattgacatccaaggctcagccaaatgatttgtagataaaatgtaatatttgtattacattaatatataataatataatttacatttataatgtattttgtataacattaatatataataatataaaaaataatatatatataaaatataacctcttctagtgccttgctacggttcctaacgtgagagagaacaggcgcacattcagatagctgagagttacagtttacccaacgctccccttatatcaccacctttgagacttgccacatccctacaaggcaagtggtacaggctctagtgccacatccattttacaggtggagaaactgaggttctcagaggtgaagaaccggcccaaagtcacatgactcgaatgagatcccactgggacttgaacactgattgcctggcccaggaaaagagaattcttttccagctgactctgaaccagtgtaataaagaccaggctggttgtctgactgaaaagaaacggggttgggaggatgaggtgggaggatcacttgaggccaggagttcaagaccaatctgggcaatatgacgagaccccatctctacagaaaattaaaatacaaaaaatagccaggcacgatggctcacgcctggagtctcagctacgtgcaggttgaggtaggaggattacttgagtccaggagttagagggtgcagtgaggtaggattgcaccactgtgctccggcctggacaacagggcaagaccacatctctggaggggaaaaaaaaggaaaagaaatgttcttagtagcgcagtgacctatgctggtaagaaagcaggatttctctaatggggagctggacaaagtagataagctgacataatgcaggaagcttcagataccagatcctgagtgtggagctccatgaagaatccaccttcacattcatcaccttcctaggtacctggggggtgagacgaagtcatcagaccatcccactgaggcctagaaaccatccaggataacgcacctcccttaaatctaggacaggtgccttcttttgacaataatggccttttctctcctcagcagggtgactgaactctttcttcatctccaggagggactggaaaaaaaaaaaaaaacagatttagggcttcttgctgatataaaccaacttgacggaaaacccattgttcagccttgtttactcagccacctgctaacctgattgtggtcacttagggagaagttccccacagagaaactgaagagctttgcttaaagtaatcaacagagaccttgggggctcctacagacctcaggagcacagttttagcaactgtgcctaggaacctttttcctttggtcctaatcactcctcctgacatcatctataaaaccgcggagcctgacgggcttcagtaaaagggtccatgtggattctgtcatctggggcaagactggaggattcagggcactgtgtaggtaggtcaccgttttgtggtgacttgaacactgactgcaagtgtaatgcagcttcacccttttctcaccttcctcctggggccactaacttcatggggaagtccagggtaggacagcaagaagcagaattcctgggttgatgcccaattaactcaatatgtcactagcttattttggcctatcctcagggcaaattagaaagcaaaagtctcaagggacgtcttggtgttgattacctgacacccaagcattgacaagctatgttcaatgcattatgctactactactaataataacaggccaggcacagtggctcatgcctgtaatcccagaactttgggaggccgaggtgggtggatcacctgaggtcaggggttcgaaaccagcctggccaacatggcgaaaccctgtttctactaaaaatacaaaattagccggacgtggtggcacatgcctgtaatcccagctactcaggaggttgaggcaggagaatcacttgaacctgggaggtggagtttgcagtgaaccaaaattgtgccattgcactccagcctggtcaacaagagtgaaactctgtctcaaaaataataataataataaatataatttaagagccctcctgggcttgcagaattaagattggccagtgtctttctcatacacagaagcagacaattttgcatcattctgttcctcccattcaccccaatatcaattatgtcctatgctcatgtttcagaaaccagtggtatcagcaaagcagaaaccactctagatatttcaaaccaaggagttaggtataaggtttggagatggatggaagagcaattggaaaagtgggtgggtctgaggagcaaaaagaagacgtgataaccgtagatcaaaaactgctaatgggctgggtgctgtggctcatgcctataatcccagcactttggggggccaaggcaggatcgcttaagcccaggagttcaagaccagcctgggcaacatggggcaaccccatttctataaaaataataataataatttgtttaaaaaaataaaaataataaatttttagaagctgctaatgctcctaggctggaacccatcagcctccatctaacattgtgccattgaagacactgctgataaatcagctctgaatttatcagagggccacctccaccagggctagttctgctaagtgccgcctctgcctagaatactggaatctggaatcaccccacctctgttcctgctgtaactacagaaatttccctcaaatatccagaaaggatcacggctgggattcaagcccagtattgtgattctagaactcacatgcttaatcactacaataggacaaacaaacaaaagattttaatgtaagtataactgatagcttcaaagagctaagagcagatcatgtattctataaacaagaccaatctgacatggaaaagaaccacacctagttgcaacagggtgcaatttcagtgagaacagagtattctaaaaagttcctaagagaaaaaaaaaaaaaaaaacctcactaagggatgaagtagcagatcggtagcatattcctcgttggtaacactggatgctagaaggccacacaggcgttttcaactcggagactttctgaaagagcgtacgttgttgttgttgtggttgttgtcgttgttgttgttgttgttgttgtggttgtggttgtggttttggttttggttttgagatggagtatcgctctgtcatccaggctggagtgcagtggtgtgatctcagctcactgcagcatccgcctcccaggttcaagcgattttcctgcctcagcctcccgaagagctgggagtacaggcgtgcaccaccatgcccggctattttttgtatttttagtagagacggggttttgccatgttggccaggctgatctcaaactcctgacctcgggtgatctgccagcctcagcctcccaaagtgctgggattacagacgtgagtcaccgcacctggccagaaagagtatactttggaaaaacagacaaaatctaaaattgttttcagtaatattctgcgaggggagtagggaaggtgggaaagggttgaaattacctgttgtgtactatattcattgtttgggtgatggattcaatagaagctaaaactccagcattatgtaatatgcccacgtaataaacctgcacatgtaccccctgaatccacaataaaaataaataagtacataaataacattctgaaactaaagttccagatcatttcaacgtaggaaatagcagcagatggctaaggtagagaagtgaaaacatgctgcttgttcttttgctccggatgaaatcctaattaactctatactttgaaagaatagtatgtttcataatgtgtttaaaatgtcaaagataattgccaaagagacagaactagcgtgcattacttccaaaccactgaagaaaaaaaaatgcatcaaggaaaacataaccaatgtaacagggggaaaaaaaaaagcaggaaagaaaaagaacaaactttaaaacagggtaaatgaacatttctcaaaagaaaacatacaaatggacaacagggatatgaaaaaaatattcaatgtcactaatcataagggaaatgcaaagcaaaaccattacgagatatttcaccccagttaaaatggctagtatcaatgagacaaaaaataacatgctggtgagaatgtggagaaaggggaacactagtgcattgctggtgggaatgacaattagtacagccattatggaaaacagtacagagatttctcagaaaactaaaaatagatctaccatataatccagcaattccatgctgggtatatatccaaaaaaaggaaatcaatatgtagaaaagatacctgcacacccatgtttattgtagcactaatcataatagccagcatatggaatcaaactaagtgttcgtcaatggatgaagaaagaaaatgtagtatatgccgggcgtggtggctcatgcctgtaatcccagcactttgggaggctgaagtgtgcagatcacctgaggtcaggagttcgagatcagcctgaacaacatggagaaaccccgtctgtactaaaaatacaaaattagctgggcatgatggcgcatgcctgtaatcccagctactcaggaggctgggacaagagaatcacttcaacccgggaggcggaggttgcagtaagccgagattgcgccattgcactccagcctgggcagcaagagcgaaaatctgtctcaaaaaaaaaaaaaaaagaaaacaaaacaaaatataatatatatacacaatggaatatccagttagccataaaaaggaatgaaattctgtcatttgcagtaacaccaatgaaactggaggacgttaagggaaataagccaggcatagaaagataaatattgcatgttctcactaatatgtaggaccttaaaaagttcatctcataaaagtagagtagaagtatggttaccagagggtgggggggtgagtgaggggtgaagagaggttggttaacgggtacaaaaatacagttagaaggaaaagttctagagttcaacagcacagtagggtgactatagttaacaataatttattgtacatacacaaatagccagaagagaatatttgaaatgctcccaacacaaagaaatgataaatgtctgaggtgatgaatatcctaattgccctgatttgaaaagtacacattgtatgtacgtatcaaaatatcatatgtacctcatacatgtgatattttgcataattgatgcataataatatataattattatgcatcaatttttaaaacatggtaaattggaatttgaaatatcaggagtaaattcaaacttatcaataggcataataaacataaatgggttaaatttctctaataaaagacaatgcctttcagtttggagtgcttcttttaaaaaaaatccagttaaatactgtagacaagactatgcaatacaataaacaacaaataaaaacaagacaacatagaaacattgaaaacaaaaatgtatatcacaaaaattctaacaaaaagaaagcagcagacgcaaaacaaaagtaaaaacaaatttccctataatcattatctagttgtcactccagagaagtaggcataaaactggttaatgggagttggcaagataagtcagttaagtatttaagagactcatttttaaattcgatatggtggtggtggtggtgagtctgtgggtggtggaacacgtccatgaccagatctagacagtagcaacagccatcaatgtctgtcactaatctcctgtggattttagatctaacataaagattgcatacggctcattctggagggatgaccagaagtgacaagctaaaggtcctcaccctgaaagtggatgcatctctgtcttctgagaaacttagatcacaggacatgagccatagataggcataaaacctggaggtataaaactttcaggccttcgcttatgctgttttctttgcttagatgacctcccactgcactcatttccacctgtcaaaatcctccttatcctttaagaccacctttttcatgaagctgaattttacccttaccaccagagtggtttcccacagtactcattttgtgtctctctccagacattcactgtactctctattatagattgctttatatttctgtgtatctctttatataggctctttaaagatgcattagtcagctattgccgcataacaaacaactaatatttcagttgtttacaatgacaaacacttctgaaaactctcagtgatcagtaggatgactgcaatttaactgatctaggcagggatcagatgggcaggtctacctcatgctgtgggaaacctgcgcttagctttaggctgtgtgttaaattcaggtctgcctcacatatttttgctgtgactctcagactaaaggagaaaccgctatgcagagtgtgttcttctcatagtggatcaggagaacacaagaacatgaactacagcacaaaaagcacatgtgaggcatctgtttgcatcatatctgattcatgttccttggccacaagtcacatgggcaaacccaacaccatggggtggtgctatagtttggatatttgtccccagccaaatctcatgttgaattgcaatccccagtgctgaaggtggagcctggtggagttagtttgggtcacggggacagatccctcatgatttggtgctgtcttcacgatagtgagtgagttttcatgagatctggtcatttaaaagtgtgtgggctacgcacggtggctcacgcctgtaatcccagcactttgggaggccgaggcgggcagatcacaaggtcaggagatcgagaccagcctgaccaacatggtgaaaccctgtctctactaaaaatacaaaattagctgggcgtggcagtgcgcacctgtaatcccagctactcgggaggctgaggcaggagaatggcttgaacccagaaagcggaggttgcagtgagccaagatcgcaccactgcactccagcctggtgctggagcgagactctgtctcaaaaaaaaaaaaaaaaaaaaaaggtgtagaatcttacccacactctctctctcactcctgcttttgccatgtgacgtgcctgctccctcttcacttctgccatgagtaaaagctccctgcggcttccccagaagccaagcagatgccagctccatgcttgtacagcctgcacaactgtgagccaattaaacctcttttctttataaattatccagtctctagtatttctttttttttgagatggagtcttgctctgtcacccaggctagagtgcagtggcgcagtctcggttcactgcaagctctgcctcccgggttcacgccattctcctgcctcagcctcccaagtagctgggactacaggcgcctgcaaccatgcctggctaattttttgtatttttagtagagacagggtttcaccctgttagccaggatggtctcgatctcctgacctcgtgatccgcctgcctcagcctcccaaagtgccgagattacaggtgtgagccaccatgcgtggcctctggtatttctttatagcaatgcaagaacagcctaatatgggtggggaaatatgctctgtccatctggtacactgaaaggtcatatggtagaaaaattgtgatcactaaccaatctaaccaggctaggtggctcaagcctgtaaccccagcactttggtagcctgaggcaggaagattgcttgagcccagcagtttgagaccagtctttgcaacacagtgagaccttgtctctacaaagaaaaaaaaaagtgtaagttagccaggcatggtggcacatgccatgatcccagctactcaggaggctgagataggaggatcacttgagcccagaatgttgaggctgcagtgagccatgatcgcaccactgcactccagcctgggcaacagagtgagactctgtctcaaaaataataacaataataataataataataacccaatctaccataaaaggcagaaaacaagccatatcctttcatttctctattcctaccatttagtaccacgaccagcatagaataaacatcaagcaataattgtcaaaatgaattgattattcatggcatggagtaacatgagacatacacataatgcagtggttaagaacttggacgtcagagtcacaaagacctgagttcaatgtaaaatgacaaaggctctttgaaaagtttcgcagtttcttacaaagtttaacatgagcttaccataaaacccagcaattccacttctaggaaactacccagatgaaatgaaaacatccgaccatacagaaacctacacatgaatgtgcatagcagaactctttatagcagccaagaaatagaaataatccaaatgctcatcaactggtaaaatgaataaataaaatggggtatacccaaacattggaataatattcaggaataaaaaggaatgaactatgttgttgtcgttgctgtttttattgaggcagagtcttactctgtcacccaggctggagtgcagtggcataatcttggcttactgtaacctctgcctcctgggttcaagtgattctcctgcctcagccccctgagtagctgggattacaggtgcgttccccacacccggctactttttgaatttttagtagagacagggttttcccatgttgtccaggctggtcttgaactcctgacctcaagtgatccactcacctcagcctcccaaagggctgagattacaggcgtgaaccgccacgcccagccaggaatgaactgttaatatacaaaacaacatagttatctcaccataagcaaaagaagtcaaatgaaaagactacatattgtgtgattctatttatatgaaatgtccggaataggtaaatttatagagacacacaggcccaggcacagttgtcaactgaagctacagatgggaatgaggattgacggcaaatcagcaccaggggtcattctggacaccatggaaaggttctaagactgtattgtcatgataattacacaacttttaaaatttactaaaaatattagctgggcatggtagcccatgcctgtagtcttaactactcaggacgctgaggtaggaggatggcttaagcccaggagttcaagactacagtgagctacggttatgccactgtcctccagcctggccaacagagcaagaccctgtctctttacaaaataataagtgggccaggcatggtggctcaagcctgtaatcttggcactttgagaagctgaggctggcggatcacctgaggtagggagttcgagtccagcctgaccaacatggagaaaccccgtctctactaaaaatacaaaaattagccaggcgtggtggtgcatgcctgtaatccagctactcaggaggctgaggcaggagaatcacttgaacccgggaggcggaggttgcagtgagccaagttcatgccattgcactccagcctgggcaacaaaagtgaaactccatctcaaaagaataaaataaaataaaataagtggctcatgcctgttatcccagcactttgggaggccaaggtgggtgggtcacctgaggtcaggagctcaagaccagcctggccaacatggtgaaaccccatctctactaaaaatacaaacattagccaggcaaggtggcatgtgcctatagtcccagctactcaggaggctgaagcaggagaatcgcttgaacctgggaggcagaggttgcagggagccgagactgcaccactgcagtcaagcctgggccacagaatgagactccatctcaaataaataaataaatgaaataaaatgaaacgaaataaatttactaaaaattattgacatgcacatccaaatgggtgaattttaataaattaaagaagaatctgtgttcagaacttggctctaccatttagtatccatgtgatctagagcaacttatacagtgacataacctctgtgagcctcaatttctccatctgcgaaatggagatgaaacagaggcctgctgaagagtagatgagataatgcaggttgtttccccagcacagggcttgagaggtgtctgaggagttcttagggactctctagcaccctgtgcttttagggaaatcatttccacccaagtccctcctacgtccaaggtccaacccttgtttttatttaagttgctggttcccatattcccttaggaatatgttgttctctgccttgtccccaaatccctagtgcaagaatatatatatatatatacacatatttttttttttgagatggggtctcgctctgtcacccaggctggagtgcagtggcacaatcttggctcactgcaacctctacctcccaggttcaagggattctcctgcctcagattcccaagtagctgggattacaggcttctgccaccacacgcagctaatattttctatttttagtagagatggggtttcaccatgttggccaggctggtcttgagctcctgacctcaggtgatccacccgcctcggcgtcccagagtgctggattacagatatgagccgacatgcctggcctccctgatgcaagaattactcagactttttctaggccagaataagagtaggtcaacctcgtccaatccacagctccagaaattgaggcatttccagaatactgtacagagatgagaggccctggccaaacaaacacattacctttccactttgtattttacttctctttcttaacaacaacaacaacaaaaaaaaaaacaaaaacagaaacagaaacaaaaaaaccttggcttggcagttctaagctagggctgacagattctataagaagtcccagaaaacatctcagcctttgcaatgaaccttcagggaacaagtggccagtgagaaggtgattcactttgatgatagcttcctgatgagggctggaaccagctggagggttggtcagtttacgacttcatagaagactcaataaaagtcataaataaaagggcacgtgggtgtgagtgcacttcacagtgttgggaggccccatacgacagaacacaagaccgataattctgacttggctcaaggtttatcacctacgcagtgaaaggtgcagaccccatatgcctgggctgcttctctcccagtggaaatagattgagcctatggactaggggggccatttctcagattcctcaggccttggatctgtgggtagtgcggggtgaggaatggctgccttctctaataaaataaatcttggtgcctccaaggttgaccctggataaggacactcctgggagtacacaagggatgcctccccttccaaactgcctgcccctccaccattcaatcccagagctgagcgcttagtcttctaatcaccttagaataggtctcatgttgtgctttcattcattcatttaataacactactattattatcaatattaataaagctgattctgagttcacctcctctcctgcagtaatacaaacttcaaggcattctgtgatagtgagagttaaatgagacagagttgaaaaaaaaaaaaacaacttagcacctgcggggcacatagttaagctccataaatggtagctatataatttctgactatcaaaaccgtttcttggtcttgcatggcagctcaatcctgtaatcccaggactttgagaggccgagggaggaggattgcttgaagccaggagtttgagaccagcctaggcaatatagcaaaactacagctctacaaaaaaaaaaaaaaaaaaaacagggccaggctcggtggctcacgcctgtaatcccagcactttgggaggccaaggggaacagatcatgaggtcaggagtttgagaccagcctgaccaacatggtgaaaccccgtctctactaaaaatacaaaaattagccaggtgtggtggcgcatgcctgtaatcccagctactcaggaggctgagacagaggaattgcttgaacctgggaggcagaggctgcagtgagctgagaccatgccgctgcactccagtctgggcaacagagcaagactctgtctcacaaaaaagaaaaaaggaaagaaagccccaagactgtgtaatttataaaggaaagaagtttaattgactcacagttctgcatggctggggaggcctcaggaaacttacaatcatgggggaaggggaagtaggcacgtcttacatggtggcaggccagagagaatgagcaggagcagggaaactgccctataatatcatcacatttcatgagcactcaatcagtatcacgagaacagcatgggggaaactgcccccatgattcaatgacctccacttggtccctccctccatacttagggattatggggattccaatttgagataagacttgggtggggacacagggccaaaacatactgtcatgctaccaggaattttgtctgtctcatttgcccatatcagcagcaaagggcctagcacctaggaggtgctcagaaaacatttggtgaattaattaataaggaagctaagaatcacagatgtatggtacatagtttcagtaaagaacaagacattggaattggggtgacctgggttgcagccccagctttgttatttacctgctgtgtaacctctaaacttcatccacaaagtggatgtaactatggtacctatctcctgaagtctgagggaggatgaagtgagataacactaacaaaagcatttggcaaccaagacctcaataaatgctagctatctttattatagtttcaacacatagccaagtccacatttgaatttaattcatggaagaagaggaagaagaggaaaaagaagaagaaggaggaggaagaggaggaggagaggagatggggagggggaggggggagggagagggggaggaggtagaggaagaagagaagattgcggtgatctcaggagtaagtatcaatggaaaaaaagatcctggcttgaaagcatgtagaagacttgcgagcagatggaaacaacccagtcagggccggaagtgatggcttacacctgtagtcccagcactttgggaggccgaggcaggtggattgcttgaggccaggagtttgagaccaccctggccaacataacaaaaccccatctatactaaaaatacaaaaaattaaagttaaaattaactgggtgtggtggcacacacctgtagtctcagctacttaggaggctgaggcacgagaatcgcttgaacccgggaggcagaggttgcaatgagccaagattgcactactgcactccagcctgggtgacaagagagagactctgtcaaaaaagaaaggaagggaaggggaggggagggaagggcagggaagggaagggagaaagagaaagaaagaaagagagagaagagaagggaagagaagagaagagaagagaagaaggaaggaaacaacccagttggtgcccaatatattcttactgaattatatcagtctctataaatgccgccaactgtcttaaacattccagacttctccttttcctactccggctaaggggagttagatgttatattcttccctccactctacactttgggagtggcttttcaagttttgcattcaatctctttaaggacactccacattgatcatatccaaaatgtctggattgaatgttcctcagatccagtggttctcaaagtgtagttcccagaccagcagcaccagcatcagaatcatccaggtacttattacacacgcaaatcttattttggatatggtggctcatgcctgtaatcccaacactttgagaggccaaggcaggtggattgcttgagcccaggagtttgagaccagcctgggcaacatagagagactcatctctacaaaaaatacaaaaattagctaggcgtggtggcacatgcctgtagtcccagctactagggaggctgagtggggaggatggcttgagcccaagaggtcgaggatgcagtgagccgagattgcaccactgcactccagcctgggtgacagagcaagaccctgtcaaaaaaaaaaaaaaaaaaaaaagcagatccctagaccttaccctcgacctcctgaacaagaaattctggggggatggatcccagcgatttgcattttaacacgccctccacgtggctctgaggtatgggaaagttttgagaactgcagttctaacaaaaaggcaaacagggcaatcaaaagctgttttctctgcttagtccctgagtggtttcctggttggttggttgatttgagctggagtcttgctctgtcacccaggctggaatgtagtggggcgatctcagctcacagcaacctctgcctcccaggttcaagtgattctcctgtctctgcctcccaagtagctgggactacaggcgcgtgccaccacacccggctaatttttgtatttttagtagagatgggttttcaccatattggccaggctggtctcgaactcctgacctcgtgatccacctgccttggcctcccaaagtgctgagattacaggagtgagccactgcgcctggcccggtttcctggttttgaattgggaagagtgagatgaaaacaggactccctgcagaacaaatggcttctccaacaaattgtaatggaattttacatgagaggagccagaaaactgctgctcaattagtcagccaaaaaatatggagtacctactatatttcaggtgctgcgcaaagtgctgggggaaccatggtgaacaagacctatgcatccagctcttcaggattgaacactgggtgccagcagactgcatttcacacacatcaaactggcaaagataaaaagtctgacaaaaccaaatgtcggagaaactggaattctcatgtactgcaggtaagagtgtaaattggtacaactgttctgcagagcaacttggtgaaattgagtaaagttgaagaagtataacccccacagcccagcaattccactcctaggtacataccctagaccaggagaagctctatcagtttgcacaaggagaaatgtacaggaatgtatatatctgagatggagttttgctcttgttgcccaggctggagtgcagtggtgtgatcttagcttatcgcaacctccacctcccaggttcaagcgattctcctgcctcagtctcccaagtagctgggattacaggcatgcgccaccacacccggctaattttgtatttttagtagagatggggtttctccatgttgattaggttgtctcaaactcccaacctcaggtgaggtgcccacctcggcctcccaaagtgctgggattacaggcatgagccgccgtgcctggcctgtacaggaatatttactacagcactgtttgtaatagaaaaatagaaacaggtcaggtgcggtggctcaggcctataatcccagcagtttgggaggccaaggtgggtggattgcttgagctcaggagttgaagcccagcctcgacaatatggtgaaaccccatctctacaaaaaatacaaatattagccaggcatagcggtgcaagcctgttataatcccagctactcaggaaggctggcgtgggaagatcgcttgagcctggggggtcgaggctgcagtgagccatgatcataccactgcactccagcctgggtgacaaagtaagaccctgtctccaaaaaaaagaaagaagaaaaaaagaaaaagagggagagaaagaaagagagaaaaagagaaagaggaaggaaggaaggaaggaaagaaggaaggggaggagagggagatggaggggaggggaggggagggaagggaagggaagggaagggaagggaagggaagggaagggaagggaagggaagggaagggaagggaaggaagacggccaggctcagtggctcacgactgtaatcccagcactttgggaggccaaggtgggcggatcaccagaggtcaggagttcaagaccaccctggccagcatggcaaaaccccatctctactaaatatacaaaaattagccaagtgtggtggtgggtgctgtagtcacggctactcgggaggctgaggcacgagaatcacttgaacccaggaggtggagtttgcagtgagccgagatggcgccattgcactccagccgggcaaaagagcgagactctgtctcaagaaaaaaaaaaaaaaaaaggaacctaaatgtccatctgcagaatagatagcttaattatgattgagttctaccatggatgctagtactaacagattaacactaacaatagtagaaaataaatgaaacataacctgtatcaacattaacactttgcaaaatcggccaggcccagtggctcacgcctgtaatcccagcactttgggaagccaaggcgggcggatcacctgaggtcgggagttcgagaccagcctaaccaacgtggagaaaccccatctctaccaaaaatacaaaattagctgggcatggtggcgcctgcctgtaatcccagctactcaggaggttgaggcaggagaatcacttgaacctgggaggcggaggttgcagtgagctgaaatcacaccattgcactccagcctgggcaacaagagtgaatgaaactctgtctcaaaaataaataaataaataaaaataaaaataaattgcaaaatcataacaatgaaccaaaaagcaagccatgagaacaatacatacagtggtagtctatttaaagtgtttaaatatgcaacataatgttatatgttgataatggataacatatattcaataagaatacaaaataggcatgaaatataagacacaactgcaggatagagatcccattgggaaggaaggaagagagaaaggagcacgagattaagaggggtccacagaaggacttgattgtctttgttatattttttaaactgagtgacgggtaaatggttgttcactgtactggtctttatagttttttgtgtgcctgaaatagttcagaataaaattattttaggtcactttttttctgggttttttttctta

SEQ ID NO: 721 - DNA, 572749 bp, Homo sapiens
tttcaccacaaaggccaattaagtgctcttacattttaaaaggcagactgtttgagaaatgcctctgagaacaattaagagtacaaaacgtggtaaatgaaactggaagttatcaaaagctattgaaggcagctgagagaaatggcaacttacctccacatgggaggctatacagcccagtggatcagaaaccaacggccaccagcgcccagtccctacccagcctctctccatcgtgcatgcggcacgacttctccaaacaaaagcattctcaactgtgaagtagcgataataatagtacttgcctcatagggtagttgttaagattgaatgtattaatacatggaaagtaattaaaacagtgcctagcacttaagtgctgaatgactgttggttgctatgataatgattattaatagagtattacatatgttccaaaatagcggggacctttgctgccttgttttctcagcacccggcatctccagcacacaggaaggactcaatcaatgtttgttgaatgattgcattaaatggcaagcttagctggtgacaaattatgatccagatcagcttgcagacccactgcccaagtgccctaggctgctctttccttcccacaggcagaggctcaggagcccttttataagtttctttcaatcctcagccagcccctcccagctcatcctctcagtccctcctggccaagggtccatcccccaacatcagctctagttccagcatcttgtccagctccctttgaacttgatgctttgagccattcctacaatgcctgcttctaccttctgaaactgaatttttctttctttggcatttgatagctgctagtcatcccaccctactgactgggcctgcctagaaccccaatcctgatgctccccagtctcccatggtctggggttcaaacacctctgcatcccaagccctcccaggctccacactgggactctggaattttaaaaacttgggtttaaatcctgatattcagggtatttacttaatctcgctgacctcagttttttcacctgaaaagtgggataacaatacccactcattggcataagaattaaatgcctatagcatgcctaccacagagtcttccatcaaaggggatgatccaatgctaattccttctccagctgctacttctacaatatggcagactctctagagccccataaaaacacgggatgagccatttggccagcaaggacctggtgattgaaagtgtgagcatcaagtctatttctccaaaagagagcagaactttgtaataaaactgagttgtggtagaaagcaaggaaaagccgcttgctgcagccttaatgagcaagataaagggcacatctttggaggccaggggacaggtttattaataggattaaagccaggggtagctgctggagagtcagagtggcttatcagtgtgaaatagtgtatactcacagataagatcacccccagagcagccaagaggccacttcagaaacaaacaaacaaacaaaatgcagtgggatcctgcgatagggtaggaaaatcagtggtcctcaagttctgtaccataatcttctgtaagggtggttacatcagaatcactggccgggggtgaaggattgggggttaaaatagagaatctagaacccatccctagagtttatagtccagtaagtctaaggtgttgcctgggaatccattagcaagtttttttttaagacagtgtctcgctctgtcatccaggctgtagtgcaatggcacaatcatagctcactgcagccttgacctcccgggctcaagccatcctcctgctttagtctcccaagtatctgggactacaggcatgccaccacgactagctaattttttttaagtagagatagggtcttgctatgtggtccaggcaggtctcaaactcctgggctcaagcaatcctctcaccttggcctcccaaaatgctgggatcactggcatgaaccaccacacctggcccattagctttttttctcttttcttttctaaatcttagatgatgttgctgaagaagcagccaggttttggactgtttgaagattataattagttttgtagcaattcagatatctggatgcatacattcatttgtttaacaagtatctgttatgtatttatgacatttttggtgagcaagaaataagaagaaaagatggtcatgttcctcgtcaagtttccagttggctactggagagatcagtcaaagggtacaacaatcaatcattcgttcattcaaaacttaagagcctcctatatgccaggttctgtgctatggaagcaggattttgattaggcctttaaaaatgggaagcaacaagaaaagggagaaagtcttatctttgatttcagcctaaccaagggaggcatcactgtttccttcttcttttttctttttcagaacgacatcctatattactccctgacaggggtgaggagtgtttcctacagttcacaggaaacattatgcatccatgattccagtccctaggcttggaagagaggtctgcataattgagatatagcttggtatgttctccagtgatactgagaaaagagtgaggagagtcaaaaggaaaaaataataatagcagcagttgtaaaacctaacacattaaacacttactatgtgccgagcactgatctcagtgctgaataagaataaataaacaagtaactgagttctcttactagaaaataattgtaaagtaacgtacaagtttgatattttctacacatggagttttaaatatgaagcagatatgaaggtattagtaaatagatcaaattatttaaagcaacatgtttaaactttcaaataaaacttaaacagaatcagtagtattcaatcagttctaagttattaatactaagttactcagtcactccattaagattcaacaaaatggttttgttaatcagtggtaccaaaaattaaattttggttttaaccttagtccttgttgttagctctcctggaatttttctgaaatttcatgaaaagaataaaagaatgatttcagaaaaaataaaaaataaaaataaacaaacagagccctttcattttctcctggaggaagtagcaaaaacagcagccctaaggagagataatttcagaacggtatcaatggcctccaaaatatccctgccatttgactatctttgttttcagagaatcctttggaactagcaccaaagcttcatgcaaaaagctgtgcagcactggttacaatgacctaaaacctggaagcaaactgtgttccaatagtaggggctggcttaaataatctctcgtacatacatataaaagaagaatgaggacactctctactgacatagaaccatttccaagattaaccgttaagtgaataatgcaaggtacaattttgaaatacacattattattaactatagtcaccatagtgtgcaatagatcactaaaacttattccttctgtaccctttggccaacatctttctttccccatctaccacatcctcaccctctgatcaccaccactgctaaaagtagattttaaatgttctcaccacaaagaaatgttaagtatgtgaggggaggagtatgttaattgacctgatttaattattccacaatgtatgcacatatcataacatcccattgtaccccataaatatatgtacttatttgctgattgaaaatgtttttaaatgtaagatgcagaagaatgtgtgctatcttttaaattttatggcatatggatgtattaactttttaaaaatttaaaagcaatatgtcaaactatttatagagtagaatccaatgatctatgtgggaataagaaagtttgggaaagaatttttgggaaatgttcactagttttgtttgggtagaagatcactgggtaattctttcctcccatttttctctatttctaaatttagatgtgtggtacaatgaaatacttttatcatgaaaaaaagacattttaaaatgaaagaaatcctggatccaggctaggggtttgcttagatatttaaaatcctagaacgcatataaaaagggactcgtgatcacaaaaggacatcagagaatgacaaaaatgtcaaagatgtggtcaggaaggcataaaccctacactaatttgccaaaacccaaaaagccaatgggctctcaaaatcaagccttaaagcaactttcagaggtttgctgttttaagtgtttggttaggactttgctgcaattaacaagaacctcaaatcaaactgggttaagcaaaagaaggaatttattggcttaaataatcaaaaagttcaggggaaagaaaagactgactttagaatagcttggtcctgttcactcatatttgttcttttctttttttttttcttagagatggggtcttgctctgtcacccagactggggtccagaggcatgatcatagctcactgcagccttgaaccctgggctgcagcaatctttttaccccagccttccaagtagctgggactacagacatgtgctaccatgcccagctaatttttttttttttttttttttttttttttttttttttttttttttggtctacagacagggtctcaccatatcgcccaggctggtcttgaactcctagcctcaagcaatactcccatgtcagcctcccaaagtgttgtgattagaggcatgagccaatgggcctagcctcacttacatcttgacttttttcctcttgactcagctctctacctggggcaccatattggggcattctaaatatcaggccctaggtagtggctcctagaaggccatgttcactgtagcttttttttttttaagcagttctagaagaaaagagccaaaggtgcctcttccccagcagaggcaacagtatgcattgcataccaactgagtcacctgctcatttctgcaacaatccctagagacctgagaatgcaatgccctgagtggcggggtggaaccaacaccatcagaagcgcactattctagaggaaaagcaggtaccaggaaaacagactgagcattcagcagcaaaacagcaggcagcagagaaaattgcaaattcatgtgtgcccatctcttcaagtaaaatgaataaataagcaaaatgaaaaaatatatatgtatatcattaagaagaacatgaaatctgaaatagatggacagcaagtaagagaacattgctttaaatgaattcaaatttctaggccacgtgcacaagtctcagaacccatgttcatatccatggagctacctccaaagacctgaactgtgatccctttcagagaaaccaaaccggagagaggccgctggggtctctcttttcacaaaggggatgggttggaagttgacatccgagaaccagatacaggcattgacttctgaggaaatttttttattaatcagttttataattgacaaataaaaattgtgtatattgtatttattgcgtgcaacatattttgaaatatatatacattttaaaatgccaaatcaagctaattaacatgcatgacctcacacattactctcttagcaaatttcaagaatacattgttgttaactatagtcaccatgttgaaccacagatctcttgaactgattatctgaggaaattactgaacaaattctaaaatagcagatttatgaaggcttagagaagactgatcaataaaacctactgtaaacttaccaagatcgtgtggtaccaaaacacactccacaggattacgagattgggagctctagggaagcccgataaaacccaattttaaaatagcacaaaaaataactaactattgggtactaagcttagtatatggatgatgggatcagcagagccccaaacctcaacatcagagaatacacctaggtaacaaatctgcacatataccccccgaatctaaaaatatttttaaggaaaaaaatatttaaacaatctgttggccaggtgagatggctcatgcctataatctcagcacttcagaaggctgaggtgggaagatcgctggagaccaggaattcaataccagcctgggcaacatagtgagactttgtctctatgaaaaatacaaaaattagccagatacagtggtgtacacctgtagtcccagctactcaggaggctgaagcaggaggatcgtttcagcccaggaggtcacggctacagtgagccatgatcccaccactgcactccagcctgagtgagaccttgtcacttaaagaagaagaaaaaaaagcatatgctattttcagaaacgcatttgaaaatttgaaaacatccatgtttgtgttctgaggataaagacaggtagaagaaacatgggtgtgaattagtagctcattgtctatccataccaactaaatgccatcatcatcatcatcaccataggtatttgaaggtttttactaccttacttagtcctctaaggctgaagtgctagcaggtagatatttattagtccccttttagagattaaagcactgatctcaagaggtgaaataacttgtccagctagcaaataatggagctggcatcctgacccagatctgtccagctgcaaaaatctttcctctcatgagttgttagcattattccaaacaaaacactgccctaaaagtgtgaaaatgtcctcagttcaccccttctctgcagtgggaccctgacatttaaaggcacaccaagaggagacagtgctccctgcagggctggagggtaatatctgaggtctgggagggacaaaattcacaaccaagggttactccctcccacctgtgcctgacatttttctttctaaaaaatctgctcatttctgttcttctttcctcttcatcttccccctctcccttttcaatattttatttctttatcttatttggtgttttcattgccaaagtaattcatgcttactataaaagcatcaagcaatagacaagtgtataataaaaagcaagaggtccaacccccaggaaactgctggggacagtttggtacctatccttccacagtgtttactgtgcgcacatcagtaaatcagacttaatacaatgttacaagttatatagaagtgctgaaatatacacctaagaagccagcagccttggctatagtctctggtgcatgcatgtggcatgattgtgcatggttctcagaaaccttgttgctgctcctatcattccttcctctaccagtccacaaatgtctaactgcctaccatgtgcgaggtgccaagctccgtgctcagaacacagctgtgaaccaggtggacatggtgcccttcctagaaacaaaatctaggctgcaagaatggtggctttaactcacttcaagaaacgcattcaccaagcaccttctctgtgccagcttttgcaggggatgaggtgatgtcacagatatatcagacacagcactgctctgaaatgctcatggaataatagaggagacaggctagaaaatgaggtccattatttgtgttttaaaattaggccaggcgcactgttcacaatagcaaagacttggaaccaacccaatacccatcaatgacagactggataaagaaaatgtggcacatatacaccacggaatactatgtagccataaaaaaggattagttcatgtcctttgcagggacatggatgaagctggaaactatcattctcagcaaactatcacaaggacagaaaactagacattgcatattttcactcataattgggaattgaacaataagaacacatggacacagggaggggaacatcacatactggggcctgtcagggggtggggggctaggggagggatagcattatgagaaatacctaatgtagatgatgggttgatgggtgcagcaaaccaccatggcacgtgtacacctatgttacaaacctgcacattctgcacatgtaccccagaacttaaagtataattttaaaaataaataaataaggccgggcgtggtggctcaagcctttaatcccagcactttgggaggctgaggtgggcggatcaagaccagcctgaccaacatggagaaatcccatctctactaaaaatacaaaaaattagccggatgtggtggcacatgcctgtaatcccagctactcgggaggctgaggcaggagaatttcttgaacccaggaggcggaggttgtgatgagttgagatgacaccattgcactccagcctgggcaacaaaagcaaaactctgcctcaaaaaaaaaattaaattaaaaaaactaataaaataaaataaaataaaataaaataaataaataataaaataaaatcaggccagctgcagtggcacactcacgtctttaatccctttgcactgtaacccctaagtactttggtaagccaaggcaggaggaccacatgaggtcagaagttcaagaccagcctcggcaacatagaagtttaatttaaaaaaaaattaaatttaaaaatagccaggtacagtggtgcacacctgtagccccagctactcagggctgacgcaggaggatcacttgagcccaggagtttgaggctgcagtgactgattgtcatgccagtgcactccaacctgggtgacacagcgagatcctgtctctaagtaataatgatgatgataaattaaaaaataataatttttattatgttgttgttactaacaaaatttattgaccccttcctagatgtcatacactatactaagtactttacaagcattaagtaatttcatccttttaaggaccgtttgaggtaactgtgatgattattcccacctcatagatgcagacactaaagctcaaagaagatgagtgccttgcctgaggtctcacggctggtgaatgactgggctgtgactcaagccaagagctgtttgtctccaagactcttaaagactcttttttaaaaccagcaagctattccatttcatggtattctctttttctccctcattagcagattcctacagaacccacatgactctactgttcctgccccaatttatttttgcctgagtctccccactttgggcaaaagcctcgcttgaactatatcgatagctacaatgactgaaaattgtgtcacgtatcacatagaatctctgttcccaaggtacccagagagactgaaataggtccgttaacagtcgtgtgttttacattccacttggagggttaacattcagggtcacccttcttctgagccttaaaaaccaggggtatcaaagtaatgagggagtgcgagcattccatggagtttggattaatgatctgtgagcctctgttcagccctgaatgcgtgtcatttttagagttcagcctggcaagaaaacttaacaagaatcctggtcaaaagaagtctcagtcatttaatgacaaagggtaactggacaacctaccaccagcaatttatttttagaccaagttaagtcatacttctatgcatgacctcactcccatgactctcctgccctgcccccagttactgtcctcagctctatgatgcaaatattctgcagatgtgtctctgccctgcaagattccctagacagctttaccttgactacagatatgtcaatgtccgccaccatagaaaggtctttatgacctttctgaactgaactgaactgatgctagcttgttccatcaagaccccttctttcactgtgcaaactgtcccccaagctcctgtgctccaatcagacaatcagaactttccattcatttcagcaaagttctattgagcttccactctgggttgggtagcaggctaggctggggacagaaagatgaatgagacccatgccttatgagacacatgatactcacagtgaggaggagagagcagatgacttacactgaaacaaaaacaataatgtttcacatccaataatataataataaacaagacacagaggaaggggttatttcttctcttctgagagaataggaaacaacaaagatacatttctacagagaagggctttaaaggatgaataggagttttccagggagaaaaggagaaaaggtcatttctggcagagccaaccaaagcagaaaattctgaaagtgaatgtttgacaggagctgcggagagggaagaagagggtgacacataattcagtaaagtgattgtgttgaacatggaacagcagaggggtgggagatgagcataagaagttgtgatggttccttgacaccttgcttatttttgtaattttttttttttagattttgaaataatttgatcctaacaggaaagttgtaagcttggtataaagagcgctcatatacaggctgggtgtggtggctcacacctgtagtgccagcattttgggaggctgagctgagagcattgcttgaggccaggaggtcgagaccagcctgggcaacatatcaagaccccatctctacaaaaataataataataatgaaagaattagccaagcatggtggtgctcacctgcagtcccagtaacttgggaggctgaagtgggaggatggcttgagtccaggaggtcgaggctgcagtgagctgtgactgtgccactgcactccagcctgagcaatagagtgagacactgtcttaaaaaaattctcataaacccgttttacctagtcttcctaaaatcgtcaatattttaccacacttgctttatcatcttttcttgatacatacatattgcatttgtatttttttatgaattgtttgagaatgagttggggtcatgatattcctttacccctaatcacttcagtgtgtatttcctaagaccatggtcattttcttaggtaactaccatataaagtcaggaaattgacattgacttaataccattatctaatccacaaaccttattaatatgtcaccaattttcccaataatttcttttatagtaacaaaaagaaaatgttgaccacctgtattagtccattttcacactgctataaagagctgcctcagactgggtgatttattaaaaaaaagagatttaattggcccacagttctgcatggctggggaggtctcagggaatttacaatcatggcagaaggggaaacaggcatgtcttacatggcggcaggcaagagaggagagcaggggaaacagccacttataaaaccatcggctttcttgaaaactcactcactatcacaagaacagcatggaggaaagagcccccatgatccagtcacctcccaccaggtccctcccttgacatgtggagattacagttagagatgagatttgggtggggacacagagtcaaaccttatcaccaccctatttacaattgggactccacccctctcaacatgtcctgggccctggctctgctttttctttgtagcattttctgacctctaacatgtagcattattcctatttctaaaatgtctctcccttcccaccatcccactagaatgtagatctatgaggtcaagaacttttgtccattttgctcactgtcatatcaacacccaggagagtgactgccacatgaaagttattcaataaatagtctgaatgactgaatggccaaacctggaggtatctcttcccaacccctcttcctcttatttttttaagcaaaaaacaataggctattttttcatgccaagaaaactgagcctccgtgttagtgtttttctccctttaagttcttgcttggggttttcttattttgcctcctgataggtacgtagggtatattgcaaaggagaaggttatccccagaacagctagggcttcttctaagaatagcccaagtcaactgaatctcccctgggtctcctatacagatgtgaaagtccttgacatgcaatggtatctatccctctgcaaacagagtgagcatctttagatctaattgaaagattaaaaagaagatccccagctggaaggtcaatttatagattccacagttaaatcaagccacattcctaagcacatgggacacaaaccttgcattaaatcaaagacttaatccaagttaagccaccctggatgaggagctagagctggagacatgtaattaacaccagccagtcagcaccaactgcttcagatgacaggtccacagcctggaaaaccttgttacaatttccaggagggctttggggatgcttgttctcaagttccagagacggtgggctttgcttctttccatctgatctcaactactgaccaccaggctccctgcactccagccccaccaacctccttgccacttctcaaacatgtcaaggacgcttccatttcaaggtcatttgcacctgctctctccctgagctccctctggactttgctcaaatgtcacctctctctcactctatttatttctgtaagcctctctcctccttgtcacctgctattccctcctgctgtatcccttcccgccactcttatcccacctgacacactgcacattgtacttatccatttactctttcttcccctgagaaaccccatgaaggcaggacttgtgctttttcattcaatgttccctcaccaatcatctagaacagtatgtagcatatatcaggcactcagtacctaactgctgagttaatttgttggctagttatctgattgattgattgactgattgattgggtggttaattaaatggttaattaatttacctcctgaggctgggcccccatatggccacctagctaagaaacaccatcaaacctggggctgggtattttggttatgaaggcaaataagagctacctagaaatgccctgacgccagatgtcttcaatattctgagacctgagtctctgttataggttggtgtccttgggataaagttcaagttctctgtccctttggttcttaccttgaggaactccatcttccacccctgaactgctcacctaccctccagtgaactagaacttttgtcagctcctcaaagtcaccaggttcttgccacatatgacgtctcttcctagaacagtcctctccatcatgccatagtcttcaactctggccagcacctgctccccaggtgtcccctgtctgcactcaccacactcttcttgcagtgaatcaccagactgtgggttccacgaagcaagagcccttgccttcttcttccccatggtatcccagtgtctagggcattgccagactcatgcttgaatatttgctaatttggataggagttatcatcttatttcacagatggaagttatgaactttttacacacctaatgtacaggaattttcacactaaacaatcctccaattctctgtggataccaattgggtattctataattaaattaaactttggcactgcctacctggtgttaccgtcagaccctatgagtgaagggttccaacccacaagaaggcccccaacctctgaggccagttgcaaatcccaggttgctacctgtactcctaagcaaccagctataaatcgggggttcctgcaacccactctcaggtttgataatttgttaaaatgactcccagaaatcagaaaagtgttttaattactactactggtttattataaaggatgaaagtcaataacagcccaatggaagggaagcataggggaaggatgggagaagggccccatgcacaccagcctcccagctccatgcgctcaccaactcagaagctctctgaaccccatcctttagtattatggaggttccactacataggtgtgattaaaccattggctatttggtgattaggtcaatggttgttgacttcagcctctctcctctccttgaggtgggaagtaagatttggggtgggcaatgagcctaatagctcctccaaccttttaatcatgaggttggtttctctatagccagccccatcctgaatctatctagagctcaccaagagtcccctcatttgcgaaaactcaggaatcgttgaaagggacttgttatgaacaacaaaagatgctcccctaaacccatcattcaggaaattccaagggttttagaagttctgtgtcaggaaccaggacaaagactaaatatatacttcttccttcatcgcagaggttaaatatagtatagtggtaagaccacagctttgaagaccatgagttcaaatcccaactcttccacttaatggctatgtgaccttaaacaagttatctcagctctctacatctttttctcatttataaaataacgatcatggtaaatttataattcattcaacaccgttctcaaggctaggaatacggcagtaaacaatagattggcccaaagtgatattcgagccaaaacccaaatggtgagaagaatttcgccaccttgagcctaaaaggaagaaccttcaaggcagagggaatatcatgcctgaaggtgttgaggcaggaacaacctcatagtgttcaggaaagataaaagaaggccaggccgccaggcacggtggctcacacctttaatcccagcactttgggaggccgaggcaggtggatcacctgaggtcaggagttcgagaccagcctgaccaatataaagaaaccctgtctctatttaaaaaaatacaaaatcagccaggcatggtggcacaggcctgtaatcccagctactcaggaggctaaggcaggagaatcccttgaacccgggaggcagaggttgcagtgagctgagatcgcgccattgcacttcagcctgggcaacaagagcaaaactctgtctcaaaaaaaaaagaagaaggcggccagtggtgcctctggcatccccaaaagcaagcctccaataccacgaaggtacacagggccactttccctgcacctctcggctcctgatctacccaactccagaccccaaggttcacctctagctctgaaaaggagcacagcttctccagccacatctgcctcattttgcctcaactgcaattggaatcgttctctgattggctcccctgggtacgtcctgaccttctcaatcccccacttctgtgccctaccatccccttaagtgacactgtcagccaggtttgcctggctctcaagctgcaaatctctaagacagaagtcaatgggtaatgagaataagaaaatgtgaaggactagaactccagatcttgatgctactggtattagttaggtcagagaagataataatttgacatcctaggaacccaaatttccatccccgtctaactccactatccagtgctaaattcaatggcttataccaatgctatttgattcttaatcagtgtctgctccatctggtccctttacagtactgattctcaaccggggcaattttgctccctaagggacatttcgcaatatcgggagacacttttggttgtcacaactggggtggatggtgctactgctatttggtgggtagaggccagggatgctgcaaaacatacagcagtgcacaggacagcctgcccctgtccccaacaacaaattttcctgcccaaaatgccaacagtgccaaggttgaaaaatgctgcttttaagtaacacagctcaccctgcataaacattaaacatatatataaagagatgttaaaatgtatttgtatgcagataaatgcaaattaaaacattaatgagatatttcacacctcgcaagcagacaaatttcaaaaaggacaaatattggcagaaaagtggggacataggaaccctcaggcacagctggtggagggtatgctggtgtgacctgttactatttagtcaaaggaagattcacagacgcaaggaccagcagttctataagaaagtcttacaaagctccttagaaagacacatacggaaataatcattgcaaggttatttgtggaaggtggaggtaacgaggttgtctatcattggggaactaggcagataaaagtggatgagcaaataccatggggtattagaagtgaccttttttttttaatttttctttttcttctttttttttttttttgagacggcgtttcactccagcccaggctggagtgcagtggcatgatttcagctcactgcaacctccatctcctgggttcaagtgattctcctgcttcagcctgctgaatagctggaattacagttgcctgccaccacgcccagctaattttttgtattttagtagaggggggtttcaccatgttggccaggctggtcttgaactcctgacctcaggtgacccacctgcctcggcctcccaaagtgctgggattataggcttgagccaccgtgcctggccagaagtaacattttagatgtacaaatagcaatagagatagaccttacagctttaatgagagtgaggagggggagttaaaaaaaaaaaaaaaacagcatgagacgattaatacaattccacatgcatcaatctttttcaaagtgtacacattgggagagtaaattggcacatgtactttggaaatttatttgatagtatttactaaagctcaatataaatactttgaaccagcaaattccactcctggaattatactcaagagatatgagtgtttgtgtccaccaaaagacatgtacacatttaatccataatagccccaaaccagaaacagccagttgttaataaagaaattgaggtatatgcatacaatagaatacaatacaacaatgaaaatacggatgcatctcatagacatcccattaagcaaaataagccaggcacaaagaatagacacagaatgcttcctttcatgaagttcaaaaccaggcaaaactaatcaacagtgttagaggtcattacactagtttcctttggaaaggatagactttttttttttttttttttttttgagacggagtctcgctctgtcgcccaggctggagtgcaatggcgtgatctcggctcactgcaagctccgccttccaggttcacaccattctcctgccacagcctcccgagtagctgggactacaggcgcccgccaccacgcccggctggaaaggatagactttaaggattgacggggagactcctgcagtgtgagaaatattctatatgttcatctaggtggtgattacacaagatctatacgtatctaagaaaatatcatgcagtccacataaggtctgtgctctttatgttaattataccttaactacaaataaaacttaggatggaggactttcaaaagatatggattcaattgacaataccaagcactggcaagcatgcagagtaattaggaattttcatatactgccagtaggaaagcaaaatgacatagcccttctggaaaacagtttggcggttttttataaagttaaatatacacttataatgtgaccctgtaatctcacccccaggtgccctaaagaaataaaaacacgtttgtacaaaaacccatccacagggctgggtacgggtggctcaaacctgtagtcctagaactttgggaggctaaggcaggcagatcacctgaggtcaggagctcgagaccagtctagccaatatggtgaaaccccatctgtactaaaattacaaaaattagccgagcgtggtggcaggtgtctgtaatcccatctactcaggaagctgaggcaggagaattgcttgaactttggaggtggaggttgcagtgagccaagatggtgccactgagccgaatccatcaaaagaaaagaaaaggagaaacaaaagaaaagaaaaggaagggaagggaagggaaagaaaaggaaaaggaaaaggaaagagagggagggaggaaggaaggaaggaaggaaggaaggaaaacctatacacagatacacaaatttatagacgctctattcatagttagcaaaacctggagaaaatctaaatagcctccaaagaggaagtggataaacaaacatccacaccatggaatactattcggcaattaaacaacaaacaaactcctgatacataataaccagaatgaatctcacaggcattatcctgagtgaaataagtcagcctcaaaaggttattatcttagtccattcaggttgctatataacaaaataccgtaaacttggtggcttataagcaaacgaaatttatttcacacagttgcggaggctaaaagttcaagatcagggggccagcatggtgagggccttcctctagattgagggccctcctccaggttgcaaatggccaacttcccattatatcttcaagtggtagaaagagcatgagagacttctctggggtcccttttataagggcactaatcccattcatgagggctccaccctcatgatctaattatcttccaaaagcctcacttctaaatagcatcatattggggattatatttcagcataggaatttgcaggaggacacaaacattcagcccacaacatgactttcttgaaaagacaaaagcataatgatggaaacagatcagtggttgccagggactatgggtgggggaagcatgcaactataaggaataacatgaaggacttctttggaatgatgaaagtgttcggtatcttaattgtgctcaaagtggttacattaatctatatatgtgttaaaattcatagaaccatgcatcaaaaaaagagtcgactttactatatgtacttaaagtataaaataaatgagatattgattcagagtcatattccacaattaataactatattaggaataaacaaatacgcgcacacaatatatattcttcaagaatatacacaaacaaaagatatacattaagcacacacgatggcctattaagggtaggaaatgtaagtaactagagtgaggtggtggggatgaaaggaaatgaacccagagacaaatcagtgagagacacatttgataatgcaactaggaagacttacaggagtgagaagcgattgtactcacagctatggtttattacaggatcggcaaggggcaagggacacacagcaggtagaatctggaagaatccatgcacagactcccagtgttctccccacctctctctagccctagggatcacggtgaatatgttctttcagcaacacctcttcagtgtttctgcctagagaagcccacgtttaggctcaaagtttgggtgttttattgagagctggtcacataagcacaaaaactagtaacaactattgaaattccaggctcctggaaaggaagcaggtattctgggcgcgaagcaggtattctgggcgctaagcgggcaaaacagtgttttacatagttagataacaatgcaaaagccaagttcccagatgccagtgaagagccaagcctgaaagcaagcctttctaaagatggcaacctcatgctgactatgttaattctcccttgccctgggtccttgcagagacccatgtggatgtgccacgagcctgtgatccaaaaaaataaaataaaataatttttttaaaactaggatctgcttctggttttcaattcttctattatttaagtcatgcaacagtgttaaccaggcaggctcactagcatgatggatggataaataagtgggtgggtaggccgacggatgaatggatggatagacgaatggacggatggatgaatggacacatggatggatagaagcaaaataaaatcaatactgtatgagccaaacaaaacaatggcttgagcattctgtttctaatgatgctctcaggaatgcagccacaaggaaactctgccctcacctccaccccatgaggcagaaactggccaccagtgacagggaaacaaagtggattcctcgaatgtcattgttattaaaacaaaactagtcccagaaaactgacctgaatgtattttttctctcacttttggcctgactgtctaataaccaaaagtcaccagaaaaaaaaaattttttctcagcaaatgcttaaaaacagagaagacccccaaagtacacaggggcagagaacaactcacaaatctcaagaataaaataaagatgaaagattctcaccctactgcaatgactctcccagcccactgccaccaaagcttctgagattaaaaagagaaattatttaatatatgcagtttcaatttttaaagtttcaggcatgaaagagcttttgctccctaatgatgtccctcagatgtagcaagacctggtctctctttcactgaagaattgccttcattttcaccacagacttcccttgcctcaaagacagatgctcagtcagagaaaggagcctgaggatccacagaaactctctgatattaattgatctgctcctagttttcagttattctattttttaaaacatgcgacagtgttaaccaggcaggctcactagcatgatggatggatgagtgagtgggtgggtaggttgatggatgaatggatggacagatgaacaaatggacggatggatggatggatggatggatggatggaaaaatagatggatggatgtatagatggagatagatatagacagaactagatacagacaaatagagacatcgttaaagagagagagagaggtaattatttatttttgcaacaagtatttattatctactttaggtcaggcactgctccagcttataactgtttgttataacagtaacaaaaacaaacaaacatccactaccttcccggagcttagagagagactataaaaaataaaaataatatatagaattatagatggtgttaagtgctatggagagagcaacatcaagtaaagcgtcttgggaccggctgggaagagttccagttcttaaagaatagggtcaggaaaggactcaccagaaaagtgacttttgaatgaagacctaaaagagatgagagtgttcgggttcaatattactttttaaatagacagacttaactacctgagaaaaaaacaggcatatcccaaaaatactaggacaagggaaaattataaaagttgatttaacaccaacaggtatgtaaaggagatgatgacataatgcttagttcctggcaagatttagattggagaaaaatagcatgacatgggcacacttggaagaaaccaatgggctatcaccaagaaggacctgctcgagctcaagataaccaggaaacataaccacctcttatgttataataatgtggtaacacaaaaagatgggatggcatgtcacatattgactcggaagtaggcaaaaacgtgagaccaacttgggcttagatacacatacctaggaatatactaggtgaagttaaagacagcaggagattgatattctacataaatatggaaatgcactttatgagttcttgagattctctggggatttttcataggtctcacccatcactggtcatgtaaatatgtcatttttagcaaaatcacattctcttcacttctatctgttctatattgctgcaaggactgctttttgaactagggtatgacaatgatctgtcttgatagtgtttgtgagtcaattcagaattacagtgattactaaagttggtcacatattccccccatctctatatgcattcctctttgtgatgtcactttgctgtcctttccactaaatagtagaacctatttctctaccctcttgagtccttgtcatgtgatttgccttgaccaagaaaatctcaaagaagtgatgttatggtaattcacagactacaccacaacaggccagaaacgtctaccttatccctcttgaaatgctaccctgagattgacatatggggagtctgggctagactcctcgagggtgagaaactatgtgaagcaaggtctggccaatagacagccccaaatgccagaattgggagtgaagtcatcatagacaatctgtctctaatggagtccccagatgtgtgcagaataggaatagccccaggaaagaccaacagaagaaccactcacctgagctcagcccaaattgttgactcacagaattgtaagtaaaccaacaaggtggttgtgttaagccattaagttttggataatttgttatgcgggaataaataactaatacagatggtagctacaagtctcttcctatgcctatggttgtcaagaagacagatgaagcaattagtagtggaaactatccattcattaaacaagtacttatggagctcctactctatgcacacacagcctagtggctcacaataagcaacctttacagccactgcttgacgaaatatctccagacaaaactattcctccaccatagcataaggtgatggtctgcccttgtgtatccatccttgtttaagaaacaaactaatgtcccttaactaaagattctccttccagtgaggacaaatgcaactcctcgtgaccactgtttctcctctggtgcccttccaataactcagaaaatctagactattggttgtttatgacttcactggatagcacctctattgtcatcaggccttcaggaggttgggtcttctgagaaatgcctgcccctcacccagccctagcaggccaatccattcctctttgtgtggtggagtcacgccagtgaagtggatgaggagtaggatgggagtcagaaaacttaggttccatttgtgcattctcagacttgtgggaagatacttcaccagccccagccttagaaatgagagtaacagagctgtacaatctctgaggtgttatttattcttaaggatacacttactggcagggaggaaatgctctaagccatttacatacattaccgacatcttctcttttaaccctccaggcatcaggcatctcgagggggtaggcactcccaccttcctgattttacaaatgggagtctgaggctcagaggaattgggtgacttactcaatgtcacacagctagttgcaggagtcagtcttttaactcaggcccatccagtcttaaaaacatggactgaaccagtgtatatccaactgacagatgagtttagaagctatctagtccagacaagcttgaactcagctagtccagcctttcatgcacctcacctatttagtgacagggaagtcattacttctccaagcaacttacattactttaggctgaaaattgcctgcctgaaattcctgctcactaatccctcttggccctctgttaacatcaataattccaccgataattacaaagcacctactaggcaccagacattatcctaagtgcttgggatacacgtatgaaattgctcattccaacttggtttggcccagttttcaagggtttcctgctcaaactcacacctcagcctgaattcccactcctgaagatttcttacctctctgtagtgagctctgttgatggcctctctccatcctgctgtaactcacatggaacctgtctcttccttcatttctcccaatgatctctaagacagagctgtctcatgccgctgactttactgaagctctcaggatatggagggggattacagcatgcaataagccatgacttccacaaagttacttatctctgtcttgaagttcttcactcacccctgccgtaggaaatttcacttccctagcctttcctcagagcccagctgctgtcatttttggggagtcctctaccaagtctcttgaattccacattccctagcctttcctcagagtccaactgctgtcattttggggggatcctctactaagtctcttgaatcctacattccccaacctttccttaaagcccaactgctgtcattttggtggggggtgggggggtcctctaccaagtctcttctctatttccttctaatttttcgcaatggtcagtacacccaagaccctctttccctgagctgggaaaagacctcaaattactatttttttgtcatgcataccaatgcaactcttcttaatctaagcttttctcatctctaccgtactccagaggaaacctccctgcaaataagaaaaccacaccaattaaagtattttttctgggaaaagaaaatatgcagttgtctcagaaggattcctcatgatactcctaggtcaactaattcaaacagcagccaacttttgaaatagaagttttctattaaataatagtaatgtcaactattaaacctgcaccttggcatatgatatgctacattcatttcttcatcttccaaatgaagaaactgaggctcagagagaaacattatcactagctttaaatcactgagctagaaagtggaaaagtgaagattcaaacagtccccaaaccaacacgcctttccagtgcttgaactatgatcaggcaagaaagtgcaacacttaaggtggcactcactctcaggggctgactgcacaagcatgaccctaagaatgggtacttccttaagagcagggtacctagaatccaagttcaggcaagtgcagggtgaatgcagctttaatttgcatcctaagcaccccgcttgcctcaccacagctggggccctgtaccttctcttccacaaacctgaaatgcatgctggacagtgaccatcctgactgggacactagcctggccctctgggcttgcatagcaattgatgcctggctttccctgtgcaggtggtgctgattaatggtgctgttaagaagagatccagctgctgctttcagtttcctcttcctgcagagatccttaattactgggcttcacctgttgagtttccttaaatgacatgagtgtgtatttttaagtgggaaaacaattcattaggaagtgccaacatctcagaggaggtaaatcctccagttaatttcagaaccacactgcttcagccacataagagagcggtccaagggggtactgcttttttctgaacgtcaccaagccaaacaaccaaccttcagcagatggcagggagcggccttgagaaaccacagggaggggtcatgagatcaaaccacccttagccatcaacctttagcatcctccctggttgcccctttagctcagcaccctgggaatgatgggtccacacagccatttaggtactgcttccacacggctgaaattgcatttgcattttattaaataaaagcaatctgtgcaaaagcctagcctaaagttactaacagatatttgagtctaagataatacatcttacagtattagaattcaggttctaagacaatcaccctcaaccgttgtcaatctttacattagggtagatttttgaaacttcaggtccctacaatctagattctgatttaattagtctagggtgggaccctggcctttagtatttttttaaagctgcagccctcagtggtgactccaacgtgtaggcagaattggaaaccactctaatttgtatttaatttttttttatttttatttttggaaacagggtctcactctgtcacccagggtagaatgcagtggcacgatctcagctcattgcagcctctgcctcccagattcaagtgatgctcttgcctcagcctccccagtagctaggattataggcatgtgccaccatacctggctaatttttttgcatttttagtagagacggggtttagccatgttggccaggctggtctcgaactcctggcctcaagggatccacctgcctcggcctcccaaagtgctgggattacaggcatgagccactgcaccctgctagttgttttatacatagagagagagattacaaaatactttctaaaggatagatcctgggtcttatcactgtattgctcataccaagcaaaatgcctggcacagagtgtgccaccgatacatgttttgtgcataaaaataaataatgtcacttgatgcttactagaggcaggagaagggacatagaaggagcaatggggataggtcggccaaggggtacaaagttaatcaggaagaataagttcctgtgttctattacacagtagggcgactggagctaatgaccatacattgcatatttcaagatagtcagagaagaggagcttgaaaatgatcaccacaaagaaacggtaaaggtttgaagtgatggacacacactggctaccctgtttgatcattatacaatgtatatatgtatcaaaatattacactatacttataaacatgtataattatatgtgtcaattataaatgaaatgttaatatgtcccttgattcttgtttgtacctttttccaattatttagccttacatatatatccatgtatatataaattttacataaatgcataaaaagtgagcattcctttgtgtgtgtgtgtgtgtgtgtgtgtgtgtgtgtgtatgagaaaaagagacagagacaagcagagagagagagagaggcagaaacagagagagaggaggagacagggagagagagacggcaaactttttttgctaccaattttggctcatttgccctgcccctctattctcacccccattgccatctccccacctgctccaacacctgccccaccagaaaacctgtactgacagtccagtcagtggtcttctatatagtgtccatcctcatttaattctagacagacatacagacacacatgagtgtgggcaatcattgttttatagaaatgggatcatattctaccaaccgttcccatgtattcaacaattccttgttgcaagccctccaagttgatttctcaaagaactaaaaatggaactttcactggacccagcaatcccatcgttgatatgtacccaaaggaaaataagtcattctaccgaaaagacacttgtgctcatatctttatagcagtgctagtcacaatagccaagacatggaatcaacccagctgtccatcagtggtggactggataaagaaaatatggtacatatataccacagaatactagacagccacaaaaaaagaataaaatgatgttctctatagcaccatggatgcagctggaggctgttatcctaagcaaattaacgcagaaacagaaaaccaaatactgcacattctcacttacatgcgggaactaaacactgggtacacaaagacagaaagacgggaacaagagacactgaggattccaaaagggggaagtgaaggagggggcaagggctgaaatattacctattgagtaccaagtttgctacttgggcaacgagatcatcagaagcccaaacctcggcatcatgcaagatacccatgtaaaaaacctgcaggtgtaccccattaaactaaaaaaaaagaaaaagaaaagaaagcccccaatacccctgatatcactcaccttcactgtccttattgggcacgtaccagtccataggtggaagccccattgcttagtcagccactcccccatggatgagcactcactttgcttcccatttctgcccgtcagaaataactcagccacaaacaggaggtcatctgatgcctgcaaccaccctatacagcacaaatatccatgtgaatctttcttcccatccgcagacacatagccaaatgcctagcaggccttacctgaccccactaaaacagtctttctggccagggaaaattataaagaattatatgagatcacacatacaaaaaaaaaaaaaccttcacagtgtgcagaaggctttgtgtcaaagtcgagctcgcacgtggccgtggccgggttctctgtggccagccccattcacaacacagctctggcagagcactcttcaatagcatcattaatagcccattgatccaattacatttctttctgttccacttcagaattacaatctcctgttccccctgaaagagcccagatagattcccagatgagtatcggaagaggtagctgccatcaggacttgcttgatggacccaagcactcatctaatagtggcactggaagaattaatctggctgatatatcagacctctctcctccgtgggaacttgccattttctccagcctctgagtttttctagtgagattcagagatacagccaaatgtgagttaacccagggacatcctaacactgccctcattgtgtgttcccagcatggggtaggcactccataaataatcgttgaattgaaaaatgcctaaggaggggtatattggggctcaaagcagaccaggtcggctgaagaaatgggctttatccagattgtgactttgcaggttggaccagaatgagagtttgaatctgattccataggtaatgcataaaatgaaaatatatactataaaaaggcaaagtcaagaccttgaatgatagctgagaaaaaagtagagagagctaaatacatattccaagtctaatgggcaggataatgagggacagaggtaggcagcaataggaccaaaatagcattcattcacttagtaactgtataatgaagacctaccttacgccgggcaccgtgctaagcactggggaggcggtggtgtagaagtcattatcccagccctcaattgctcatggtcttagggaggaggccaagacacaatcacattagagccatgaccaggacaggacagagctaaagcctatgacaaacataagcccagggaaattaaggagtatacagggaggcgcctaagccaacctggggaagtatcaaaggcttcctggaggaggaggatgaggaagaattagtaatgttgaatactggcaggtgaacaattcatactgtgagaggctgtggccccagtacccttgcatctgctttagactttgacttctacagtgagactcctggccaatgaggatctatgtccacagtccctgggggtcatcagccctgcactctcccacctccacatctttgtccatgttttttcctctgtatggatagcactctctggttccctctccccagtctgtaaaaccatcaccttcacctcccatcaaggcacagccccagtgctacttcttgcatgcagcttttccaacttcctctacctggaattaatctctgtctctttctctctctctctgaatttcaataacactttgcttgtttctctcttatagtacacagcactcttgacattgtattataattatttgtgtatttgtcttatctcctctgctaaactatgaactccacaggggcagaaaaaaccttgtcttaaccacctttgtattccctgcagcgccttatacaaggcaggtgcttgatacaggttgaatgaagattatgtttaccaggttccaggtaaatggaaggaaattaaaagacagcccagctggaaacagtgggcaggcattacaggcagggcccgctttctaacagctatcataaaactggctgcttgctggagctgtgaatttcccatcgctggttagagaaattctttaaaagggagattcttttaaaaatggttgtcctagatgatgtctaagctcatctaattttcactaggttactacaatggagaatggttgatgagtaagcaaagacagcagaaacccactacacagtgaaataggaacagatgtgtgttactgtcaatgtgattgctcttggttgaatgatgagatcaggggtatttattagattattaaatttttaatcaattaaactaaaagatccattctcagagaaataatgacagtatgtcatgagcaaggattataactaacctaattctaaacatccgaggattttttttgttttttgtagagataggggcctcatcatgttgcccacactggcctcaaactcctgggctcaggccattctcctgccccagattcccgaagtgctgggattacaggtgtgagccactgtgtctggctgagaatcatttttaaagtttgatttaaacaatcgcccatccccagatctgatttggggcatcaatggggccaaatgacatgggtttcctagagagcaaatctccggatgtcatacagatacttaaaaccttcaatggctccccatttccctacaacacattcctagtcctcagcttgatgtttgaggcttttaataatatagctcttgccagctgtaccttacacaacgccagacacactcagaccagaggtttcaatctcaagggcatatagggactcagtggagtgtgctgggccaggacaaaaccacaagggcatgccccaactcaacaactgagcaacttcacaggtccagcccctttgcccagcagaaatgcagactcagcattgcaagctcttctgagttttcaaaagaatcaggaaattaagatttttttttgtagaacctgccatttttcaatgttagcttaaaaatgcttaaacactttgtgaaaaatgcccatctgtggctcagatctctatgatttacttagactctattttttaattacttagatttactaaaaggtgctatgctcgcaccccttcaaatatccctccccgatgtttcctctctctaggttactcctctctgtctcctttcctggatttattccagcccaacctttaagactagcttctagttgcagtcattcctgcagaattacctatttctttttactcttccatattgtcacaatgttttacaatgaacctgagcagcagatgctgtcagtgccctcccacatcccctcagctcccttgatgattttgtgcacaccagtttcccatgtgctttcactcccaacagcctcagaatattggaatccactttctctgaatgcacggagagctagaagcacctgggaatttatgttgcccaagagcagcccttagccaatgattgacaggtggaggagtttaaatacttcacctcccttgcttcttaacgggaattacttcaaaatatgctgcctccagatctcccctgcagattgagccacagttatcttctgctagactttgtttgctatcacacacctgcttgggtttttcctggaaacacttcctattaaactggttttaaatgagccctcatttcaggatctgcttctaggacctttgatagacagcttttgacatgttctccaatgatctccagcaccttctgttaatgcccttatacaatcccctcaccatgagtgtgccatgtttctaaatccaaaagtgatgagtgtcacttccatgattgggatagaagagattgacttccatcttgccaccagactctctagcttgtcttctctccttgtgtgctttgataatgcaagctgccacattgaagagacccacatggcaaagaaatgaaggtcatctctagtcaacagccaacaaagagctcaatgctgccaataactactgagtgagcttggaaatggatacttccccagtcagaccttcacgtgagaccacaaccttgcaccaacatttgattatagccttgtgcaaaaccatgaagcagaggacctagctaactcgcatccatattcctggcccacaactataagataataaatgtgggtcagtcaagctgcttaagtcatggggtcacctggtatgtagcaatagataactaataccagaccccaacataagacgatgtgtaatatttctataattagaaaatattccatcctagatatctcctcctgaaagccattcctgagctcccagaccagggcatttttgtcacctctgtcatggtcttcatcatcctgaatttaataattaatataccctgcctccccatgtttttctcccctactgatcaccttgaaggcagagctttcagagagaaaaggtctgatatatttctttattcatcatctaagcatagtatcatataggagatgcttaacaaatgtatattaaagtaattgatttgttaattgttttccatatgagattttggccaagtgcctccctatataccattattctccagatgccaaatcaagggtaagggaggccttcaatattcagcaaaatctctactccatgcatcccccacatcattttctaagcagtttcttcctttccatcaccagggtgcttatcaattgtacattgacacttcctcccatctgttcaattcatctgttggatggtcactctctgccacttcagagcaatggggagttcactctgcctttcatacccctctgggaagcccaggaaaattatctctgattaatatcatttcttcttttgggtctaatgacaaaattacagcaaaatccagccctactttgcaccacacttggaaaaaaatctgctcagcttttgtctgccaaccacagcaaaaacttgattaaccaggactcagtgcacatgggcagagggctttttccccccagttagcagagggatgaaactgaaaatcccatttatttcctcccttattaacagaaaaaaagaatcaataggttagcccacattgctacccactgtcaataaattcccccaaagaaattgagtctctcttggaaagatgagcattcttgcaggcctaagaattgtgtattctgggactaaagatagtgttagaaattagactgaatcagcagagatctttggcatgtggaatttttatttaaaacactatttgctatcacttatattcccgtctttgcccttctcccagaagcaaagtataaaaaatgtgtgttctcatttttcaagtgttccagattcctaaagtccagttcatataaattgtagcatattcttatttatatgacagagactgtcacaggcatctaagctcaagcttattaaactgaagtttcctattctatctactcaatgggttctcatagtctcctaagcatctcatcatcttcctcctccctctgagacatgaaactcctacttggaaccttttcaaggtctacggcattgtgcaaaaagaaaaacctttcttgttatgcaactaacagatcctttcagttccaggggaagaaggagccaccagaatggtcactcaataacttagccaagtttcaactctgttttaagggaaaggaattgcaaagaaaggaaacattcgattattgagcactgactatgccaggcactgaattgagaatgcattttttactcctaatcatagcctgaggccctgcacgatctggtccctgcctgcctttttgactacacctctgaccatgcccccacatcacttaatatgctatacccacactggccctttttattttctagagcatgccaagctcttcctaccccagggcctttgcacttgctggtctctctgctgagaatgcttttgcccagatatgtgcgtggctcactccttgtcattcctcatttcttaattctaggccacctccaaaaagtaatcccgaactaagctgtccacctcccatgctaagtcattctttatcttgttcctttattgtattttttccataacacatcaccattttaaattaacttagttattgcctgcctccccatgaatatataagcttcatgaaagcaaagggtgttcctgacttactcactattgtgaaaccaacatgctagtacatgcctgccatataatagaatctaaaaacatttctggagtggatgaataaataagtttctctctgaatcctgccaagataaatattgttattatccccgttagcagataaggaagttgaggttccaagcagattaggaaatctcacaagtttgcacagctagaaggtgctagagcaaatcttacaaccacggaactgtctaactccagtgcgtgcattctccatcattcctagacactgtgtgggaagacaggagattataccttaatcaattgttttctaacttctgttcatgaaaaatgtctgggcagctgtgacaaggaaaaaagtcttttatcagctcacagttgtgagtgtgacagagcagggatatatcttctgcatcaaacattgccagtttgtcaaatatcagaatagaattgaattttaggaagacactatttctgatgcagctgtttcttttggatcctctcaatgggcagagaagatcccagcaatagaatgggtgaggcacgcatctgtctattaggatggttggaatgcatgaatttgataagccctatatttggtgagggatgtctgtcctcaccccaaaccttctcaccaacgtgacctcccgccagcatggaagccagtgttacaacattgtgagaactgggccctgcaactgtgctggtggccatttttctgggaccctcttcttttactgatacctttgggagtactcccatattcatttccgttgggcatctcattcgttgctgtaattcttgtcttcagttcaaagctcaaaagcctcaccataaagaactgggttttactttttggatcttgatccttggggaaaccccctaaaaaagtctatatctactatatccactccccatcttccagtcatctctgagcatggctgatgtagggaattgctcaacacagtttcaaagccccaaacaacaagctagctctggacatgcctacctgctatggtttgagttcagtttgtgtccctccccaaaattcatctgttaaaatcctaatccccaaggtgatggtattaggaggtgaggcctttaggagatgactgggtcataagacaggagccctcatgaatgggatcagtgactttataagagatcccagagagatctttgtccctcctatcaggtcagattatagtgaaaagtcagccatgtaagaaccaggaagcaggtcctcagcagacactgaatctgtagacaccttcatcttgaacttcccagacctcaaaacagtgagaaataaattcctgttgtttataagctaccaagtttatggtattttgttacagcagtccaaatggactaagacactacccccattctatttaaaagaaaataatctattagctcaccacatttactgtgctgaaaatttccaaccagaagaaaaagctttatggaggtgacccaacgatatggaggtgcttacaaccccatgggtggctacaagaatcaaagagagaaattatagttcaaaggcaaaacgtatactatctcctcatccctattttttcttggtttaagtcatttttattaagagtcataatgttctctatctacatgacactttccatcttcaaacattaactaattaattgactgaaatggtatctcgggagcatttatcatctatcacattagccagagagccagggaactgtctataaaagctgttgaacactcagtggaggcttcatctttccgcttcctttcccagaaatgtttttttgtgtgtctgcatatgaatgtgcaatggggaaaaaaataaaaagagaggatttgacttccaccaactgctataaaaatttacctctgggagacatggaatttcaattgtgaaataatcagtcttggaaattgtcctgtcctccaggaaaagaaaaaatatgtagtttaacagcaattgcccttcaaaacaattactaattataacgtctataaagaaaaataccctcgataccattactcctaataaagccaggcgaatctatagaaaggaattagctggcatgtctaaaatctgacaggagagctgttggggatgggtcagaagaggagtgagctccaaccagcttaaaaacctggatccaaagctttaggaggcttaccacctggagcaagcctctcttagcaaattggcaagattagcacaagaaatcaggccaggacaattacaaattgagaacccaagtcatttttcctgaccttccttccactctatcccatcccagctttctccatgaacctcttaacctcctcttcaagcagatgtcacggtacctggaactcatgccttacagctcaccatcttcccttcaccacagtcctcttaaagacatatgcccaggtagggttacaccaagcccctgagcccttggattgaatttgactgtcagatcctaactgtttgaaacaacatatgtcatggaggaaggatcttggaggaaagaaagagagaaaggggccacagaaaagagaagttggtggcagtgctgaagatagacaaatggaaaaagtccgttctgatttcaaattctccatcacttccctgctgtgaagcctgtgtcaagttgatttgaactctctgatcctctcacctcagtttctcaaagtgaggggaaaatatacctgaaagcctactttttaaatgagtgttcagttgcagacaatggaaaccactccagctaccttacgcagaagggaagtgattaccagatgtaagctgacttaggaaaccattggaaggacccaaagagttggagcttccaagaacaattccctggtcccccaaatcactctgcctctgctatgatggtgaaaactgctacctgcactacgagaagtcaccacatcaggaagctaatggctgcagaactacccagactctgcagagatccacaggagcaaagtgaatggcattatgccattttcccctcttaactcagttataaattcaagacgcaaagagtatctgatttgcagaacctgagtcatagtcagaatcctagctgcaagggagtccagtatattgaccttttagcaacccagcctctgcagtatagaatgacacagttgacagaggctggaatggaaactgaaggagcccatgcacaaagggcaccacccacatgattcagggctgtcaagagaatcaaatgagatggtgtttacaaagcacctaatatgctgcctgatcattagtagcttctcaataagcactacttttccttcactttcccaaaattttgctgcagcttggccctctgaatcatcctaaaagaacagaagaaaaaacctggaagcagccaaatgaccttcctaacttaaatgtgagggttttttgggcatctttcatttagcaaccttatcaaacatcagttatctctatttaaggcattcccccacctccacagaaagaatgaatcattttaagcagtagtttaagcttttactctatccaaacaaaattggcaaaagatcctctccctggataattacattaacattatttatctaaccactatttttctttttctgagatggggtctcgttctgttgcccggaactggagtgcagtagtgtgatatcagctcactgcagcctccacctccctggctccaataatcctcctgcctcagcctcctgagtagctggggccacaggcatgcaacaccacatttggttaactttttgtatttttggtagagacagggtttgtccatttgcccaggctggtctcgaactcctgacctcaaacaatccatgcacctcggcctcctgaaattacaggtgtgagccactgcacctggccaatctaatcattatttactgggcacctactagttgcctggcagatgtgattcctctccttcaaggagttaacagtctaggcagggtaattgtgcaaaacttgtaagattaaaattctgataaaacattaagagaagagatcagagtgccataagccagaataaagagggtgaaactgattctactcagggagtcaggaaaaatctccctgaggaagtaatgtctacactaaaacctgaaggataaggaaaagttaacctagtaaagagtgggagggaagagaatttctggcagagaaaacagcacatgcaaaggctgagtatttaggaaaccagaagaatacctgtgtggctggagtatgttaagtgagaaggagagagaagcgataattactttggctatggaactccaggctattatctggggtgacattttccctcaggttggaatccagatatgtgagacaattaacatttcataaaaataacttttgaagcaatgtttttccacctttctgtatctcagttgtctcttctgtagaatagtgttaacccttcactggatgatcatgagtgttaaataggataacaagtatacgattatgacaagaaggctgggcccttttgagcacagcagcgacatcctcatcatcttcttcagtgtttagccataccactccagagagctccaccaagaaccagagaggtgcttccctacctgcatgacttctctgagatgctctctagcccacacacagcagaggcacccacctgacaccttcacctggccacatctgattggaccagagtgtacacctcctactacccggacctatcatattcctacacctgggaaactcttacattcagatagaggcgcaattgatcagagtgcattagaagctggagctgtaaggtcatgaagaagaagtcccagggccctgggcaagtagaaactgggaaacagcaaaccctgagattccaacggcaggcgccagtctgcagagaagagaatggagcagatgtgcagaggtaagctccagagagtgaaatggagaaagcggctgattaacaacattccaagtcccatgaggtccagctgcatacgtcggatttccagagagccttgtgtgtccagacagtaaaatttcatatccactttaatctctttgaatgggtttctattccttgcaattgaattatcactgtctcagaggcccatcaaagtggagagctgaggccacccttccttaaatcagacctaaaatgtaaccctatcttgctaacaggacataataccggaactgaggaccccaccaccatctcaaggccttcacacaggctattccctttgcatagaaagctcttccacccgctccttttgcaaaactaaatctcactttcttccaggctgccccctttgagcatcgcttgtaaagactcccactccaaagtggacccttgctgtggtttccatagctctcaggacttccctttgcattgtgtaactcactttggatcactcgtaagatggctgccaccccaccatatgtgacattccacacttgcatcctgtttcttgcttattccccagggtttgagtgggggacacatagtagctgcacaataaacatctgattaatgcatgatggatagtctaaaaggatcaaattgacattctactgaaaaagaagagtttcactttagcctactaggtgctctactctatgcaaggtgttggaaacacaaagatgaattagacatcatccctgtgtttaggtcttgaaaagcctaagggaacaggtggataggtagataaatacgtttatgacaatgtaacaacgtgagtgttaggagagagagagactacaataggtgtatttctgaaggttttttggatgacaggggaagagagagagatgttgtagagggtcctagtggcccccacaccatcactcctcagaatttttgcagaaaacaaatgtagtgagcatctgattgttggctgctcagcatctactctctaattctgaatatagcacttcatttttccttttggaaaagcaccttcctgccctctcagcccaccagcacactggtgtaactggtatcaattcaacacctctgtccccagagtcaaggatggatgtgtgtcccaagcctagtcaatcagaatactccatcctcacaaggagtggttcagggatgatcatgtgacagtttagttaaatgagagtcaatctgggagtgtaaattagttcaactattgtggaagacagtgtagtgattcctctaagacctagaggcagaaatgccattagacccagcaatcccattactgggtatatatcccaaaggaatataaatcattctattataaagatacaggcacttgtatgttcactgcagcactattcacaatagcaaagacacggaatccatctaaatgcccatcaatgatagactggataaagaaaatgtggtacatatacaccatggaatactatgcagccataaaaatggatgagatcatgttctttgcagggacatgaatggagttgaaagtcactatcctcagcaaactaatgtaagaacagaatatcaaacactgcattttctcacttataagcaagagctgaaaaatgagaacacaaggttacctggggggaaaaatgcacactggggcctgtcagtcagagtggtgggggacagagagcatcaagaagaatagctaagggatgttgggcttaatacttaggtgatgggataacctgtgcagcaaaccaccatggcacatgtttacctatgtaacaaacctacacaacctgcacgtgtacccctgaacttaaaaggtgaaaaaaaaaagataagagtatatctcagaattcctagggagaagcaaggagaaagataagctcttctgtcactagaacccctaacctggcagcagccttcagctgagctgctgaagcctgtcttgggactacaaggggaaaaaaactccccaaaaataaatcttacaaggaaagtagcaggcctgagagaaaaagccacttctgatgtcagtttgaacatctggatccaaatagattcatcctggatttttcagttgtgaatcaacaaattctactttttctgtttaagcttgagttcctgaacctcaacactattgatagtgtttggctggatgggggctggcttgtacattgcaggatgtttagcaatgttcctggcttctagagccattctcacccacgagtcatggccaccaaaaacagctgcaatcattgccaactgtcccaaggggcaaaatcacctcctattgagaaccactggtttaaaccagttttcaggttcctattgcttgcaaccaaaagtcacgagcatacagtaacctatcaaataattccctacccaatttccaggaataattctcactcctacatgcttttactttccgtggtacctggaacatctttctatgggctttgctttccaaagccagtctgttgattttacattttttaaatattggtgtcaatgaaagtaagtcaatcagatcaagaacagcttagctctcagtcccagcagtacttgtacaagtgacatatttgggtacattgattatactttttcttcctcttaaaaatttaaacatcttccctcatttactttctttattttagaattctcagcagtcaattttcttttatctacaggccttcccttcgatgggaaactaatcaataagaaattagatttttgccaaggtattttaaagtaatgtaaccagcatatttttctctcattcatgactttattattgtgaaatgaaaacagaaataccacatccttgaaaccctcattttattaagctccatcacagctaccttcattcatcggagccatctcttccaatgtcattgttttgggtgaagcttgtgtttgatcaccaacctcatattttaaattgaaactcagctggagtagagttcttccctctgaatgagggatagcagtctggtaattagcagcaaagctcaagcagacaggctgcatccacttattctatctgaaattcttttccttttcttttttttttttggccagtaattactcttatcttggtgaagctgacccacctcttggcccctcaattggagtctccctttcaagaaaatatcacattgtgttgaataagaaaatcaaaatggaaatgaagcttcaagaggagtctagctaccatcttttcaattgccttttgaaacatcagctgggtggactttcaagacgcaggcacagttagatatgtggatctgtttcttagattgcacttgtgtatctgaagacatccattatgcctaagagggaaggaaatgagcaaggacttcccaatgcatacaggtgcttcgtaacacctggtgatcttgttactgaaacaccagaggttcagtctaggttctaatgcttgctgcacagaaagccaatcactgagacaatgagtattgccagggaagaaggcttcaattggatcctgcagccaagaagatgggagatcagcatcaaatccattcccctagctgactaaaattaggtatttttatagcagggaagaaatgtaaccatttgtgagaaaacaggaattagggagaggaaaggaagaggagtttgtcaacaagaagcaagtggttgcttaggcagtcatgacggatgaagggtcgggtgctttcactgtccagattcagagatctggtgagtttcagctccttgattctatctgggaagcctgatggttggaggcctgagaaaggaactcagataagacaaatgtaacttttgcaagtttcaagactgggatggccaatttctatgtgtatttaaaagaaaccataaacatcagttctatgggacaattgggccagtttcagttcggctcagttttttggcatggaaaggaggaagagactatcaataatattaacagtatagctatattgatcctttattagagggggagaaatctatttatttgggagagtagcttcaaagtgtgccaagtcagggaatcaaaggcacattgggaacaagctgaccaaacatcaaccagcatgaatggtcttgagccctcaagaccaagatgagccaagaacccacttcaagtttgaccaaagcagacagtaaataagacctccctgtaggaactccgctcttgttgcctaagctacattccaccttccacactgataattttatcacaaaaacaagcaaatgcaaaggaagaaagtagtgatatgataggatgacacatgatctagccaattccatctagaaggcaaataaaggatggaggcttggtgggattaatgcatttattctttccagaaattatagagcccttactctttgtctggtactgttctaggcttggaatacaagcaaagatccctgcagttgtggggtataccctgtaacaggtgaagagtgacatatcagaggaaggtcagtgactacagatgaaagggattgcattgagcctggacatttcccatgtcctacaagcctcctcctgcctttggtagaggtgagtgtaaataaacaaaatgtttcctgcactcaaatgccctcctctattttatttgttatgggagcaaacttccatctccaggacagcagagcgtagagcatcttctggtgtggtagctgtggtgagttagcttgagctgaagccaatgtgggcaactgtctacttaaataactcacctattcacctattcctggctgccatcaacaaagttggagcctccaagaagcagttaggattaacatattaacacagaggacggtctttttttttttttttttttttttttgagacggagtctcgctctgtccctcaggctggagtgcagtggcgcaaactcggctcactgcaagctccgcctcctgggttcacgccattctcctgtctcagcctcccgagtagctgggactacaggcgcacaccaccacgcccggctaatttttgttgtcttttttagtagagacagggtttcaccatgttagccaggatggtctcaatctcctgacctcatgatcagagggcggtgtcttagtccatcttgcgttgctataaacaaatacctgaggttgggtaatttataaacaaacaaaggtttatttagctactggttctgcaggctgtccatgaagcacggtgccagtatctgcatctggtgagggcctcaggctgcttccactcatggtggaaggtgaagaggagctcgcatatgcagagatcacatggcgagaggggaagcaagagaaagagggggaggtatcaagcctttttaacaatcagctctcacaggaactaatacagcagtaactcacttataaacatgaggatggcaccaagccattcatgagggatctgcctccatgaccccaacccctcccatgagtctgccacatccaacattgggatcaaacttcaacatgagctttagggggacaaatactgagacgatagcaggcagtcagcaaaaacaagaactagcatgtgttgagtctgcttgattcatcctttcacatatatcatgtctcatttcacttccacaacaattctatgaggtatgtatgtattagccccatctcacagatgaagaaactgaggctgagagagactaagtggcttgcataagatctgtctgactccaagttctacagcctttctgcattgttgtgctgcctatttcacccaataaagtccaacccatccgcatgagagtgttaataaatcaataacctgagtacttcctggggctggctctgtgtctatccctagattgggcactgtgaggggtatgaaattaaggtacagtctttgttctcctgagactaagttagctaaggaaacaaagggaaaagcattcattcaatatttaacgaaccataccaacactccacccacattcaccctatcttacgcaaatacttgtggatcccaaaacgtgccatgcctttgcacaagtctgcaatgccctttcgtctctcctctctgcttcaacctacatcatcttcatctcgcaagagttagatcatccagaaagcccctctaaacccacaggctagttggtggactttcttctatgaattccatggaccctggtgctcctctccgccataaaactctctggaaaaaaaatcagtgagagcttcagaagttagggaaccctgtaagtgagatgactggggagaaaacaaaagcctgagatggggaaatggctaaagacaaaagaagaaggagtatgtatgtggcccaaggtggtatcatctacaacagaaaactgacagccaggtaagggactgtatagagctagggatgttgtcacagtaagaaatagaagatatcattactcaaagccaagttaattacgatgttctgctttcacttattttttctaagtgcttccacctctggaagcatttctgatcagcacaactgtgaggttggtagtaggtattatcattcccatttagtggaaggagaaactgagatgctcagagaggttaggtgagctgcccaaggacacacagcatgaagacactaaggcagcagaatggttgagatcagactttctggtgtcaggcctacagctctcaaccacctggccatgtgaccttggacaagagacttaacttctccaagactcagtttccacacctaataaaaggggactaaagaatctctacttcgtagagatgttgtatggtgacataatcatacgagacctttgtcagtcctggacatatctgtaacaataaatctttgttccactcatcgccactgcttttgtttcgctgggatcatctgcaaaaccgcttgtgtgaaactctggtcccagctgctctccagggacaccagggcttccttgcaaaatatagcagccaagatggctttgggcccccaagtttctgagctcttgtttgactgcacatccccttccttagaaagccagcatcttcacgtttcctttctaagctgccaggaataaatgccaggttctggctttatggaacagtttgggaaataattagtttgccttccacagaggccagagttcacttctaagatatttaaaactctactgatggcttaaaataaatatcacaatggagatgtcaaaatatctatgtgttcttacacatgacattggaggggcagggagactaaaaaaatgtaaatggatttaccaaaataatctcgaggtaagacctttgaggcttgataccacagaagtgccatattgtttttaagtttcttttttttttcttttgtaagtttatttttctcctcggagggcactgaaagttttgttgtgagaagcaataaagttctgttttccaaaagagaataaaagcatgattgtatttttaaaaatcaatcttaataatttccagccattactttatgagcttaatgcaattcccaaacactgataactgatttctccaactggaagatgcgaagcgcacccaacggatgccaagttccgggctgagtactttaaatatttattgaattattaatcctcataagtgctcagtgaggcaggaatgatattcctcattctgtaggggaggtaatggagaccctcaggtacttgcctaaaaacatggggataataaagcagaaagtcaggattgaagactaagtgtccttatcctgactccatgctctttccagtgagttcttcaccccatccagatctaggagtgctgaacactcaacaacattatcaggcaagacaacaaacacacccgtgtcaactggagtttgtggctagtataaagcaatatagagtaaatctcaaagagaagtaggtcaaagaaatacctacaacctcaagaatatgtccttttctggctgggagcagtgcctcatgcccgtaatcctagcactttgggaggccaaggcaggaggatcacttgagcccaggagttcgagactggcctgggcagcacagcgaggtctcaactctatcattttttaaaaaatagaatatgtcctttcccccttgcctgcctggataaaaccttcttctttatctcttgctgcttcccacttcgcattttctgctctgttaaacatcaaaccgcttctgttgcccagaactatgtctcaggttccatgcagctgtgcctctgcaatgctgtgcctttttcccaaatgctgttcctctacaatccacttagcaaactcctgttcatccatcaaaaccctgatgaaacataaccttttaaaagaagtcgtcttcatccctctcccacttctagacccaatggaattcacgcgttcctcttagtcttctctccatagcatgtacatgcttacatttttataattattgcaacgtctgggatttgggtctctgggttagttgattggtttggctgatatatcagtctccctcacccgactggctttcctataggcaggggctatgcctgaatccacctttgtatcctctatgcccagccctgtgcccaagtcaaaacaagcatcgaattgaattgaatcaaaattgaaaatgaaaacaaatatcttggagaactagaatatagggaaacaagtgttaatgttgtaagagtctatcgcagagcaatcaaccagaccatgtttccctaataccgattacaaagctggcacagaggcaagacggagcagcagtggggatttatgctctctggacatctgttgggcgtctcttctgataaatcctcgccttgccctgctgacgatctcatctttcagaagacagaggaagcgacagagaaaacggttacttgccactaaatcctggcaacgaggaaacactggttaatgagaaaagtggaatccttaggagaaaaaaaaatgggcacataatcctagagttaatgatggtgcaagaaaggaagaaagaaaataagcacccattaaaaacctacagtgtgccgcctactttacgtgtgttactacatttaattctcacaacaaccctgggaggtgggtttcagtcacttccattcacagaaaagaaagccagaaaatggagagagtaacttgcccaagctcataaaaggcaagtctatctgcctgcaaacccccagttctaacctcacaccaggctgctgagcaaaaaaagcaaggcattgcctgacttcaaacctagagttgatgaataaggcagcgtcaatctgtataggctaggtaatgatacagtaacaaaacacacacacacacacacacacacacacatatacatacacacacactgaaatccaaatcacggtcatgtgacacgatcaagctatttcttccagccttggcagctttctaggacaggcagccaccctcctttgtgtgctggctgagttctccactttgcttccacctcatgaggctccatctcaacagatgcttcagagcttgcctcattcagggggaaaaaaaaaagccccggaggatctcaccccagtaattaaatgctgccacccagaagtcacatatgccacttccactcgtgtggcacaactcaaggccaaggggcagagaagtgcaattctccacccagaaggaaaacaagccagaaatggttgtgcaacgaaaattccaaccacagtagctttctgaaagatgagaaagaaagcttccatatgcagcaatgaacactggccaagcccggcctctgtgtactaccaggggagagaggagaaacatgaaaacaaaaattaatatctagaaggcaatgatcaaaaagagagagacaaagggagtgatgttgatgggagaactgggttatggaaaaggatttcacaagaatcaccaagcacatgtggaaggtcagtgccatgaacaaggtccccggacacaacccaagaaggaaatattgtgcaaaatagattggagtgccttcgtcagttcaggctcctataacaaaataccacagcctggggcttaaacaacagaagtttctttctcggagctttggaagctggaagtccaagatcagggtgccagcatggttggttccagtgagggttcattttacggtgtgtagacagcaactttcttgctgtgtcctcacttggcagagagggagagagcaccagcttctttctcttcttatagggacactaatcccattgatgagggctccacccttgtgatttaattaccacccaaaggccctacctaatatcatcccagtgagatatcatcccgttggaggttagggtttcaacacatgaatttgtgtgggggacacaaacatagctccatagaaaagagtctcagaaattgtgtctacccattcaatttttaccattcaattccattcccgggaattaggaagaagcaattaataggactaataagagctgtctggaggctcttattgacaaggctgtgagcaaaggatacaaggtgggacacaaaactgctttgaaaatggaagcaagatagcctgatagaaaaggcactgggcctttgccactgtcctctgtggctttataaagttacttaacctctctgagccttggtttgcttctatgtgcaacgggaataatatactatctgcctcaaaaggtagttgtgaggattgagaagatcctgcaggtaatatacacatcaaagtgcccagcaagatgttagaacaaggaaaacaatcataagaaggatgagcatgacaataaactctccaattggataaattcaagttggttgtctcaggaaccatctgtcttgtaactctctgacttcatttcccaccaccctattattgcctgaatttgctgcattgatcttttttgttcttttttttttttctttgagacggagtcactctgttacccaggctggagtgcagtggcacaatctcggctcactgcaagttccgcctcccgggttcacgccattctcctgcctcagcctcccgagtagctgggactacaggtgtccgccaccacgcccggctaattttttgtatttttttagtagagacagggtttcaccgtgttagccaggatggtcgcgatctcctgacctcgtgatccgcccgccttggcctcccaaagtgctggaattacaggcgtgagccaccatgcccggccgaccctttttgttcttatttgatcattccaggaatgctcataccttagtgcctaggtactttggggttctctcttcctagaacacttctcagaaaatgagagaatgtcttgttcaagtgctattatatttactcattgaaaccttccataattacctacttgaaattatggcatccactccactcctcacactctctattctctttccttcctgtattttcacattggcaattatcatttcctaatatacaaaatcatatacacttttttattgtctatccccccttcattagaatatattctgaaacttagatgaattctccagccaagaaaaacatctgacacatagtacgcatttatcactacgcatcgtttttgttgttgttgttagagcaaccctgcatttctctactctgatccattacattttaattttatattttagcaacagggaatgccttatttctttgtggaggtttttttattttgttgtttgttcttctgttgtttgtttttttgtttgtttgtttgtttttgagacggactcttcctctgtcgcccaggctggagtgcagtggtacaatctcggctcattgcaagctccgcctcccaggttcagccattctcctgcctcagcctcctgagtagctgcgattacaggtgcccgccaccactcctggctaattttttgtatttttagtagagatggggtttcactgtgttagccaggatggtctcgatctcctgacatcatgatctgcctgcctcggtctcccaaagtgctgggattacaggtttgagccaccgtgccgggcctagggcatgtcttatttctatatactccttctacaccttttattctggcattgcaaattcctagcaaaacatcctgaagggttcatgctgaaagggcaacctactcttcccatactatcttactgcaacttgttcttacttcagtcttggagctgcccattacatgagccttgcagtggcttggacatcaacctgtgagaagtcgccagcatccaaaatatctgagactcacagaagactcagcataagctcctgtaacgactgtatttcctcaactgcaggatcaaggtgtggctgtgaatgtcactctcatcagtactcattttgtactgcttatggtttgtttgtttgtttgtttgttttcagggaaatgaggttgagatcaaaaccaggacccagcgcatgtgattctgtatcataaagaatatggaagtacatgtatggagctctagtgaaatttgcttggactcagttaagatgcaatggtttgcaagtagttataacacctgaattcctgggacaacttccgattacttttagaacacagagacacaatatgggcatcatttcaatatcagatcttatttgtctgaaaataccagatcactagggcaatgaaataaacaaccagctacaaaccagctacaaattatctagagggtacagcctccattctctacaggaaaagagattcacattcttagtaccaggcccagcaataaacaccttaaatattaatgttattccatttcatatccacaataagcactacggcaaggtaaattctatcggctccattttatttttaattgcccaggctggaatgtagtagtgcaatcacaactcactgcagcctcaacctcccaggctcaagccgtcctcccacctctcagcctcccgagtagctgggatgacaggtccatgccaccacacccggctaatctttgtattttttgtagggacagggtttcaccatgttgcccagtctgctctcgaactcctgggctcaagcggtcctcccgcctcggcctcccaaagtgctaagattacaggcgtgagtcactgtgcccggaggccccatttttcaggcaaggaaattaaggctcagaaacactaatatcattgcccaacttcatgcatatagcaaaagacagggttagaagtcatagctatgtcttcctgactctagactgtgctttttccactacaagggatgaaactggggaaaataaactgctcaaatgaataaaatgctcaaataaaaaaatacaaataaataaataattttatattttagcaacagggaatgccttctttgtgggtttttttttattttgttgttgttttttttttttgagacggagtctttctccatctcaaaaataaataaataaataaataaaaataaaatgctcaaataaataaaaacaaaccaatgaacaggagtgctggtagacctgcttctttgcgactgcttaatggcttaaagggccattcatttggttttgaagccaccaaagccagggcaaggtgaaacgtttagtccaaatgggtccctcaccccatttgggaaccaatcactgtcccctatagacctagttcattgaaggcatttaactgaatccaatcatccacattactaattgacctccacaagccaacaaaagaaaagatcggttcatccaattaaccttgggactagctcacccttgatctcaatgctcatccagatggagagaagtcctctgggccaagattgggaaactgagcccccctttctcaaagctggcagctttttaaaggccaccaactccatttcacaagagatgaggagagacagatggtgaatagagtacctgcaaaaactcaaagatacacagggccagtgtagcaacttgcacacttgcaacttgtatttccccctttttcctcccaagtagtctcagtctcccaacctgattgtcttataagccaaaacagcttttgcgcagcttgatagcctcagccttgatttttaaatgactagaaattcaggaggcaaaagagcgatagtcttagctcaaaagtcaaccggacctgggtttgaatcccagatccacagcacaacagctgcaaaaccttgagcaattagtgatatctctaagcctcggtttcttcatctctagaagggaaatacaaacatagtgtcttcctttcattaggttgtggctgtgaagtgaagaaattacaggtaaagccttcgacatggggctcagcacacagcaagtactcaataaatgttggttatttattctaaaaaggaaaaaagttagctagtctataaattttataggtcaacatcagtactgaaaatgactattcaccatactctgaatcttctcttgatccgtgcgcttgtaatttctgaattttaagcttctcttaagtccttattggggagtcccttgggatagttaatgttctcccaagactatctgcactgcaccccgcttatgttccttctagaaatataatcaggatgagcctggaaaatctcatccacatcatggttttagccatcgaatcattccctcaataaatacgtattaatcatctattgatcaccaattactgtgctctgtacacagagctgggcactgcatatccagctcatctccactttggtggccaagatactggaaactcaaactgtccaaagcttgatgccatgggctaaactgtatctctaaaaattcatatgttgaagcactaacacattggagaatgtgatggtatttggagacggggcttttgggaggtacacaggtttaagattaggccatcaggatgatccttatgacgggattagtacccttgtaagaaggcactagacagcttgctcactctctcttgaccaagtgaggacacaggagaaaactatcatctgcaatccaggaagagcccctccccaagaaccgaatcagcaggcaccatgatctcagacttcccagtctctagaactgtgagaaataaatgcttgctgtttaagccatttgatccatggtattttgttaaagcagccagaactaaaacacttggtttccaacttcatcttaaaacatgcttctcccctgtctcctttcttggttacaggctccactgaccaacccaaactgaaatcatttgagactttccctccctcactctcatatccagtcagtccccaactcttatttgtgggttctagatttgaaaaaaaaataaaaataagaagctcttccatctttataaacagagctttttctccattcatgactgatttctactcatcctcagggctcatggtgtctcctctaaatcctccagcagtcttcaaggcggtcttattactttcactcttccctagtagagtccctgccgaaaagccattttctgaaacacaatcctgaatctgccccttttctgcttaaaaaccttcaagaattcacaaaacctccaggatatagtctctgctcctcagctgggaaatcctaccataactgagccctggcccccgcccagccatttctcaacaagcccccttcactttagattcctcagcctaattgcaacatccccaaatggtccaggtgctttcaaacctccacgcctttgcaggtgctgttccttctgctccaaccccctctccattccttgactgctgatcctatactttatcctcatctttcataggttcaaatccccccatgggccattactgagcccccttcccaggctgtataaggctactactttcctctctgttccaatatattcccactataataaatatgacacagtctattgtaacttgttctttccctctttctctgtccctcctccgcataaccagatggtcactcctttgagaatagagagatcctgtcttatttattttcaatgccatgcaggttttaaggataaaaatcaagaaaaaataaagttttggcaactgtgctaaagccagaaatttctgaaaatgactgtttaatgcataccatggggataattataacgataataacaatatcaactattttaagtgctaaatatgactaaacattttataggcatagctcatttaatccttttaaccaccccaggaagaagtattatttttgctctcttgttttttggatggggtaaatgaagcacagatctctctttctctctctctctcacaaacaaacacacacacacacacacacacacacacacacacacacacacacacaatgggtttgggattcagaaaggcacagttcctaaactggctctgtcatttatcatctatgtgacctgaaggcaattcacttaatctctatttgtttcctcatctctggaataagaaaagacttgttgtggtaatttaaaaagactatttacaaaagtattgaaccaggagcagtggcatgcacttgtagtcccagctactctggaggctaaggcaggaggattgcctgagcccaggagtttgaatcctgcctgagcaacatcatgaaactgtctcataaaaaaaataaagtttaaaaaaacaaaattaaattgacacatagtaggtactcagtgatattgtctctttctccaaacacttacccagacctgtatgcttcaggaatagtattaatgtcttaaaccgggtaactagtctgctgactggctgagattcaggcatgtcagtatcgcttggctccagcttacctaatagactagctctgagtctgtctccatccatgtctcccacccacacaactctagcctcatggataaggtgaggctcagggagtgtgacctgggacgaggttagaatgagcatgactgccatgcagtttgcttgataacttcgaaaaagctgaaagcttagcagtttggttttgaggttgtgatgcaaacgtgtaagtgttcgatgtgtatttctgtcaaccacacctgaaaggccgtgtgcaacaccatgtgcccaggtgcggaagctcagagacttgacgtaggcgggaatttgccgtgatagcatttaagcagccatctgttttccaggagattctggagccaccttccccatcaagcccccctttcccgtcctcacgcacccccagctcctcactcaggaatacattgacatttccagatgtattgattacaggggcagactagctttgggcgggagaagggagagaaatggattgactttattatttgtgggtggaaaaaaagaataaacaagggtgcttttgtttgaaggacaaaaccaaaattatcggttgaatggggctgaattaagcacttaaagttcaatccttccagagtgctgacagtgcacaggcggagatcaatacagaaactatttgggccgtggggaacctgggccctgcttattaaccgctaattataccaagttttctgccgaaatgggttagttcccttcaagattacgatacaacagaactggttggcactgtcggacccgggtctgggatccaacccctggagcaggaagtccaaggttcaggataaactcccaaaggccttctatttatggagcccacttcccaatttgccacttgcaaatcagggtgtagacagcccaccactttcttattagaattttaaaataagactgccaacggcaagacggatatttcactagggctttcagtacggccacaccagttgttcaaaacagggacactctcccacgccagtcgctcagcaacctcccctgctacctcacatgcccctcactctcattatccaggcttaacacctggccgagcaagggcctgcggggcccgctccagcatccactctggtgaatctgtgctcatgccctcccggtgctcaaacattttgagcacgaccctgaccacaggcaacaactttccataatccgttagtcaccagccagtctacaaacccagatgccttcccgtggggagggggatattgattgtacatacacaatgtcacacacacacacacacacacacacacacacacactatataaatacacaactgcatgtatatgtatgtagttatgtatatatacagttatatataaccatataaaatatggaaaatttatatttcatattatattccattaactatatattaaatatgtatatatactatatatagttttatacacttaatatttaacgtactaaacatttaggactaaaactaaatatgtactatatgtatgtaactatagttacatatagtacatatttagtactaaatatactatatatactaagtatttacatatctagtatacataaatactatatataccatatatatttatatataataatatataaatattgatataattacatataatatatatttggcactaaatatactatatatgtatagatagtatgtgtatatataatatatactatatatgtgtgtatatacgatatactatatataatactatatatactatagatactgtatttagtatatactaaatttactaaatatatattcagtatatactaaatttactaaatacatatttagtatatttagtatacataaatatttatagttacatatagtacatatttagtactaaatatatactatatttatatatttagtaaatatataaatgaacatgtactatatgtaaacacatgtaaatatataaatgtatatattaaatatataaatatatagttacatatagtacatagtatatatgtagttatatagagtatatatagactataaactataactatatatatatatatatgaactatacacagccatccctcggtatacacaggggactggttccaggacccccaggtgtaccaaaatctgtgcctacccgagacctgcagtcaaccttgcagaactcaaggacaggaaaagtaacccttcatctacacaggggttttgaagcagttcacatctgtattgttcaagagtcaaatatagatagatagataggtagatagacagacagatagatagatagatacacacacgtatatagatgcacacacatagtttatgtaaagttggtgtgtttgggagatatttccatgttgccacttatcaatttatcttatctttttaacagctacatggcgcccagtagtacggatataccataatttagccactccctagttgatgaatatttaggttatcccacattttctctatcacaaaacatactgcaatgaacaccttgaacatatattattctgcacatatatgaatatttccataggatggattccaagaagtggaattgttgcgtgtttttaattttggcagatcttgacaaaccattcctactttctctcatacaaaaatgatggtgacatgtgcccccatttatctggatggtttgcaggaatgagccccctcaaagtggtctctggtcaacacaacgggtctctgtgatgtacccacctgcatttagcaatcagagttcacagagcactttccagtctgcttggcacacattcgttcacaaagaagctgagggaagcttcattgctgcttctaaaaagcagattattccagatccccgcaaagcttccagtctgttgagctacctgaaaatgacaagcagcaacttccctgcagagacctggagtcagagtttggccatcaattgccacccagaccttgaagccactctgcttgtctctagggcaatgtgaactcctggccatcatgccttgcttaggatgtcaccaagtgtcccctgaaaaacagctgtcagtctgtccctctaatcataggacctcaaacccagcacagagagccaaatagaaagcggatcctattccattccctttatctccctgtttccattaaaaataaaagcctcagagcatgcaagcaggcagaggagagggaagtattgtccacagtcaaagcatctcgacctccagatcagtcagccagaatgtcctgctacacaagcatttttattcgttccaggatgttcttgaggcagcttccaaaaatgcacataacataacaaaattggaaagtgcaattaacagacaaagtgagaaaaatgaaaaatatatatgagacaagatataaagacccaacctaaatgcctaccaatgatagactggattaaaaaaaaaaagtgttatatatacaccatggaatactgtgcagccattaagaaagaacgagctcacatcctttgtggggacatagatggagctggagaccactgtccttagcaaactaacacaggaacagaaaaccaaatactgcatgttctcacttagaagcgggagctaaacgatgagaatacatagaggggaacaacacacactggggcctatcaaagggtggagggtgggaggaggaagactcaggaaaaataactaatgggtactaggtttaacacctggatgatgaaataatctgaacgacaaacccccatgacacaagtttacctatggaacaaaccttcacatgtactcctgaactaaaaataaaagttaaaaacaaaaaaagaagaagaagaaagaaagaaagaccgaggagaaagaaacctatatgaggcattaagctctgcacaatttttaggcatttggactccaacaacagcaacaaaaaaaggcggatagagggttcgggagatggaattacatttagtgtctatatctacaatgtgcatgaaaataattcccacattttgactttaatcacagaggctgggcatggtggcttacgcctgtaatcccaacactttgggaggctgaggtgggtgaatcacctgaggtcaggagtttgagaccagcctgaccaacatgatgaaaccctgtctctactaaatttaaaaaaattagccaggcatggtggtgcatgcctgtaatcccagctacttgggagactgtggcaggagaatcgcttgaacctgggaagcagaggttgcagtgagctgagatcgcaccactgcactccagcctgggcaacaagagtgagactctgtcttaaaaaaaaaaaaaaaaaaaaaaatcacagagtggaaaataggaaataaagatggcacaactttcaatttctcagaatgggtctgtttctcatttgaacagcataaaatccagccaggcctcctctccaaccagcaggccaagactcttccaaactgacctgacaccccgccatacccaatcttggcaccccacccacttccccctcctcagggtgctgcccaaaccagacaaaaagcaggcgccaagatgctcccacaggactaaggctcatagtgaccttcttaaaaaaaacaaaaacaaaaaaacttagttggcaactgttaaacattgggaaattgtacataaaaaatcctgatctctcactttttaaaaaaacaagtggaaaagaaaaataggcaacataacatctccccatagctggagctggggccgccttggaggagaaaaggtacctcccattttgtgcactcagcccactttcctgactcatgcccatgcaaaccccagctaggcaacaaatacttatattttttgattattatttttttttagtagaaacggggtttcgccatattagccaggctgatctcgaactcctcgcctcaaaccatcctcccacgtaggcttccaaaagtgctgggatgacaggcgtgagccaccacccctggcctaacttttcaatttttttaacagagagaaaacttaacggggtgagtaaaatggcaccaaaagacctgaacttggacccatgacttggccgtccattttctgaatccaccaaatgaggggtccgacactgaatgacgattctttgcacctctgacaatgttctttcttttgactgacggaggtcccactttccagggtaggggattttgctggtatctacgaaccatgccaacttggcttaaacggtcaagaaagaggggggtctccataatggggccatttcactctaatttcttcttgaaatgcttacccgactggtcccctccctcgccccttacctatccctttcctctctagggttttgctaggatgttagccggatgtaaggtacacggacgaactgcaagcttagaggtagtgattggctttgcaagcagaaacaaaaacaaaacaatgaccaaaaaaaaaaccccgcaaaaccaacaaaataaaacaaagcacctcttcctttgtttaaaatacattttgcgttaaaccagtagcctaccaaaggcagcctggagccttaagtgtgttctggaagctgagccttgagcgccatctgggagcagagggcggcactgcagcctcccgccctggagcttcgcctccaggtccttgcagactttccccttcatgatccatctcttctcctgttgccccaaggtctcagaagaggggatgtgctacaatggggagttatgggttttgcaatcagaccctgacacttcactggctgtggggtcttgggcaattcattgcctttctgcaacatgaggacaatcacacccaccttactgggagactggaagattaaaaaagaaaaatgacataaacgggcttatagcatgcagtcagcaaacttatccccttccgtcacagtgccataactcagtctacagacgagtaactcggggagggggtttgtttggctcatctgtaaaacagggctgctggaagccgacattgcataacccatatgtacaacaactggcacacagtgagtgctcagctgttaataaagggaaggaaaagaaactgtaaatctggctctgttataggtcctgaggttaagcaaatagagagacagttataaagataagtaagacaagagagccaaatgtaaataataatatcaggtaattaattagatgtatgaacaaagttcaaatcagtgtagcttccaggctatatcaattacctcgcttaagccctctacgccctttacaacacaggactgtcacccctgcccagtttacgggccagccaaggagggttcagaaacagcagggaatgtcctttgggcttacgctgtttgtgaccctgcttcttctcggatcctagtccatcttcatcttttttttcccaaaatggttttctcatttctgccactgaagttgaacaaattcaacatctgatttttcctttccctgtctcccctctgcccacaccctcccccagtacttcatcctcctgaggtcggctcgatcccaacttcatgtctgtcccatccagccctcttcaattccactctcctctctccagttatgacccctggatgcctgaagaagccttctaactgtgctctccactgtccagctctgctccctccaatctgccctgcatgagcccctgagggatctcaccctttcagcaggtccacctacaagtataacccctctaggtgacataccttccttcgggaagcttctcccaacaaccactgacccacaagaatctctgctttcctcaaacacaagtagacttcgcaactctgcctacctgttagaataacctgaagaagcttcataccacactgttcaccaacaagcacacaaaaagatgctcgatgtcattagccatcagggaaatgcaaattcaatcaacaatgagagaccactccacacccacaaggatagctataattaaaaagatgaacaacgacaagtattgatgaaaatatggagaaattggaaccttataataccgctggtagaaatgtaaaatggtacagtcacttgggaaacaaggctggcagttagttcctcaaagggttaaacagagttatcatatgacccagcaactccactcctaggtatatatatgtaagagaattgatagtttctgtatccacacaaaaaacttatatacaaatgttcataatagcagtattcatggatatccaaaaagtggaaaccaccgaagtgtccatcaactgatgaatggatgaacaaaatgtggtctaggaatgacgtgctgatccacactgcaacacagatgggtctttaaaagctatgtaagtgaaagaagccagtcacaaagaaccatatgttatttcaatccatttatatgaaatgtccagactaggcaaatccatagacacgtaaagtagattaatggttgccaggggttgggggaggggaaatgggaggaaatggggagtttctggtagtgactacagggtttcttttcgaggaaatgaaaatgttcggactgtaggctgagtgtggtggctcatgcctgtaatctcagcactttgggaggcttaggtgggagggtcacttgagctcaggagttcaagaccagcctgggcaatgtagctagatcccatttctacaaacaaaattttttttaattagctgggtgtgatggtgcatgcctgtggtcccaactactcaggaggctgaggcaggaggatcctttgagcctaggaatttgaagcggcagtgagccatgatctcatcactgcactccagcctgggtgacaatgtgagaccctgtctctaaaaaataaaaaaagtcgattgtggtgatggttgcacaattctgtgaatatacgacaaactattaaattgtgtactttaaatgggtgaattgtatggaatgtgaattatgtatctgaataaaacttatatttttaaaaaaataaacctcccattccaatcacttcctcattgttcaatatggcttcatatatttcttcataaataaatatactgatttaatacgtgtttattcgcttattgtctaccacaacagtaaaggtaatttcaatgagagcagagcctatggcgcattcacttctatattcccagtgctttgagcatggcacaaaaggctactaaataagtaagtgccagtgtgtgaatatatgagtacctgtaagaatcagcaaaaataaaatactgtttccagggccccagccccagagattcagacgcaattgatctgagggagagcctgacaaaggtctggctcaagacttcttgagtgataccattgtacaaaccaagacgaagagccctgatccacagcagttgtcatctataaccctaaccctgtgtcacccctgcagatgaggcttcagtagctcaccattacctctacagacattctaaattcaagttaaataacgcagatgaaggactcaggtgagtctgggactttctgtatcagaatcgtcacagatgcctcaaaaaatcagattcccggaccccgttggagacattcagatccttgcagacccctgccagggaattaatgagttcaggttcattccacatgcagattctcgggactccctccaggaaattaaattgagattcccggatttaaccccctggaaggggtcccaagaattcacgtgttgaacaagtgtcttttctcagacatgctgaaggtagggatctacagagtcacattcatgcaaggtctgtggcacaagacctggctctgcctgcatctctggcttcatctctcaacattcatgcccccaccctgtgcaggtccaccaaccccggctactccacgtaacagaaatggcctttccctactccttctcttggcttctgcaaccagcctcccaaccttcactcaggtatcaaagtggcaagcttttctgggttccgtgtctattctgagctcccaagcctcctacagttgcacttaaccagggatgattgtgcttttcaagggacatgtggcaattctggggattttaattgtcatattgggggggtcactactgccacctactgggtagaggctaggaatgcttaaacatcctacaatgcgcaagacagcccccaccgcccccaacaagaactatctggcccaaaatatcagtgtaactgaacttgaaaaactctgctatagtctattgtcatgtgagttcctcgaaggcagggaatgtgtaacactcacctgcataacctcagataccacatacagagcctgacacacagtatttggtaaatactagtggaatgaattatccgtaccttgcatctggcattcaggtgtgttcatttctgccctattttattccagaaaagacgtgtagatacttaaaaaaacttactcaatgcaacaggataaaatcagtgaaggtatcgtagaagcagcagctatgatgaagctataggtgggttgagagcagttattaggattatttttatagccacaaggtagagataagctgaaatttgactctgggcttctggttggcatccatgcaataaaaatgtcccagttgctcaagggaagcacagctctctctaaagttgagaggtgtggggcactgggccatagtgagagtgaagtggacaaccctttctttctttttttttgttttttttttctttttgagatggagtctcactctcttgcccaggctggagtgcagtggcgcaatctcggctcactgcaacctccacctccctggttcaagtgattctcctgcctcagcctcccaagtagctgggaccacaggcgtgtgccaccacgcccagctaatttttatatttttagtagagaaggggtttcaccatgttggtcaggctagtcttgaactcctgagctcaaatgatccacccgcctcagcttcccaaagtgctgggattacaggcatgaaccaccacacccatctggacaaccctttcaacagcaccaatacaccaggagtctttcacaactagttgttataacttcctctgagttcttttcctcttccagaactcattctctttctctttcccatgtaatttgatagtttctttctatctcttaagtttgagcttggccacatgacttgttttggtgaatgaaatgatgatagacatgatacaagtaggagctttagatgtgtttgtgcagctggatgtgaattcctgaatctctcccatcaccatgagaagagcatgccctggctagccctctggttcaaagaaggtaaaaaaatacctggagtcaagctcattcaacttaacccacagacctgtagcctacagcagaaccacacagctgagcccagcctagctcagcacaccccctgctgacctgcagttgcataagcaagcccagctgggttcagccaccccccagtcgcagatgcatgagctaaatatatgttcactgttgcatgccacagagtttggggaagattcactatgccccattattgacaatgggtaaccaaaatatctcccaatagcaagttaaagaattacgccaaagcgtggctaaataaataaatgaaagcaatcttttggggggctaagatagaccaaattattccatgttacttaagattcctcccaaactaagtagtaactccttggtgatagatcatattcttccaccaagtgaccaccactgagctgggcacataagaatgcttgatgccaatgtgtcaatcagtatttgattgggaatatagccaacccatttcaagagaaatgctgtgaactaaagtcaaaatgttggcaacactgaacaatcaatcgactgaattggacagtcaatagattcagatgctctaaatgccttccattatatcagatctgccaaaggtccaaaaaccaatgatgcagtggcaaatttcctggtctcatctcccacgcagcatccactctcccccagatggttgagttctttctggtcatcttagatccctccagaatggattttttttacctctcatgcttgcgcaaggctcaacttcaattcgaagaaagccttcccatacttccttttatgaaattacaagcctgggatccctaccttgtctgctcagaaataaaacagactcagccccatctacacttgagttagagttgagagttgcatactctcaactcctcatgtggctgagttgctaaaggtgttgtattagttcttgcactgctatgaagaaatatctgaagctgggaaatttacaaagaaaagaggtttaataggctcacgattccgcaggctgtacaggaagcatggctggggaggtctcaggaaacttacaatcatggcagaaggcagaggagaagcaggcatgtcttacatcaccagagcagaaggaagagagagaagaggaaggtgctacacacttttaaacaaccagatctcatgagaactcactcactatcacaagaacagcaagggagaaatctgcccccatgatccaatcacctcccacctggcccctttttcaacactgggaattacaattcgacatgagatttaggcagggacacaaatccaaaccatgtcaggagtgaaccatggagtcaagcagtcctggtttctatcacagctctgccacttatatgctgtgtgaccttgggaaagcacttagcctctctgagcctcggttgttctaactatacaatggacataatatttacctactttaagactgttcttaggactgagaaaggtaaggtctataaagtacttagcacagcccctgacacgtagttggtgcttaattaatgctcttatcacttgattttgaattcagagagtagacccatcacagcagagctacagtggggtggaaaggggaggtaacggaggtaacaggacccactatgagcacctactgtgtgctagcagctgtgctaagcactttaaatacactctctcatttaatcctcaccaccacctactttgtcaccattgcttctataacaggacatcaagtaggaattctccagttgttctggatcaatgactacagcagacagttggtacctagctcagggtgagagatccccaagagaaattgctccaaaagagggtgatcacacatccccagtttgccctgcatgatcccaatttatacctgttgtcttaacatatctattaataacttctcattccctttcatactcagaacagtccaaatctgagcaacaaattatatggtcacctgtcatggtcaccagccaattatatggtcacctgccatggagccatgggggctgattgcaagaaggaggggctagcatctctatccctgagctgcagagccatgagcccctctagtgcgatcatctgagtaagatggagtgaggacactcttggaaaagctgactctaagcaaagcttaatgtaggaaaaggacaggggcaggcatctccctctcattccctgtgccctaagagtgcgtcacagatgcctgtgatttcatggtagaagacgaagccagagatatagatgagaggctatccaaggagccactaagtgaggggcttggagccacagatgattgaaaggggccaaagggaggcaaggctggccttcccctaagggtctcagtgacagatggggcacatatgacattgaaaccaagcacacgatctacaccagaaccatctcatttgcaaaggttttgagcagcaaaaccagtgttacacagaacaagatcagaaatgccacccataactacgaccttgccaagttaagtagaaataagcctaaactccccgacccactttcctccccatctccacacacaaagagaggaatgggagatgcataaagagctaaacatgcccttcgcacgcgcctcttcaggtccctgccatggggaagagagataacgtttgtttgtttgtttgtttgttttttagatgcagtttcattctttttgcccaggctggagtgcaatggcccgatcttggctcactgcaacctctgcctcctaggttcaagtgattctcctgcctcagcctcccaagtagctgggattacaggtgcccgccaccacgcccagctaattttgtatttttagtagagacggggtttcactatgttggccaggctggtcttgaactcctgacctcagatgatctgcctgcctcagcctcccaaaatgctggaattacaagcatgagccaccgcatctggccagaagagaacttttcattggatctgaaattggagatttaagtcagactgaactaagttttttaatagctgaaagtggccagaaagttaagggacctagcacccactggggtagaaagactgaacatacaactgataataatatttaagaaaaaaaacaaaactagttcatgcttgtaccccatggagttgaaacttctccccaaactaattactgtcgtttaatagacacttggtgctgagtgctttacatattttccttttagggaaaactctgagacacatgggctcaggggaaatatttgttgacttggatggaaaaggcccatcctcagcttttgttttgccctgtcctgctgtctgtctgtgttaagttcaatgcctgaggctttgccaacttgtattccctgtaagggcagaaattcagctcatgtaaacctcacagtaatccttatccccatctaacagagatggaaatggagactcaaagaggtaaagaaactcacccaaagaaccacagctaaaacatttagcagagtagggatttgaacccaggcctgtccacctgcacatcccttgcttgtttgccttattgagctgtctcgtcaatttcatcttcgccagccccaattctcagatgtcccctgggcctcctcaataccatgttgcaggccatagccccaggctgctaaatggcacgcagcctctgtgggagaagactctaattgtgcctgaccacaaggtctgcagggagttaataaattattccaagagaatatttgcactgaaggccttattgactggagtccatttcctgagttggcataattttttttctccagcaattgttataaagcaagtgcaagtcttgaaacctcaactgtagaatctcttgattatcaccaagtatatgggcttccaagcctacctaccttcaaagtcaaggtcatcacaatgggataatccctcaggcaaaaagaaagatgagttttaggggtcttctggtttccatagaaaaggcgctccaggccaggtgccatgactcacgcctatagtcgcagcactttgggaggctgagtcaggaggatggtttgaacctgggagttcgagaccagtgtgggcaatatggtgagatcccatctctgcaaataatacaaaacaaaattcgtaagcatagtggcacacacctgtaatctcagctattcaggagactgaggtgggaggataacttgagccaggaaagttgaggctgcagtgaactgagatcacgccatggcactccagcctgggcagagtgagaccctatctcaaaagaaaaagaaaaaagaaagaaagaaaaagaaaaggcactccagttccattctattctttatggaactattcataatttacagattaatgtcacttttctccctcccaccctcatctttctccctaagaaaaccacgactgatttgttgcagtattataacacccaatgagtagaaacaacccaaatgtccatcaataggggaatggttgaataaagcatgatatagccacccagcagagtactatgaaacatactaaaagaatgagaaggacctctacatccccagtatggaggagtttccagttcattcaaatgaaattagcaaggtttcagaaaagagtatgttgttttgtataaggaagtgaaagggattagaatatatatttgcttatattagcgaaataaaataataaaaggctaaaaccacaaaaaaaaagtttcctttggtggagagagaagaagaagggtaataggaatgaaaatgggacttctctaaggctgagaagaggggagaaccaagaaagaggagtgtgggagtgctttgttctgccaggtgcagtcaataggtgccttgtctgtaaagaatttaaaaaacagtaatacaatcaactattaaatgcaatttggtatctaaatcaaattttggatccaggaaaaaaggacattggtggaaaaactgatgaaatttgagtaaagtctatagttaatagcattatattaatattaatttcttttgacaaatgtaccatggtgatgtaagatgctaacattagggggaactggatgaagggtaactacaagaattatctgtgctatttttgcaacttctgcaaatctaaaattattccaaaacaacgtgatttctaaaaatatatgaatttcatacacgagtattatgacatgaacaaaaagcaattaaaggtcatccatttttattattactggcaattctaaacaatattggtgatagaactctcccactcctccaaccagggcaactaaccactctgtacctactctgaggatggcttttttatttagttattagtttggaacaatgttaatgttctgtaaagacaaatataaaacaaaatttgaaaacaaaaacagaaagagccacaatattgggcatgaataacccaaatctgagcactgtcaccacgtgctcctctcaaattcagggttttaattttttattctttattacagacaggatctccctatgttgcccagcctagccttgaactcctgagttcaaatgatcctcctgtctcggcctcccaaagtgctgagattacaggaatgaaccaccaggcctggcctcaagttcaggtttgagcagctctcaccaaaatcccactgcagtaaaattcacagtgggcttcaaattcaggtccatctgagtccagatcccaaaagctttctgacagatcttcttgagggtgacaaaacagaaataaaagatcagaatgggaacttgcagttcctcttctgtcctttatagaagtgtcaacggggatgcaaagatttcattatcaacgggactggcactgtgcccttctatcaggcgtctgctctcacagggaaatcaacttggcacagcctcaagcattgaacctaacactgagaggcagccgggcagagcagaaagaaagctgaagacaggccctttccatccaagtcaacaaatatttcctttgagtacgtgtacctcagggtttttcccaaaaagaaaaatccctcttcatataaaccccctagaaagaagtcattgctgcctcaaatgcatgtattcagctgcaaggcttctattgctacatgctttctgattatagccaccatttctaagccctgcaggtgtttgcccatcttggatcctttgaaacagctccttcccctgccccatttgcttccagatatctgcacggctcagcccctccatttatttgggcgtttgctcaaagccaccttttcagagaggccttcactcaccaccctatcaaaaccgggtcacacctcccatctctctccattctctatacctactttatctccttaatgctcactatctcttaacatttattcatgtgttgacttgtcttccctctctgaaagctccataaaagcagggtctgttgcatctccagagcctactattttttttcggtgtaaacagtaggtggctcacgcctgtaatcccagcactttgggaggccgaggtgggcagatcacgaggtcaggagattgagactatcttggctaacacggtgaaaccccatctctactaaaaaaatacaaaaaaattagccgggcatgggggcgggcgcctgtagtcccagctactcgggaggctgaggcaggagaatggtgtgaaccctggaggcggagcatgcagtgagccgagatcccgccactgcacaccagtctgggtgacagagcgagacttcgtctcaacaacaaatatatatatatatacatacattaggtgcaaaggccctggggtgcaaacgtccatgcatgctaaaggggagaaggaaggccagtgtggccagtgtggctagagatgagctaagggaggagaggagggcagggcctttgtagactacagcaagtggttttataagggtcttattctgaatgcaacaggtagctgctggatagtcataagccgtggggtccgggtggtggggaggttgacatcctctgattatatttattttaaagatcattctggtttctatatgaagaatagactgaataaggcaagaggtaaagcaggggaccgattataaaggctaccagaatagcccaagggagatgggatggtggcttggattacgggggtagtgctgaagagaggaggcttgtgggtgtttcttggtaatttgtggataaactagatgaggggcatgagagaaagaaaaatgtcaaggatgactccaagtttaaggagctgagcaagggagtggatgatagtggcatttactgagatgggggttctgcagaaaatacaccttgaaaggggaataaaaagttagttatgttttgtcccagaatcacagcaataataaattagtcttaatgcattaagttttggggtggtttaataggcagaaatcgatcactgaaacattctgtctaataagtactgtttccttgatttcaggatgcttttgatggagtaatgagcgtcaattaaatgcacacatcaaatgaaaaacacatcacgattttagaaacctacttaatatcttctttagagaaacatctattaaagtccttagcccactttttaatcagattgttagagttttttttttgctattgagttgtagaaattccttatatattttagaaattaactccttattatatagatggtctacaaataatttttcccattttgtgggttgtcttttaactcgattgtttcatttgctgtgcagacactttttcgttttacatagttctcatcatttatttttgttgttgttgtctgtgcttttggtgtcatattcacgaaatcattggcaagaccaacatcatgaagtgtttcccctatgttttcttctaggagttttacagtttcgggttttacttgtaagtctttagtccttttttagttgattttcatgtatggtgttagataaggatcctatttcattcttttgcatgtggttatccagttttcccagcatcacttattaaagagacaatcattcccctattacatattcttggcaccattgttgaagattatttgatcacatatgtgtagatttacttctggacttgctattgtattcctttggcctatatgtctgtctttatgccagtaccatattttattttataccagttttaattactgtggccttgtaatatattttgaaatcaggaagtgtgatgcttccaacactgttcttctttctcaaggttgatttggctatttgtggccttttgtggttctatacaaattttagactcattttttctatttctgtgaaaaatgcctttgggattttaatagggattgcattgaatctgcatattgctttgcatagtatggacacttgaacaatatgaagtcttccaatccatgaatttggaatgtctttccatttgtttataccttctttcatttcttttttttttttttcttttgagacaaaggctcgctctgtcaccaggctggaatacagtggtgtgatcttggctcactgcaacctccgcctcccagattcaagcgattcctctgcctcagcctcccgagtagctaggactacatgcacgcaccatgatgcctggctaattttttttattttagtacagatgggttttcaccatgttagccagaatggtctcaaactcctgacctcatgatccacccacctcagcctcccaaagtgctgggattacaggcatgagccaccatgccgggccaccttctttcgtttctttcaaggttttataatttttagtatacaagtctttcacctccttagttaagccaacaagtttatgaaaaaatgtccaataccacaaataatcagtatcactaattgcaaatcaaaaccacaatgagaaatcacctcacacctgtcagattggctagtgtcaaaaagacaaaagacaacaaatgttggtgaagatgtagaaaaattgaaacctttgcacactattattggcaatgcaaaatggtacaaccactaagaaaaacagtacggaggtttctcaaaaagttgaaaatagaactagcatatgatccagcaatcctacttctggatttatacccataaaaattaaaatcagaatgtggaagaaatattagcactaacatgttcattgcagcactgttcacaacagccaaaatggggaaaaaacctaaatgacagattaatgggtaaagaaaatgtggtatatacacgcaatggaatattattcagccttcaaaaagaagaaaatttgggatgggcacagtggctcacgcctgtaatcccagcactttgggaggccaaggcgggtggatcacctgaggtcaggagttcaagaccagcctgaccaacatggagaaatcccatctctactaaaaatacaaaattagccaggcatggtggcgcatgcctgtaatcccagctactcgggaggctgaggcaggagaattgcttgaacgcaggaggcggaggttgcggtgagcagagatcgcaccgttgccctacagcctgggcaacaagagtgaaactccatcagaacaagaggaagaaggagaaggaggaggaggaggaggaggagaagtgggggggaagggagggaggggggaggtgggagggggaggaggagcaggaggagaaaattctgcaagatgtgagaacaagaattaaatcttgaggactttatggtaagttaaatatctgtcaaacaaagacaaatatttcttatttccacttacaggggtcatgtgaaatagtcaaatgcgtagaacaaaagagtgtaatggtggttgccagggctgtggggaggagaaaatgaggagctactcatcaatgggcgtgaagtttccgtcaggcaagatgaatgcgttctagagctctgctgcacattatgtacctagagtcaacaaggtattgtgcacttaaaatttgttaagagggtacgtctcatgttaagtgttatcacaataattttttgaaaaaaaatctgtttactatatgccttgacatgaagaatataggtaccagatgacgtatctatgcactccaagctctgtgtctcacatttatttcaatcacatgtagataacagcaagaatctttagacaactcagattgcatctggcttatcacctggtttgtccctaaatttatcgtttctacagagtgagcagacatgtccctctttctctctctctccctctcagggcatatttcaataacgttctctttttgatgaagtcacacaagacgcagaagcagtcctaaaactcaatttatggaagtcagttgagaccagactttggattgaacctcccaaacctgcctaattaatgacacacattatggcccctgctcccctaactgaatgcagcctccaaaccttgacgtgttttcccaacaataaaatgcagtaaatgaatgagtgtcctgagggaccgtggcaggaataaagggaaagccatgaaagatagatgatgtctcaactaattttatgatttatcgatctccactttgctcattttgcaatgcgggagagctcatttttctgccaggcccacagtggtgtcacccttgctaatagatatgattaccatccccaaaactgtgtttgtgaaaataagaagtgtggcttctctgctgctgctgacctcagcagttttcttttattatgtgctggatccgctaagaagcaaaattgatgtacttatccggggactctgttggacgggcacaagcattttcctcatttttcttccaaacaagttcatctttaagcaagtacagattcatggtttaaattacggcattgacacatcatctgttttcagtgtgtgtattcttacaaggaggatcttttatgtgatcagagagaggaagagaggggatagaggtgtcacccacgtgccaagttgagtttaaagatatacatgttaggacacaatacaggctgctttggatggttcaccaactgcattcagcaaatattgattgggcacaggtattgtgctaagcatgccgggggtattcagtcatttaataaatatttattggcaggccaggcacagtggctcacacctgtaatcccagcactttgggaggccaaggctggcagatcacgtggtcaggagatcaagaccaacctggctaacacggggaaaccccatttctactaaaaatacaaaaagtagccaggcatacaaaaataaaaaaaggtgcacgtgcctatagtcccagctacttgggaggctgaagcaggagaatcacttgaactcaggaggcagaggttgcagtgagccgagatcgcgtcactgggcgacagagcaagactccgtctcaaaaatacatacatacatacacacatacatgcatatttattggtgatttcatatatatagctggaattatagagcaaaataggcaatgtctcttttatcatagaaactatgtcctgattagaaaagatggaaagttcaaaataataattatgaagtgcataaaatagggtgtgttagtcaactatgccacagcagtgctgggtagcatacagccagtaactccacaacagcaagcatgtgtacctcatttatgcaactatggtttgtcctgggtttggctgatctaggctgggcttggctccaggccacatgtttagttcatgtctgttccttgcatctctcactcttctgggaccaacaggttacccagggcatgttaccctcatggccatggaagaactaaagtaggtgagcccaaccactctatcacatttcaaatctctgttcacttctacccactaatatcctgttggccaaaacgagtcatatggccaagcccaaaatcatgtggtagggaagtaaataccatccacaattggagcggggaggccatcaacacttgctgggcaataatccaaactgttatgcagaatgatgtgataaaagggatcagagagaagtgctgtgaggaatggggatgagttcactgggatgatgtcagagaggcaggcgagggccagatcttgctgagctacggaaagaaatggcacatttgatttgtgatttcaaataatccctttcactgctatgggaaaactggattgtaagtggcacgagagcagatgcagggagtcccagcaggtcggacactggttcagtgttctaggtgggtggtgatagaaggtgtgcacttgaatagtggcaatggagatgaaggcaagcgctagactgagaaacagaagcaaatggacagggtaccaaagtggataacatgtggtccctgaccttaaagagctaataacctacttgatgagaaaaagatgtacagacacagccatggtttggagagatatgtttttaaaataaggccatacacaaaatactaaaaaaaaaaaaaaaaatccaaaaaagagctgtgaactttgtctgagagtatctggataatttcagggaggaggtgatatttgaggtggacttccaatgtgtcatgtcaaatagcaccaagctgataagcaagaaccatcttaatcagattgactgggtgccacaaagccacacctatgatggacacacaggaaagtctagcagccaagcagagggaggatgactttccacaaagacaagtatttgtgctgtaagactacatgctttgacccatctgcaaaatgggtgcatctgcaagaaggaggccaccaggcaataggctgggggccaggtaggtacttcttgagtagtgtcacacactattcaaggagatctgtgactcagtatacccaagagaacctccaatttgccgccattctgccaaagggatgctagaggtttgaggaaagcagtctggcaaagataaatcctcagaattgaaagacctaaaagcacagaaccatccgtgtccccaactaactcggtgatttctttgctcttcagtttccacaaaaataaaatattatttatataacatatgcagatatatgcaccaagatacaaggcatgccatagactctcaaatatttgttgaacagataaaggaacatttaacacaacatttttataattgtaaaaactttgagactacccaaaggcctttagtaggccaataattaaataaacactggtatattcatatcttggactattacgtagctatgcaaaattttctcattagaaaaattcattattaatatgtgggaaaaacgtggaaaacacggaaagatgcaagaataaaataaaacacatcccctagagataacctctattaatattttgtagtctctgcttccatcctgtgtggtacttttgtagtgcatgggcattgtgtacctatgtgtttttagctaacataaatgaaattatattaaacatatgaattcaaattctgcttttttccctttaatattgttttatggtgttttgtttgttttgagacagagtcttgctctgtcaccaggctggagtgcagtggtgtgatctcagctcactgcagcccctgcctcatgagttcaagcaattcccctgcctcagcctcccaagtagctagaattacaggcaagtgccaccatgcccggctaattttttcttttagtagagacagggtttcaccatgttggccaagatggtctcgatctcctgacctcaggtgatccacccgactcggcctcccaaagtgctaggatcacaggcatgagccaccgtgcctggcctacagtgtttttctatataaatttttacaaagaggtttagcaatgtaaaaaaattgcattgattttataagaatggaaacatggaatacaaaatcatgtatctggcatgagtttaagtacgtaagtatttcgtatagacagacatgtgtgttttgtatacgtctgtatgaatgaccgtaagaaaatatacccaaggttagtaatgattgtcttggggttgtgggattattatgggctgtcatttcatcacttatatttttctgcatcttctttataacataaaataagcatgtattactactgcaataagtaaaaagagaaatgttttttgaacaggagcaatgaatttgaaagaatccaaggacgagtgtattaaccaactgtgatatctacgactgtggtttcacaaattaggggcatacttgcagcgccaggctcacctcgacctcctagagttatgcctcctcctcaggccaggccttagaggtcatgagacaggctgaggaaagagaggtccaggccagcatccatggaatctgtcccattagctcagagacaacaaaaaggggacagatccagagggtggggggactggcaatgcaggacacaggaaaagctagactaaaagatcccgggcaccgggagatcaaagggccaaagcgagcagcagccagccctcagaccaaagactccccaacacgccccacacagcaggaattcaagaaattccaaagcctaactctgaggatgtgctcaaaccctcacattattgaccatgatggcaagaaaagtcttcagtatcattttcgttatagaagttagcggagaagcaggcagtggaaacccaccatggtgatcagacagggccctttgtttgcatgagcttaattattgacttagaaaacttgagcatcctcctttgccagagaaagaagcacctttttttttttttttgaaatggagtctccctctattgcccaggctggagtacagtggcatgatctctgctcacggcaacctctgcctccggggttcaagcaattctcctgcctcagcctcacaagtagctgagaatgcaaccatgcaccaccacgccgggctaatttttttgtaattttagtacagacaggatttcaccatgttggccaggctggtctcaaactcctgacctcaagtgatctgcctgcctcggcctcccaaagtgctgggattacaggcatgagccaccaagcccgggcagaaagaccaattctttcaccatggcattcaaggcttccctgggtctgtctccatcaaccaacctacctacacacacacacacacacacacacacacacacacacacacaactattgtccatacctgccaagactttgttcatcctgtttcctctgcctggaaggcctttctctcatttccacgtatctaaattctttacaactccaaagtcctcttcttaaaaagcctttggaaaaaactattgagtgaataaagcaagggtctgctccagtcctgtctgagtgaatcagacaggtctgctccagtccaggcccctctccttactggctgtgtgacgttggacacgttcaatcgtccttctgataccaattttctaattagtaaaattagcttctaattgaagctgcctccaaggctttctgtaagaattaaaggagaaaattatttcagatatctatttaaaagtagccgaatttatgtcaataaatggcaacaaatataaattttatatcctctttcctagtatcagttccccacttcattttctaggtggcattttgcctacgggttcaccatcttctgtccaagtttacttttatgcctcctggagtcaaaggcaactgccgcctctgagtttagacacaattgggttgcatcttagctctggtaccttctagctgtgtgtttttgaacaaatcatcacacctctcagagcctcagcttccccatgtgaaaaatgggtttaatgtttcacgttggggagttgagtgagtcaatgtacattaagctcttggaacggggcctggcacacagccctagaagggttcgttgttactgcctcacagggttatggtaaagatggggtgggtttctgtttgtctgcaaagcccttatccaaagtcccaacacgtagcaagccctctgtaaatatcagtcgtataatcaggaatttagtaaacaagtccaatgcccctcactccacccccgcagcaatgtaatagatgtcagtcaatcccttttttgggtcttttcagaacaaaaacccctgttctctcctccagtggggtctccctgggctaactgaaccatcctcctggtcttaaacaggaggattcctggagccaagtgggatccttctcctgcaccacgagggcccaggggccaggtaacatactgtctggctaatctggagccaagcagaaactggcacagaggacatccacaggcttactgcatttccttcccctgtaaaagaaccctacggtccagcccagcaagcacctctctttgaccagctaataaggttataaaaaaacttatgtatctgactttaataatggtattaaacccagtaatctgactttaatagtggtatgccaaggcaaacatggtcctagcagggaccaggagcgagggcaggtgagggtacacatctgaggctgagcgacacctcctatatgaagttgattcatgttggagcaaatccgggcagggaccagctgattcaggcagttaagttattgctctgccagtttaatatttcgccatctgctaactgaaggctctactgcctgctgggtcctataaagacttttatttattatactacacatggcaacatctgccaccaggatgaggctctactcggcgccctaattaaacaaacacacacttcagtgacagcagagggccgggtctcgctgtgagccgaactgttgctgggagttaaaaacttggagtgtcccatcctgaagagcctttgctgagaaaaggtagcatgagtcattcacctcctggtggccactaaagatttacaggtgatttaaagcaggctggaaaaaaaaaattaaaaggctgggtgtttatctcccctaacctgcctctcactcccaaacagaacttgagtttcagggcttggtttggccaacggtcagaattcctgcttcacactgtcacatgagcccctgcccttcaatctccgtgcacactctcagaaacaagccctgcagatgaagaaaatgaatgtcaaagtttccattcaatttttcattcatgcatgcattaaaaaaatatggagtcattctactataaagacacacgcccacgtaagtttattgcggcactggtcacaacagtaaagacttggaaccaacccaaatgcccatcagtgatagactggataaagaaatgtgacacatatacactatggaatactatgcagctataaaaatggaggaattcatgtcctttgcagggacatggatgaagctggaaaccatcattctcaacaaactaacacaagaacagaagaccaaataccacatgttctcactcacaagtgggaactgaacaatgagaacacatggacacagggaggggaacatcacacaccagggcctgttggtggggtggggggctggggagggagagcattaggagaaatacttactgtagttgataggtgcagcaaaccaccatggcacgtatatacctacgtaacaaacctgcacgttctgcacacgtaccccagaacttaaagtataattaataaatgaataaagaaggagtatgtgctacataacccgtactctagcaggtgagctggtaaataagatagacatttgtgtcttcataaaagccccatttgactaagtcaagaggacacataaatggataagataattgcagatcgtgctgagtgttaggcagcaaataaagagggcgatatatatattagatactgggctggcatacaggtatattagtttcttattgttgctggaacaagttaccacaaatttagtggcttaaaacaatacaaacgtattatcttacagttctgtacttcagaagtccaacatgggctaaaattactgagctaaaatcaaggcactgggcaaagatcaagatgtcagcagggctgctccttctggaagctctagagaacatccattttcttgctttttccagcttctaaaggctgcctgctttctttggcttgtggccccttcctccatcttcaagggcagtaacatacctgtttccgtcatcacactcctacctttgactcttcgattctgcctctctcttccacttttaaagatctttatgattcctttgggtccaaccagatattccaggaatagctccctaaggtcagctgattagtaaacttaatttcgcctgctgccttaattgccctttgccatgtcacttaacatactcttgggttccagggatgaggatgaatttcaaagttcccattcaatttttcattcatatatgcattcaataaatattgagtatgtgctacataatccatactgtagcaggtgagctggtaaataagacagatgtttctgtcttcataaaaaccacatctttgcggggtgtcattattctgctgaacacagtggacaagaaactactttagatagcgtggtcctcaggagggcttctctgaaatgtgatcatgagaaagggttgcaagcagaaggaaaaggaagtatgaagatccagaggcaggagagaatttagaatggctttggtactgaagggaaactagtcatgggcttaggagtcagagagtcatgggcaagggaaaagtggccccagatgaagctgaaggggtgaaaaagggaggaatcagatcacctagagtcttgtgtgccttgcagaggcagcttggtgcaatgatcaaaagcccagacattggaagggaacttactttcacttaacacctaatttttaccagaccctgtgccaggacctttaaatagattatctcatttagttcctggaacaagtacatgaaatatgcattgcaattcccattttgcagatgagaaagtagtgacttaaacaactaaattataaagacacactgatgtgaattctgaaatatctggctcagagcccttgctttctccaccactcaaggctcctgtccaaatgattttgccttccgtgcatgtgtgattatgcagccaggatcctctatcttcttttttctcatttaacttgatagacagactgcagaacctcaaaatcacctgcagtggagtgtcccactgaatttgtgttttgcttaccgctttatcaagaggtacatgaaattcctcttgcctgctctaaagaggttggatcatcagtgagactgaacctataagctctccagtcccactagggaggatgcatgttatttaggacaccagctgagttgctggtacaagagatccaaaaacacagtgactcaggccaagtaggaatctacttctctttcacagattggtccagaggtacatagtctagggctgccatagtttctttgccccttgcaatcagtcatctagggatctggttccttgcattttaatgttcttctttcctctgaagtattgtcctcatccacatggttgaagtagacttgccagaactccgtcaaattccaacgtgtagaaagaggaaatagagaatgaaaggcaagtattttcctttccagtgctgtgacttgaagctgcacgcatccgttctgctcacaccctggaggcagtaatttagttgcgtgtccacacacagttgcaagagaagctaagaaaggtagtctctacctagatggtcacatacagagtgaaagcttgagaagttctactgctaacaaaatgaaagagaaaataaatactggagaaaaattagcactctgccacaaaggatgactgcccttttggtttatctaaagtccaggcattctttgcctgctggatatggtttgtagaatttttagaacgaataaatctctattgttcagaaaagagaaccaaattaatttcttttctctctcaggggctgaaagtaaaaatggcctgatcctgggtaggtctcattcacctgctgtcattggaaaaggcattggagttgtggggaccacggtgagtggataaacaaacctcatccagaacaggacctctaagaggggttaccgtgagagttaccagcctgcactacattgtagcccagcagcactggctccgtgttcaacagtgccatcttctctcagtaggaaacccaaacaggctgacaaataccagcgcttttccctaattgggagtacaagttgtgaggactcctaattatacaagaaccctggaactggagcagaaagtctcaataaggtaattcaggacttctggccaacctggaagctggtaactcaagtactcttgattaaatttggggaaaaataatttaaattcatgatagtacttgctcttgaggtattagtagaaatgctatttctgtcaataaacaaaagagtttttttaaaaataaaaaaaatcccctgaatatatcctcaaacgtgatgccaaagcaaagattgataaaatgccaaagatctggctaaaaaagatgcaaagaattcatggaagagccaatgtgacccactaaaaccactctaagtgcaatttttgaataaaatcccacttaaatgattgtttacctgaggtcaacggaggaccagggcagtcccaatgagtaagggacttaacatgggccacgggggtacatattgatgacaggaatcgcctgacaatcactaagctgatggcctgttctccatatgttcctcatctctccacctaaatttaatgtatccaactttttggaatccttcctcttagtcttgcattctgtacgtatatgaggaaggtaaggaactaggggttgcctaggagggatggagaaggataaatgcaaaaataacactgaagcgatggccttgcagccagatgacattttaggtagatccgcacaaatgcctacaaatgaaactccagggcctcaaatgcttcatctgtgaaatgggatgattacttgaatcaccgatataaattatgtgttctaggaacaaacggtggctcacgcctgtaatcccagcactttgggaggccaaggcagacggatcacctgaggtcaggggtttgagaccagcctggccaacatagtgaaaccccatctctactgaaaatacaaaaaaagttagccaggtgtggtggcaggcacctgtaatcccagctacttgggagggaggttgaggcaggagaatcacttgaacctgggaggcggaggttgcagtgacgtgagatcacaccactgcactccagcctgggtgacagagtgagactctgtctcaaaaaacaaacaaataaacaggagcaaaagcctaagctcagctttgtggctcaagaatagtgtccctgaggaggcagcatttgaggagggtgtagaaggaggggagggattttgatgggcagagacggtgtagaagtgtaggagaattgtgggaagtagattgtgtggaaggcctcccccagcttttatctcctcaacagtgaagtgggttacaagattattttgcaagttagaaataatgtttgtggaacacacaggacagtgtgtgacattaaaaaaataaatcaagtgattatgattaaattaacaactagtcactgactgtgacaaggttggggaatctgagactcctatgtaaggctagttattttgaaggaagacaatgctggtggtgtcttaggctcctaatggaggcaaatgaaaattctctctgtgtgaaagcattttctacttgggtcataagaatttccatagattaagatcaagcctctgtaagcttataatcaaaggccaccaaactcattaggaaataagccaccatgagggagaatcagcagaattaataaacaacaaatttttactcccacaaacttcagatactggaaccattgaaataatcagatacataatataaaatcattctgattaaaatatttaaatgaataaaagatggaattagaaaaatgggaaaataatcaacgtttataaaaaaattatgaggtatagttgaaaaatgatcaaataaaaattttggaaatcaaatatataactgttgaagtaaaaaactcaattcaactagccgggcctggggacgcaggcctataatcccagctactgaggaggctgaggcacaagaatcgcttgaacccaggaggtggaggttgcagtgagccaggatcatgccactgcactctagcttgggtgacagagtgagaatctgtctcaaaaatatatatataacaaaaaaatgaaaaatataataaaaactcaattcagattaaaaatagcaggaaagagaattagaacttgaagatatgtctaaagaaattatctagggtgcaacaacacaaatagattaggtgattaaaactattaaagagaagttaggagatacagaggacagaaagaaacagactaatgtatgtctaatatattagacatactattgggagagaatagagagactggataagaggcaatattaaaagtgataatagatagaaattttgcaaaggctgggcagggtggctcatgcctgtaatcccagcactttgggaggcagaagtgggtggatcacctgaggtcagaagtttgagaccagcctggccaacatggtgaaaccctgtctctaccaaaaatacaaaaattagcccgccacggtggcacatgcctgtagacccagctactcaggaggctgaggcaggagaatcgcttgaacccaggaggaggaggttgcagtgagccaagactgtgccattgcactccagcctggacgacagagtaagactctgtccgagagagaaaggagaggaggggaggggatggaaggggaggggaaaagaaatgttgtaaaaatggtaaaatacagtcacgtaccacataacattttggtcaacagactgcatacatcagtggctccacaaaattgtaatactgtatttttattggaccttttctatgtttagatatgtttaggcagacaaaggtttaccattgtgttccaactgcctatagtattcagtagagtaacatgctgtacagtcatgtagcctaggagccataggctataccatatagcctaggtgtgtaggaggctacactatctaggtttgtataaggacactatgatatgcacacaatgatgaaatcacctaatgactcatttctcagaacatatcccgattgttaagtgaggcatgatgagatagacagatagatagatcatcatatacactaacacacacataaaatcttcaggtccaagcacagcatatataagcaagatgaatgcaaagaaattcatagctagacatattgcagtgaaaccacagaacatcaaagacagagaagacttaaaagctcacaggggaaaggggcagataaccttcaaaaacactacatttagatcaccacctgagttttcaggcaaagcaatagaagccaaaagactctggaataacatctccaaaattctaaaagaaaacaaccatcattctagaattgcgcttcaggcaaatgtgtcttttaagaatgagtgtgaaatgatgacacttccatataaacaaaaactgagagatttttaccactgataaattcccactaaaagaatactaaaaaaaaaaaaaaaatagcccagaaaaaaaaatttcgagtgtaagaatagttagcaagtaagcttacaaactgagagataaatctaaaacattatctgtgtaaaatattaatagtaacaatctgatttgtgagaatttaagatgagattgaaactactgacaacattgacatttaagtaatggggaagtcattgacattaaagtatcataaagtccttatagtatttggaaggggaagttaagatatttatgggctttcaattttccttgatacacacaataaaatttcaagggagagatgatagaaaagaggttttaaatttttggaattttagaatttttagaatcttaatatttgaatttggaattttagaattccaacaagtaaagggaaaagcagagtttgaaaacaaaacaaaaacaaacaaaaaacctcaatttaaagaaaagaaagaaaagaagcatgaagaaaaatggaataaatcttagaaaccatatagtgtgaacaaagcaagtcttaaaatattatttaaggccaggcacagtgactcgcacctataatcccagcactttgggtggccaaggcaggcagatcacaaggtcaggagttcgagaccagcctgaccaacatggtgaaacctcgtctctactaaaaatacaaaaatcagccaggcatggtggcacatgcctataatcccagctactcaggaggctgaggcaggagaatcacttggacctgggaggtggaggttgcagtgagccaagatcgtgccactgcactccagcctgggcaacagaacaagactctgtctcaaaaaaaaaaaaattatttaaggtatgagaccatctttataaagctcaaaagcaagcaaaactgataaagctttgtggtaaagctaacaaagcaaagaaaggggatgataaacacaaaacaggattgtagatttccacatggggataggatgggggatgcaagaggcacttttcatccagatggatccagtagaactgttcattttagtcaatcagttaggcacttaatgtagtttggatatttgatcctcccaacatcgtgttgaaatctctccccatgttggaggtgggacctattgggaggtgtttggggcaggggagttgattgctcatgaatgacttgctgccattctcaaagaagtgagttctcattttgggctgggtgcagtggatcatgcctgtaatcccagcactttggcaggcagaggcgggaggatcacatgagaccaggagttccagaccagcctggccaacatgaagaacctctgcctccactaaaaatacaaaaattagcagggcgtggtggtaggcgcctatagtcccagctactcaggagactgaggcacaagaatcacttgaacctgcgaggtggagactgcagtgagccaagatcatgccactgccctccagcctgggcaacaaagggatatcctgtctcaaaaaaaaaaaagttctcattcttagtcccaggagaactagttgctgaaaagagcctggcatctcctcctctctctctcgcttcctctctcaccacgtcatctgtgcacacagtccctccacttccccttctgccctaagtggaaacagcttgaggccccaccagaagcagatgcagtgtcaggcttcttgtacagactgcagaaccatacaccaaataaaccgctttttaaaataaagtgcccagtctcaagtattcctttatagcacacaaatggactaagacagcaatgattttatgggtcttcattttgttgatatgtttgataacttacatgttatatatatattatttgtgtgtttcaaatattgcattaaaaatatttaaaaataggccaggcatggtggctcacgcctgtaatcacagtactttgggaggccgaggcaggtagatggcatgaggtcaggagttcaagaccaggctggccaacatggcgaaactccgtctttactaaaaatacaaaaaaaaaaaaaaaaaaaaattagccaggtgtgatggccagtgcccgtaatcccagctcctcaggaggctgaggcaggagaatggcctgaacccaggcagcagaggttgcagtgagccgagatcacgccagggcactccagcctgggcaacagagtgagactctgcctcagaaaaaaattaaaaataaaattaaatgcagaaaacaataggagggtaagtttcccgaggacaagagcaaaaccagagcttttctgtatcccatctactgtacacacagtgggccctcaacaaatatctgcttacattacagccagggaatttgtttactttagtgcattacaaaagaatgagaaaagccgagtcttctcaaaagcaaacgtcaacgcggcagacagaggactaaattacatgataacacagcatataatatagtataatgggcatgatacaggtaataataacagaaaaacaaatctgtttttcagccatgaattacactgtgtctgtggctttgggcaagaagcatgcctgtagttaccctgggctgcaagttgttaaatcatgatggatgatcccataaggaaccaaacaagatcagtggaattcattgatttgccgggtgccctgggaattctttcatttccccccagacctgactgcctcctcctattactggggcagcagttgggctataccacacagactagccatgaagcgggagagaggcccagaaatacaaagccagcattccaggtctagccacaaagattataaaataagcagctctctacatccaatccaaagcaacgagaaggtggttgggtggaggctggaaggacacactcaagaattaaaacttagatctgcaactgctggttttgtgtccgagagtggattattttgcctgcatacagctcagtttttgcattaggaaaataggaatcataatgtctaattcaaggattatttggaagacatctgcttgcaccagatctagcacatagtgggtgctctgcaaatgtctcctttcctcagtaagtttccacacatcttcacctctgaccttcaacttgtaaataaagcagagattgcaatgctgcgtgacagaggagaaaaatgctatctaaaactactactgactgcagctgcttctgtccctaagggagacacattatttctctccagactaaatatattttcttttgcaaaatactttgataggcagctttggttatgaaatgtgaggccccccagggcacagtttagaagaagacagtgaaacaaagaagtagtgaaatagctctgcgttgtaaaaatgaacagagatgccagggtttggcggtatgctaggaagcgcagtgataagagaaagcacattgcaacagcaatccctgttgctgttcttcacctgacagcccgtcctctcctcttccactactttatagctgtcattagaaattaatctggccgagcactgtggctctcacctgtagtcccagcactttgggaggccaaggcgggcagatgacaaggtcaagagatcaagaccatcctggccaacatgatgaaaccttgtctctactaaaaatagaaaaattagctgggtgtagtggtgtgtgcacctgtagtcccagctactcaggaggctgaggcaggagaatcgcttgaacccaagaggcagaggtcgcagtgagccgagattgcgctactgcactccagtctagcgacagagcgagactccgtctcaaaaaaaaaaaaaaagaaataaattatcttcaatctgaggaaaccaatttagaaaaagaaaaataaacaaaataaagaaattatcagcatcttacttactatatagtctacttattcactgtatgtctcttccctcaagaaaggaagtttcctaagggcagcatttatgtgtattttattcattgtcgtttctccagagcccagaagagtgcttggaaaataagaggtattcattatgtttttcttcaataaatgactaagaggggagttttaaagcaaaacttctactgccaaactgcagctcaatgagaatacaaaactattgttttaagtgtgagtttaggggttgtttgttatatggcattattgtagcaacagctgactaatacagatagcaatattggttgcattcagatatgatttaaatcacatcaaagttgcaagactgaggtttggggctcagattctcctgaatttaatcctgtcccattatatcagagcctctcttttctcctctgtagggaataaaccctccttctggagtgatgaaatgataaccttcttcacaggtcactgtgagaattaaaacaccacttttttcataaaaagcactcaataaatatcagtcattaccatctatctactcaaacaattctgatgtttaatgggttcacttattctccaggtaaagtcagtcctgctaaaaaatgaacataagattttgatcctgtacagtgcttgaagttaaaggtatgtaatatgaaataatattttttgaataaattagcaaagtcaaattaattataacacttaaagcttatgaagcaaaatggttatttgcactcattaaaaataggtataacttccttgtttttttgagatgtaatatgaccatattttattaagaaccataaaaaatctttagatattttgatcaatgtctaccttctagaatttatgttaaggaaattattgtaaatttttaaaaaaatattttgtgaatgcacatctttattgaagcatatttggttgcatactactttgaattcagaaatagaaagtcaacagaaaatgccattctcatgcaaataatcaaaacaaattagatgagctacaaagctatttggaaaaaaaaaaaccttcagtgaactaaggacagagaaaaatccaaatgaactaaattccacaaagtgaagatcattttagaggagaggagagatttactacaggtcttatcaaaagcatgctcttttggatgtaaatattttttactttagtctctactgttcttttatacagaattttcagtatacaatcaaacattagaagacatattaatatttttttaaagaacaacaaaaaagtggcctatagttaagagtagaaacaatcaagaaaaacagatccacagatgactcagatgttggaattattagacagggaatttaaaataactataataaaaatgccaaaagcctaacgaaaaatatagataacatgcatgaagaaatggaaaatttcctaaagacacgttcaccaggaaacattagaagaaaatcaaatgggataagtagcaatgaaaaatacagtattagaaatcaataacatcagatgtacttaacagcacactggaaaaaaaacagatgaaagcatcagggactaaaggcagatcaatagaaagtatccaaactgaaacacaaaaggcaaaaatagtggaaaaaatacaacagaatattcaagatctgttggacagtataaatgaatctaacatgatatcaagtgatgtaacagaagttccagaaagagaagagaaaaactggatcgataatatatttgatataataaccatctgagaacattccaaaatggatgaaagacataaacctgtagagccaagaagctcagtgaaccctaagcaagataaatataaagaaaaccttacctagctatgtaacaaccaaaaatcacataaaacaataaacagcaaatctaaaaagcaataggaataaaatgacacattaaatacattagaaaaaaatttatgatggctaacttttcatcagaatctagaataaaagccagaaaacaattaaatgacatcattgagtacgacaagaaaaaagaaatggaagcagagaattctatgtctagcaaaaaatatccttcaaaatgaagatgaaataaagatatccttagagagacaaaatctgagatacttgctgatacttcaggctgagggaaattatatcagatggaaccccagatgtgcagaaaggaattaaaaacaccagaaaaggtaaatatttgtataaatggaaaagaccttttttgacttttatttttacatttataatttctcaaatatttaagtgactatttacagtgtagactggaaataataacgtatgataggattaataccatatgtgtcactgtaacacagaatataacaagagcacaaaaggcaggattggacataagtggaattatactgcagcatgatttttatactgtgaattaggttaaacattgtttgaaggtatactgtgaacatttacatgtagtttctatagtaaccactaaattttttaaaaaggaaatataatctaactatccacagaggatataaaagtaatattaagaatacttaattttcccctgaaaagacaaaaatgaacaaaggaataaagaataaataccataaatataaaacaaataccaagatgggagacataagttgaatcatatcaataattaccttaaatgtaaatggactaactcctctaataaaaagtcagagcttagtaaattggatatgaaaggcaacacccaactataggttgtttttgagaaacacaattttattataaagatacaggccaatagaaagtaaaaggatagaaaaagatatagtatgaaaacaccaaaaataagaaatctggtatgactatgttaatatcagacaatgtagcatttaaacaaagagtatgactggatattaagaagaatacctcaaaataataaaaaaaggataattgagaagaaaacaatcatgaatatagacgtacctaacaacacatttccaaaactcacaaaggaaaaactgacagaactgaaaggagaaataaaaaaaaattcacaatcatagttggagaatgtaaaccctcttggtgcaggttgaacatcccttatccagaatgcttgagaccagaaggattttggatttttccggactttggaatatttgcattatacttactggttgagcattcctaatatgaaactccaaatccaatgagcatttactctgagcactcaaaaagttttagattttggagcattccagatttcagattttcaaattagggatgctcaacttataactgatagaacaagcagatcaaagattcagtaaacactatttgaacaactctgtaaaccaaactgacataatattttaaactactacatccaacagctgcagaaaactcattcttttaaagttgtcatggaacattcagcaaaatagaccatattctggatcatataaaagtattaatgaatatcaaagaatgaaatcatacagagtaacacgatagaataaaatcattcacagtaagatatctagcaaatcccctaagtattgggcaataaaacaaccctctcctaaataacccatagatcaaaaaagaaatcataaaggaaactgtaaaatattttgaactgaataatatgaaaatatatcaaaatttgtgaaataaagctaacgcagtgcttagaagaaaatttatgactttaaatacttacactggagaagaaaggtatatacaaccttccatcttaagaagctagaaaaagaagaagagggtaaacctaaagcaagtaaaagaaaggaaatactaatagtaaagtggcaatacaaagtcttaacaacaatggacaaaaaaaagagggaaagcacaaattgcccacataaataaaaatgaaacatcactacatattctaaaaaatgttaaaagggataaatattaaaacattctaacaattcaacaacttatattaattaatccaaatcacaaattactaacaactgaagacacagaaaataaataaccccatagctattaaagaaattaaatttgtaaaacctttctaaaaagaaaattttccacatatatggttcattagtaaattctacaaaacatgtaagggagaaatatcaatattgcacaaattcggaacatagaggaagaggtatcacttcccaatttaatatagaaggccagcatcaccctgaccccaaaatataacaaagctattacaagtaaaaaaataacagcctaatccctcatgaacataggcaaaaatttcttttttttttttttttttttttttgagacagaatttcactcttgttgcccaggtgggagcacagtggcacaatctcggctcactgtaacctctgccttccggtttcaagcgactctcctcactcagcctcccaagtagctgggattacaggcgcccaccaacacgcccagctaaattttgtatttttagtataaacggggtttcaccatgttggtcaggttggtctcaaactcctgacctcatgatctgccctctttggcctcccaaagtgctgggattacaggtgtgagccaccgcgcccagcccataggcacaaaaattctaaaccaaatatttgcaaacagaatccagctctctctctatatatatgtatacatatctatatatatatctatagatacatgtatatctatagatgtatatatatagatatatatagatacatatatctatagatacatttatatgtatctatagatatatatgcatacatacatataaagaataatacatcatgaccaagcaaggtttattccaagaaagcaaggttggtttaatgaaaatcaatcaatataattcatcatactataacagagtaagagggaaaaccatttgatcatttcaaaatacacagaaaaaaaatttgacagaaatcattatttctttatgataaaaacactcagtgaaactaggaatagatgggaacatctccaatatgataaggttcatctttaaaaacctacagttaatatcataattaataaaatattaaatctttttctcctaaaatctggaacaacaaaaggatgcccactctcatatgctgtgttcagtatttactgaagtttttagccagaacataaggcaaataaaagaaagaaaaggcacaaagttagaaaagaagtaaactgtcattatttacaaaaacataatttgtctaaaacctggaagcaaaactaatatccaaaaatagatcctttgactacatttcagggaatccatttaacagactattctgtagtcatttagaatgagattctattaacagtgctaataaaatggaaagtgtttgctaaaaccagctgtaaaaaacattttaggggaatggtggggaaacatggactggttattagacaattttaaagagttatttttctctttgttagaagtgatggtgctatgtggttatgtgaaattttgcattttaagaaacacattcttaatcatttagaccaaaggttttcaacctcagcactaccggcatttagaaccagataattctttgttttggagggggcagtcctgtgcattgtagtatgtttagtaacatccctgatctctaccagggatgcaggcatgctttcttttgtgacaaccaacattgtctccagacagtgccaaaagtcctcttgcggaggacaagggtcaaaatcaccctcagttgagagccactgatttagggtttaatatcatgatgtctgtactttcttttgaaccacttaagaaaaaaaatgcacaaagaaaatataatattagtgttaattctaagcgataaatacatgggtgtgtattatgctatctttttttattctaccttttacttaggtattttgtttacatacttgttatatatataattttttttagatggagtcttgctctgttgcccaggctggagtgcagtggcatgatcttggctcactgcaacctctacctcccaggttcaagtgattcccctgcctcagcctcttgagtagatgggattacaggcacccaccaccaaacccagctaattttttttatttttagtagagatagcgtttcaccatgttgaccaggctggtctcgaacccctgacttcaagtgatctgcctgcctcagcctcccaaagtgctgggattaaaggcatgaggcaccacacccagccgacatacttgttatatatatactttttattttattttattatactatctacttttctgtttgaaagtttcataataaaagtcaaaataattataatatgctataaatggaaaatgcaatacaattgtatggcactacgattaaaagtatacctaatgctaaatgacgagttaatgggtgcagcacaccaacatggcacatgtatacatacgtaactaacctgcacgttgtgcacgtgtaccctaaaacttaaagtataataataaaaaaaatgaaaaaaatatgcaaaattacatatacaaaaactactcaaaggagtatgttcaagaggagtaagtcttttcagcagtgtgccccagccactccagcgacagtggggatcaatgtaggttggctgtgccacagccacctgaattcactatgatcattaatcctctcctcccatcttttgtgctttaccagctgtataatgaatcctaggataaagtagaaacaaggaggaatcaaagagaatgtaaagaacagtttctccccaagaagaactctgaagatgattcatccttccaagccagatctcttgtcggaaaaaaaaaaaaaaaaagtgactggcccaaagcatatccaagaggaagcattggaatgaccagttgacagccaggacttcccactctagagttgtcattgtcccagaatagagtgacaattaaaatcttggaggagtcacccaagaagcatttgatcttaggattaaatgaaatttatcccctcaatattggagagaagtagcagaacaaaggaacaccctctatgaaacacttaaggaaaatgagaagcttcacagagaaattgaagaaagaacaatgaaattgaccacttggaaaaggagagtaaacaactggcaaaagcggcagagtacagtatatgacagaggcaacccagagactgaatgatgaacctctggataactctgaagcaccagatagtcaggaatttgattctgaagagaaaactggtgaagattctcaagtggaaaacccaaaaattggcacatgcactgagaatcctgtcttcctctacagatgcaaaaccttgcatgtaaaatttaggattcacaattgtcgagatatgaaaccaacctaagtgcccatcgaccaatgagtggataaagaaaatgtgtggtacatatacaccatggaatactactcagccatgaaaaaataatgatataataatgtcattgcagcaacttggatggagctggaggccattattctaagtgaaataactcaggaatggaaaaccaaataccatatatgctcacttataagtgggaactaagccataggtacataaaggcatacagagtgatataatggacactggagactcagaagaggagaggatgaaaagggaatgaaggatacaaaaactacatattgggtacagtgtacactactcaggtgacaggtactaaaatcttagactttaccactatataatttataattcatccatgtaaccaaaaaccacttgaaccccaaaagctattgaaatatatgtatatgtaaacacacacacacacatatgtaagtcttacatgttaaacctattaatatttgactcttgagaaatataccatccagtgggttcacctggccccctgcctagacagagccaatttagcaagatgggggaactgcagtggaaaaacagtaattcacacggagccacgtgtgcgggagacctgagttttattattattcaaatcagccttcctggagcatttggggatcagagtttttagagataatttggtgggtagcggctcaggaagtggtgctgattggtcaggttggagatggtatcatagggggtcgaagtgaggttttcttgtggtcttctgttcctgggtgggatggcagaactgggagccaagttaccagtctgggtggtgtcagctgatccactgagtgcagggtttgcaaaatatctcaagcactgatcttaagttttacaataatgacgctatccctaggagcaatctggggaggttcagactcttggagtcaggggctgcatgacccctaaaccataatttccaatcttgtagccaatttgttagtcctacaaaggcagactggtcaccaggcaagaaggaggtcttttcaggaaagggctattaacaattttgtttcagagtcaaactgtaaactaaattccttcccaaggttattttggcctatgcccaggaatgaatagggatagctttaagattagatgcaaggtgtagttggttaggtctgatctctttcactgtcataatttcctcagttataatttctgcaaaggcagtttcaagtttacctccagtatagttctttaaagcagaacacataactacataatgcaacctctgagatcaaaattctttgtttgaatcctgggaccctattgtattaaaatacaaacactgtatatttttaatttatgatgttttatgtgaacagcattttctcaattgtcagacatgacttgtgtaaatgactaaagaaacttcaatctcctattgaaaaaaaaaagaaatatattcaaggggttgtggatgagtctgagtgtaattcatggttgatttcacttcctggatgttaaagtaatctgtaattatctgcttttatattgaaaaaaattgacaaaatctaacagtgtcaaaatgcaatattattaatcattcatggcctaatattagaagagaattagcagaaaacacagcagagaagagagacttgcagactggaggtcttccatccactacgaagaaagcatctagaggcggaatagctttgaatgggcatacatctgcataatgacttttcctttgttcttttctcactggctaattgagtaactcctacaacaaatatgccttcagacttcacaccagattagagccctttgtaaataaaattaaagttgggaatatgctttccctagctggtaaataaattcaggaagtctgaggtttagcactgcatgccaagatgtctaagtaaatctcaaattcttccatattttgaaataaacaccaaggattatcaaatgccaagaactcccaagaagaaaatagctcacctcactctctgaatcagagaccctctccaatcaaaatgtcccacctgaaaagtagtcttctctcctaccccatcacagacatatggatgttactgatgtcatgtgtgtctggaatattgcctggttcctatgacaagaacaataaaatctcttagtattctgcggcaaacagtctctttctcatttatccacctctgcattgaacatgagtccctcctatgggcccaggcattcttctaatcattggcatcacaatagtgaaccaaacaaaaatgctggtcctcagagagcttagtttttagagggttcttccaaaatcctagcagtggtgaccacaagcagaggatagatcctgggtaaccagagtcaggttatgcaatgcttgtgttcatcatgtcaggataaaaatcttcatctgatttcagactcaccacacggcatcgtcataaggtcataagtcatggactatttgagaaagcactaagctaagaggagaaaaagtgcccttgaacctttctgaacccaatggtatctgcctaagagatggggaagctgaactaggtcacactgagatgagaagggggctccacccatgatgtccttgtctcagaataagtcagcctcttatgctataatatgtggatcaaaagaacaggatgggctgggcgcagtggctcacgcctgtaatcccagcactttgggaggctgaggtgggtggatgacctgtggtcaggaatttgagaccaacctggccaacatggtgaaaccccatctctactaaaaatacaaaaaattagccaggcatggtggtgggtgcctgtaatcccggccactccagaggctgaggcaggagaactgcttgaacctgggagagggaggttgcagtgagccgagattgtgccactgtactccagactgggcaacaagagcaaaactccatctccaaaaaaaaaaaaaaaagaaaagaacaggatgtgggatcagaggagccctccaagacaagtggcttcagttcaaatataagctctgtcgtttgttcagtgtttcaccagacaaagtacttgagtgtcctgcttcagtttccccatctgtaagctgaggtgagcaagaatacttcacagagttgttatgagagataagtggaatgtttcatgggaggcagtaagcacagtgcgtgccacatagtaaacactcaataaatgttagctatttccactaatacagtatagtatatataatataataatgttagctagttatgagtcattatgaacttagttactcacccaaaggccccagttatatcctgaatgcacaccatgtgccaggcatcatgctaactgctgtttatattttcttctttacttcctccagcagcctataatggaagttatcatggtctttattttacaggtgaggatactgagctcagagatgtgaagcaacctgcccaaggtcatgcacccaggagtggcagggtcaagatgcaaacccaggcagaaattactcgaaattccatgttctcttcccaacacaatctctgtcttatttctgtctttccaatgacaccagtatttccaaactttcaccttaccacattctttaagcaacacattatgcagatttcttttttaactggcaacctgaggcaggtctctcttaaccgctgtcagcctaagctcactgctaaagcaccatctctatgtgcccccagacctttgagcactgtcaaaatcagaaatgcattcaccctgtaactcagcaattctacttttggaaatttatcctagaatatacgtacacctgtacacaatgacatacatgcaatgttattcatcgcattgtggtttgtaatagcaaaagatgagaactttcccaattgttcatcaagagagaaataattaaataagacataatatagccattataatagaaaaacatataattataagtaagaatgaaagaactcactataccctgatacagaaagataagcaggatataagttttaaaaggcaggatacagaactgtgtaataaaaaaaaaagaagtgcatatacatttgtatttgcttgtacatacctgaaattctgcaaagataaagaagaaacacataacaatggctgtctgtgaaaaggaaatgttccaggcagaagggacaattttcactgactattctagcatactcttgtttttaaatttttcaatcatatgaatgaccggcctgttcaagaaatgaaacaattttgaaaatacgggttttaagagtataggattaagagtataggattttttttaagagtataggattaagaatcagaaatttgagtccaagttcggggcaaacttggataccttactttatttctatcagccttcatttcttcattagcaaaatctccaagtccctaaatactggggactttggccaacgttatcatagctaccatttattaagtggttacttttgccaagccctatactggagcctcctaagaatttgcctcattgagtcatcgcaagcaaccctatgagataggaactatgattactcccatctcacagatgagcaaactgaagctcagtgcgggggtataacttgcccaaggtcacacagccagtatgtggcagaaccagaattcaaacccaggtctctcaagcctgtatttggactcaatggtttgctgcctccatccacattgacagttttcctagttgtgttccctgcctcttgcataaatcccacccaccagttcccttctgaaattgccagcctccaccaggcctggcccttgctcatttccaatcaccctttatccaccatagctttggaaatggactgttactaatggctagtcatatgtcagcctaatgaatgggaggcagacttccattaaaataatgaaattagcgagttttgaatttggttacatcgcatggcacacagcctcaagtaatgaccaccccatgctccttcctacaaattaaagtcagtttatttatttaaggtctttggcttggccatctctattaagctcacatcatctgtttagggatggatttttttttttttttttttggccttgtttgtttaaatgatgttcgggctgttcccctgattaataaagtcgtaaacacagtcaggagcagcttctgaaccatgtgcaaaagcaaagaatgtaagtcaaagaacaattctttgggggtttgggttttgtttgtttggggtgtttttttttcctccaaaggatggaaacaataagaaagaagctctttgagctccagaaactccaattatgctgacatttctgctgcagaaatacaccaagctccattttgcaggaacccagtgaactagctaatcagatttccttggataatttgctccaaaggtcagctgccttaaaaagcacccagtgcctcattatttggtaaagcaggctgcatgcgggctgcgatttggaactcagcctcccatggcaaggtagtttttctggaattttttagcccagaccctgcagccttagctttggccaaagtctcatccacctttgtgatcagcccgcagacaaaatcattaccagaaaaagcacctgaatctctgagtctgtgaggtctctgtctccaagacaggtctctctcgtgtcccaggagcaccaaagatggcagactcatctgaaatgttcatgccattggtcaatttcaagggaggcttttactgatactgtgatgggtaggcggccagacctaggttctaatcaccaagtccaattctacaaaatccctaaccagtacccctcaaaactatcaagatcatgaaaaataaggaaagatggagaaattgttccataccagaagagactacagagacgtgagaataaatgcaacatgaaactctggattgaatcctggacaggaaaaagacattagtagaaaaactggtgaaattcaaataaaatttggaatgcaattaatagtttccaaagttgtgacaaagacattaacatttttttaacattaaagaagctgggcacaatggctgacacctgtaatcccagcactttgggaggccgaggtgggcagatcacgaggtcagaagttcaagaccagcctggtggtcttgaccaccaacatggtgaaacctcgtctctactaaaaataaaaaaattagctgtgaggtgacgtgtgcctgtagtgccagctacttagggggctgaggcaggagaattactagaaccaaggaggtggaggttgcagtgagccgagatcgtgccaccacactccagcctggtgatcgaacgagattccgtctcaacaacaacaacaaaatttaagaaaaactgaaactgagaagggatttcttggaacttgctatagtatcgttgtaacttttctataaatctaaaattatttcaaattttaaatatctgtatataccattaaaaaatccattgtgtattagttatagtttgatgaaaataagtttaaataatacataattattgttctattataaacttgatatcctagtcctgatatgatatcatagtcttgacatgtgatatcatagtctaaaaacaaaacaacaagaccagagaggaaggtaaagccattcctacaactgaatttttattcaatctcttttaagatcccagcaaagaaaaaaagaaacaacaaaaagtaggactttggttaagctaaaataaaatatgatggatagtctctctctataaactgacacaggaaaatccaagacaaagaaactaggttttgtttgtttgtttgtttgtttttaccactcccaccaacctcaccactctgaaggattgtaatatcacaagaatagcttacaaagcaaacatcactggcttagcttccactctcacagatttttaagacacccagctccaatcctcaccctctgatccttctcatcttgtagaaagagatgcatgaagagtccattgtgaaccaggcattgtgcttgatgacggagacaccaagtcaacttggaccaggtccttccccttaaggagtcttggaaaatttgctcaagagagtctcagctgaatctcgaaggaagaagaggaggtagttggatgaagaaagaaaggaggcttccagaaaaagagcacagtgcatgccaggacatctaaatcatgacacttagatacctgcataaagaggacaaaattgaggtgggaggagttagaaagggcccccaggtaatggccttgtgtggtaaaggatttaactttctcctgaaggagataaggagttttaagcaagcattttagaaagattcagcagaggacagtggatagagggtgaggccaaaagcaggaagactatcatccaggccacacatttctgaatacaatgcccagagacagtgggagagatttctccaaggattctttgcaggaaacaagggtccctgcaatgatgagacctgagtttcctatttctctagtagctttgtagctcagcacccatcccaactgcagctggaagatgtcctctgctatttctccattccatactccaagtccctgccctgcagtatgtatgtaccttttgccacccaccctctgactctgttacattgtatattgaatcttcaacctaaagatctcaactgcttacaaaaaagaagagaattatgtgggcttaataatgttaagggcagttaccacatgagcactgactatatccaagcattgtgttagcctttaacctgcaaagaaaaatacaattatccccatctcagaacataagaggaaaattgagactcccaagaagttaaataacctcctatatagcttttaacatgggtggggataggatatggatttgagaatgtctgattccaaccacccttttatggcacctcactggctcacttttaatttcacttgctgatttattacaaatctccctctccttcagaatcaaacacaaactcattatgctgggccaaaataaaatctgaatggccatacccaattgtttttaaaatgttcagccttccctgacagatgtatgacattgcaacactacagctttggagtggctggcttaacgccaaggagtggttccaaatctcttttccagtggaacagtagcacaaatttggtctaccatctaaaaccaaataatggctgcccttttcctcttcctggaaaaaaatgacatagatgggtaaatggattaatgaatggattagacggataaatggatggatgagtgaatagatggatggatggataaatggatgtgtgtgtggatggatagatggatggataaatgggtaagtaaatgaatagatggataaatggatgaatggatggatgaatgaatggatagatgaatgcaaagtggatggatagatggatggataagtggatgaaagaatggatagattaatggaaagtaaatagatagatggatggataaatggatgaatggatggatgggtaaatagatgaataaattgatggatgcataaatggatccatctatggataggtggctagataataaatggatgggtagatgaataaatggatagatgggtgaataaatgaatacatgaatatacatttacaatatagaatatttctcaaggggaacatagaaaactatcaatagtggttgccatttctgtgaagaaacaaactggttaggacaaggatgggagtggaaactaccttttactatacactcttttgtatctttccaattttgagccatacgtgtataatacctatttttaaaataaatagcaatataaaactaatttcaaatacttttgttaaatgtatatatgaatgggtggacagaagaataaataagtcctaagtttttaaacaaataagattcaactgttattttccccactgatttttctttaaatctcggcactaacttctacttccctacataagaacataatgtaatgcgtatccaccttagtgcacaatcaactacaaaatttggttattcaaatggaatatgtcaataacattgtgttgctttgcaaagagcaccttgacttcaaggtgtgtccgcttacgtctgttcaaggacctctctgcaggagttagagtaagggacaacagtgctgaggcctggacacatgatcccacccaagtttctttttctgttgttggtttttattttgttttgtttttttgagacagggtctcaccctatcacctagactggagtacagtggcacaatctcggctcactttagtatccacctttcggactcaggcaattttcccatttcagcctcccgagtagctgggactacaggcatgcaccaccatccctggctaattttttgtagagatggggtctcatcaggttgcccaggctggtctcagactcctggactcaagcgatctggcctgccttgacctacccaaagtgctgggattacaggtgtgagccaccacacttagccaagtttctttaagccataattctcctctgtgcaagacctgcatactgggcttctgaacactgccccctgcaccatttggggaacataaggaagggctatgagtaaggagaccttgccaagggaaagattaaaaaacaaacaacttccccagccaccatcaatagcatttccaggaagaaataaacagaacggactcttggccataaaggatttatcactttcctttccattggtgtggaaatgaagcagggttgcttcaaaactgcattttccagctttccaaggagctgtgtggattccatatcctagagaagtcgacaccgttctagtaagttggcatggaccccaggtcctacccttaagggcttaatactctgatgcaatatataaaatataatttaataaaagactgaggcagtatttgtgtaccaagtgtctatagcaagtaccaaggtatttgcatggattgggggtggtagcaagtgtgtgatattctccttctaaatcccctgcgtgtggggatggaatttttaacagtgggcgatgtgataggacgatcagagatatgcaaaaccacctttttagtggtgggacacagtcacagttgtattccttctgggactatttggaaatcacacatttctcatcaagtaagaaaatgaaaacagagaaaaaccagttgacagtgatggctcaatagcgccatctcgtggtgatctctgtccccactccaagagcagtccatgggccccaccccttccgggatgttttgccccctctgtatctgagtcccagaaggcagtgcaaaagggatctgggcaaaacagagtatcctacagattggaacagtgaccaacggcatctttaaggaggagaaatttgaaatgggttctaaaggaatagatacccaggcatcaaagagaagcaaagacatttttgatgaagggcatagtgcaaaccaaggttggtggctggaaaatgtcagatcctttgaggatatgaggctggaaagtcagtctgggttggtgaggactcactgctgggctgctgtgggcatgagatgtccttggggaggtacagactttctgcgagacagaaagtcaaaaatcatctccattcacctgtggaccagcaccgtgctaaattacatcacatacatcagtttatgtatgcataaacatacatcagtttatctgccctcaaggggtgatactattatgaacctccacttgacagatcaagaaagcaaggcccaaagaagttaaatcgcttacctgaagtgacttagctaacaagcggcagagccaggatttgaaccaagatctctgcccaacttcaaagcatggtcttgctcttcataaaggtgttctcatctgcaggtctctgctgttgcttgtggcaaagacagttgtcacatatgaaattgctcaatccaaagtgcttctgctttaaatctaaatagttaccaaacattctgccccctgtaaagctgaagtttctcccgaaggcttcaggcttgtgccctaggacttcttgccacctggccagctggtcacagtgtctttgaatgactgggggacagatgtggcaaaatggtaaagtgtgacggttaatttcatgtgtcaacttgactgagctaaaggatgcccagatagctggtaaaacattacatccgggtgtgtgtgtctatgagggcatttctggaagagattagcattagaatctgtagactgagtaaagaagactaccctcagccaggtgcggtggctcacgcctgtaatcccagcactttgggaggccaaggtgggccgatcacgaggtcaggagatcgagaccatcctggctaacatggcgaaaccccatctctactaaaaatacaaaaaattagctgggcgtggtggcaggcacctgtagtcccagctactcgggaggctgaggcaggagaatggcgtgaacctgggaggcggagcttgcagtgagccgagatcatgccaccgcactcgggcctgggcaacactgcaagactccgtctcaaaaaaagaaaaaaagaagaccaccctcacccatgtgggcagacatcatcccatctgttgagagcccaaacagaacgaaaagcaaaggaagtgtacattttctatttgagctgggacattcaccttctcctgaccttggagatcagagctcctggttcttgggccttcagacttaccctgggacttaatgtcattggctttcctcataccccaccttgcagatggcagagcatggaacctagcctccataactgcatacaccaatccatataataaacagacatatatatcctactggttctatttctctagagaaccctaatacaggaaggttgtgaggtctgggatctaaatcccagctctgcccctgagttgttcaagcatagcctgtccaaagctgagttcccttgatctttttccccaaactcctcctcctctactaacccagccaccatcaacgctcctcctccaaccacacattccaccttgcccctcctggaacagagattcccacctcaggacctttgcactggctgttgcctccacctagaactgctttgccctccaatatcaacactgctccctcatgtccttcaagtctttgcataactgtcgccatctcaatgaggccaagcctggccaccaccaccaccccgaactgcacgccctacaccccgttaccttctctgtatttctcatagcagttgccaccttctacaatgccatgtaatttacttgttttgtttccggtttactgtgtgccttcccccactggtatcaatgtgccccagtgactggtagaacctaggtagtaactgaacacgtgttccctatgaaattggtttaactctgctgtatgtgtgaaattttttgtaataaaatattagggataatggtctcaaaggcagtcgttttatctgctttgttcactgatgtatcccaagtgtctgaaacaagacctggctcatagaaggtgcactataaacattactgaatggaggaattaaggagtacatgtgttacttagggcaagttatcttatctccctaaagctctaggtgtcaactacaaaggggcaaaatagtagctatttttcatttattaagtatttattgagcatctactatatatctagaactactatatatgtaggtactagagatacaactgtgtgaaagacagaccaagtcctccttctcatggagctttcaatccagatagggaaacatgaccacaatttcatgtaactccttcatttattacttattgagcatctactatatatctggaactatgtaggtagtagagatacaactgtgtgaaaggtagaccaagtcctcctcatggagctttcaatccagatagggaaacaagaccacaatttcatgtaactccaatgccatctatgagattgcctaatacctgtgtgtcccaactctgtcacagggattcagggaggaccactcagctgagtggcatcaaaactgagcactgaatcttaattgttaggattctgctaataagaaaaatgcatctttattttgctgagggcaacaatgtatccagctaaaaatcatctttcactagcatctcttgcagctagggctggccatctgacgtagttgtgaccagtgaaaagaagggagagcgcacctttagttttctgccttgctgccctcccttggcttctatgcctgctgacgtgatgcctggagatgaagcagctattttgtaaccatgaggatagaaattgcacagcagagcaagaaaatgaaaaaagtgggggtttctgatggtctctttgattcactctaccaacatggcttgcctactgtttagcttattgtgtaagccaaataaacccttgcaccttcaagccatgataatagagttttctgatacttacagccgtatctgttgtcccaagcaagatatgaacgaggttaagaggatgaaagtgaaatgtactaagcccagggcacagcatgtgcaaaggaccagaggtgtgagtgagcaaagtcaattccagcaacacaaagttcagggcagctgaagtggagtgggcaaaaagcaggtggtgagtgaagagtttgcaagagcaaacagggatcccactgaaatcaaggttttgtaaatcgaattggagaaacagtgaagagccatagcaagctgctaagaaaaatttgagttaatttatggaaagtgtccaatgcacagtgggtgcccaagatataagcaccgtgagtatcatcttaccttggaatacacacaaaattaactcctccgacaaaatgaagatgcatcacttttatctgcaagcccgccggaggtcacagacacgtgcagagggaaaacagtatggtgagacggagaaaaacaatccagccaggacagttacaccgacgctttattcatatctgccaccatcgggattgattcccacacagtgactcactcacagcaccaacctctttaatcaactgtgctgagcagtgacatccaagctcacctcggaaaacgacggaaactccaaggcaaggtggcctcccgaagtggccttttcccttccctcctcatccctgggctgtttccagcagacggcagtgaacgcctaaatgagggtttgatcaatggaggccaagctgatattgacaaagcagctgcagtttccgcaaatcacccagcactcatagatactgaagattaatctttacaaatacggggcaaagggggagagaaaaaaccaagtcgatttagtttccgattattactttctccagaaggcactgaagagtcaaaagtttaactgatgtacattagacagggagacaaatccagaaatatcacccaattacccggtagcttctagaaggtatttttcatgacagcaggtgggtttgccttttctaaatcaggaaggagacaagacaccgctaagaggatgttgacttggcccagcgcacaagcactaacctcaccggacaaatagaagcctgaaaatttgtcctcagtctacacggtccccatgaaaacacatttccaccgatttcctagttatttctgttttatgcctcatgtttagaaagtaaattgttccttcctggaacaagatggacttttttttaactacaaagaaataataaataagtgcttagcctccctaggcctccattttcacatccaaagagtgggtacagcccaggacgtaatgtttagagggcactgacaccatctagagtggatcattctctaccgtgcagggctattccgcccactgcaggatgtttactggcatccctgaagtctacgcaccagatgccagtagcaccatttcctcatccccagttgtgacaactgaaaatgtctccagacatgaccaaatgtccctgagagacaaaaccacttgcatagtcacgaacagataacacgactaagaatggggaaaacgtgaatcaaaagatgttccatgctgtgttcacataagcaataaaaccaaatgcttgaatttgatgctagttataacctttttattcatgtccatgtcacagccaaagaactgtttttgttttttaggttttttttttttgcagagacagcatttcatttatttcaggacactttcacagaagtattcatatattctggcaaaatgaaatcatatattacacaaacatttcatttccatagttagtacagaagaggaaaaattatttgtggtcaaaattactcctgagattcctttaaatcaaccataatttatagagtgcgcatgtacttgtgtatgtaatcattttaagtcataactatgcccctcgaacagttggaagtcactgagctggaccgaagaattcacaaaagagaaagctcttcacagatacttgggttttgaaaccattctgccattagatagctacctagtcctcaaggtgaactaagcacgatggaggaattccaagtgtggcttcccacctgcagggtcgactccactgagactctgctgctaacctcagcatacaaccctagatgatcttgtcgtgaagatgaaggagatcacagacaacatcttgccagggactgagttttaatgctggcgttttagttatcctgttgggctacaaaaacatgtcaggcaagatgttaagttttgtttaaagcatcaagaattccaggcccggcgcggtggctcacgactgtaatcccagcactttgcgaggcctaggcgggcggatcacgaggtcaagaggtcgagaccatcctggttaacacggtgaaaccccgtctctactaaatatacaaaaaatttgccgggcgtggtagcgggcgcctgtagtcccagctacttgggaggctgaggcaggaggatggcgtgaacccgggaggcggagcttgcagtgagcagagatcacgccactgcactccagcctgggtgacagagccagacttcgtttcaaaaaataataataataataaagaattccaaaatcaagtacaaaatcaaaaggcagattttcaaacaaaatctttgaaaagtggttctggccgggcacagtggctcacgactataatcccagcactttcggaggccaaagcgggcggatcacgaggtcaggagacggagaccaccctggctaacacggtgaaaccccgtctctagtaaaaatacaaaaaaaaaaaaaaaaaatcagcggggcgtggtggtgggcgcctgtagtcccaggtactcgggggaggctgaggcaggagaatggcgtgaccccgggaggcggagcttgcagtgagccgagatggcgccactgcactccagcctgggcgacagagcgagactccatctcaaaaaatatatataaataaaaataaaagtggttctgtcctgcttacaccctcttctcacgcttttcaggcacaaagaagggccaagagcaagagaggatttctttggagagagtctgttgaagacacgccttcatgttacaagatcttgaaactcatgggcaccatggtctgggatctgaatcctgcagcaaagctcttccaggcttcctgctatgctgcctggggtaactgcacaaggccccataattagacgaccccactgtgatgctggcattttgaaattcctataatttttttttttttttttttttgagacaaggtctttctctgtcacccaggctacaatgcagtggcatgaacatggctcactgcagcctcaacctcctaggctcaagcggtcctcctgccttagcctcccgagtaactaggaccacagatgtataccaccattcccggctgatttatttatttattttttttttaatttattcatttttttttttgtagagatgcagttttgccatgttgcccaggctggtctcaaactcctggactcaaagcaactccccagcctcagcctccaaaagtattgggattacaggtgtgagcccctgcacccagccagaattcctataattttcataacaagaatccccacattttcgttttgtgctgggccctgaaaactatgcagccagtcctgcccaggatgcttattttatttcattttcccagctttagaggggtaaaattgacaaataaaaatggaatacatttacagtgtacaatgtgatctttggagatatatgtatacacaaattgtgaaatgatcaccatgaaccagctaattaccctattcattacctcccatagttgtctttggatgtttatgtgatgagaacacctaagatctggtctcttagtgaaaggatggtgattaccagagcctgggaagggtagtgggctggggaatgtagggatggttaatgggtacaagaaaaatagttacaaagaatgagtaacacttactacttggtcaggtgtggtggctcacacctgtaagcccagctctttaggaggccaaggcggacagatcgcttaaggccaggatttcaagactagccgggcaacatggcaataccccatctctactaaaaatacaaaaaatagccaggcattgtggggcacacctgtagtcccagctactcaggaggctgaagtgggaggatcacttgagcccaggaagtcgaggctgcagtgagctgtcatcatgccactgcactctagcctgggtaacagaaatgagatcttcactccaaaaaaaaaaaaaagacctactacttgatagcacaacagagtgactatagtcaataatttaattgcactttttttttttttttttttttttgagacagagccttggtctgtcaccaggctggagtacagtggcgcgatctgggctcactgcaacctctgcctcctgggttcaagcaattctcctgcctcagcctcccgagtagctgggactacaggcatatgccaccatgcctggctcattttttgtatttttagtagagacggggtttcatcatgttggccgggatggtctcaaactctagacctcgtgatccacctgcttcggcctcccaaagtgtgaggattacaggcgtgagccaccacgcctggcctaattgtacattttaaaataactgaaagagtgtatttggattgcttgtaacacaaaggataaatatttgagggtatagataccccattcttcatgatgtgattattacacaccacatacctgtatcagaacatctcatgtacccgtaaatatatacatttattatatacccacaaaaagtaaaaaaaaaattttaagagctgctctcttaacaaatttcaagtaagcaatatggtattgttaaccatagttaccgtgccaaatatgagatgcccagaacttattcatcttatcaccgaaagtctgtaccctttgagcaacatttcctcctagcccctggcaaccattctaattcgactctcttttcctctgagttcaacattttcagattccacagataagtgagatcacacagcatttgtctttctctgtctgaattagttcacttagctaattctactctttttgtatgagttcaacgtttttaaattccacaaataagtgagatcacacagcatttgtctttctctaagtccacttagacaatcagaggtgcttgttttaaactcaggttcctggaccccactgtttttaacagttcagcttgatatccaagcctgtaagagacactttgattctctggattaaaatgagagacagtgagaggagaggaagaagaataaaggaggagagctttctctctaaaaatctaagggattccaattaaaaatcacctctcattgtacatgcagaaaatgtacagtgagacacaaagatgggttggaagacaaaactctgaaactagtctgggagggttaagtgacttcatggaaataaatactaaaatatcaaaatgctctaaactttccatttttacttctaaatgtgctgagaaaaaaatctgattatttgacaggaattttaaaaagaacaatttttataaaactaaaatcacattcctgaacactcaaatgcttagcataggggatgaaattgacctggaattttctttgtgagaggaaggaccaagttcccaatgtggatacgttaccagttagattttccaagcacagttcatactgcagaattcacctaacttgatttaggtttctcctttataatcagtttccacttgaacttcaactaccacgaaaaagtaagtaagtaaagcaaagatgtaaattcttgggaactttgttatgagaggaactttctagactgcacttagttgtcttatttaattagctaccagggaaacaaaacatatagtatgtccaaggagttgactcaatggaatgctgtcatgctaaacagatctaacgtcatgctgggtgagacacacagtctattttagaaagccaaacagggccggatgcgatagctcatgcctgtaatccccagcactttgggaggcctaggcgagtagattacctgaagtcaggagtttgagaccagcctgaccaacatggagaaaccccatctctactaaaaatacagaattagatgggcgtggcgacgcatgcctgtaatcccagcttcccagctactctggaggctgaagcaggagaatcacttgaacctgggagatggaggttgtggtgagccgagatcacgccattgcactccagcctgggcaacaagaacaaaactccatctcagaaaaaaagaaagaaagaaagcaaaacagaagcaaagcatgcaagaggtttattccaagcctctgacagtaggagtcctgaaatccacctggtggatgaaggaggagacaaaatttagaggacttggcagaatcacagaatgtggggagatgtttccaaagggggcctcatctcatgctgcaaacgttttgtctggagaataccaaaaaaaaaaaaaaaaaaaaaaagttttgtctgtgtcttgtgtcttgggttgttttgttgttgttgttttttaacgtcatcaatgaggcgttccttgttctgctgaggccctagaagcattcaggaaaggaaattcagaggtgggaactggagagaaataatgtgctcaataaaaggagtaaggttttggagccagacaagaaaaaaaatgagaagcagagctggggaaagaatagagggttctagaagcctgaatgtgccagaaaatcatcccctccagaatcccccagtcttcagtgaagccctatgaactcaatagctgagtaggtttcctgcaggcaatgggagacgcaaagttctgcacttaagctcctgtaggggaaaaagcagagccagcgtgggttgggggcaccagggccagaggcagatacgaccttgagaaggtcgccctccccagattagcaggaagtagcctgcatagaagatcttacctagatctttgaggattcaggggaccccagctgacatgtcggttattctacttaattataaaatgtttgagcagggcacagtgactcacacctgtaatcccaagcactttgagaggcggggacaggaggaatgcttcagcccaagagtttgagaccagcctgggcaacacagtgagactctgtctctacacactttatttttttttgttttttttttgtttgtttttttaaattagctaagtaggatgctacaggcctgtggttccagctacatgggaggctgaagtgggaggatcacttgagcccaggattttgaggctgcagtgagctatgactgtgccactgtactccagcctgggcaacagagtgagaccctgtctcacaaaataaaaataaaggccaggtgcgattgctcacacctgtaatcccagcactttgggaggctgaagtgggtggatcacttgagatcaggagttcaaaaccagcctggccaacatggtgaaaccccatctctataaaaatgcaaaaaattagccggcatgatggcaggtccctgtaatcccagctacttgggaggctgaggagggaaaatcacttgaacctgggaggcggaggttgcagggagccgagatcattccattgcactccagcctgggtgacagagtgagattccatctcaaaaaaaataaaaataaaaatgtttggccatttccaaccttgccttcagactatgggttcctggaggacaggtgcacttctcagccatctctggatgcactgatgtggccatctttgttagtgtactggtatggaccagtagggtccatacttgcacaaatcccaacaatcggtatttacatctctttgcttggccagggcccacaatgcctgtgcacaggacaggtcagaagtcctggagaattaacatacctcctgcattaggtcttcaccagtgactaactggagggatgtataaatatcccagctccttcactcctccagggggtgattctgagctacatgctcaacactagggttggcaaacttcttgaaaaagggtcatatagtaaatattttatgttttgccggtcatattgtctctcacagatgctcaactctgctgctgttgtataaaagctgccatgggctatacataaatgaaagggtgtgactgtattccaggaacattttattgaaataacaggtggcagaacaggtttgccatgggccaatagtttgcaaatccctgctctgtgtcattttccagagttcgccagagagattaaactgtgattccccacactggtaactgacatgataatgcatctttcttgccacttccctcccttgcctgtcccctttcccccacctcctcaagcttaataaactattggcactcaaatccttgcctcagagtctacttcagtgagcatccaaactaaaacagttgattaggactttttttgtttttttgcaagagatggagtctcgccctgtcacccaggctagagtgcagtggcgggatcttagttcactgcaacctccgcttcccaggttcaagcgattctcctgcctcagcctcctgagtagctgggattacaggtacgtgtcaccacgcctagctaattttttatttttagtagagacagggtttcactatatgttggccaagctagtctcaaactcctgacctcaggtgatccgcctgtatcagcctcccaaaatgctgggattacaggcgtgagccactgtgcccagcctgataaggatactcttgactgcaagcaacacagagttgaactacaggtgatttaaatattaattttgcaccaacctataatccagatttattgtatctcccacacaaaatccaggcgtaggtggtccagacaggttaattcaataatgtcatggctttgcggtttttctgatccttactagctcactactgagaaccaggtcatgtgcccaaggctaaaccagtcagcagtgagagaaacaagatgagcatgcctggcttgggccaactgagttccatgcctaagagcatgaggaaggaaggggctccatttctctgggcatattgccaactgatgcatgaatgaaaatgggatggtctcagcaaagaagaagagaaaagggttgctgggcaggtaaccaatacatacccagcagctggtgcttagaaaatgctgctgcagtctatgaatgcatgagccactggatgtaaacaatggatagcaactttctagaagaaagataaagttgaaggagtcatcctggacacacaagagtggtgcaaaataagcactgagtggccaggatgctcaggggaaatctcagaggctttagggagcatggttacctaactcagaaccatcagtgccaactaaggaagacacaaggtacattggttaaagtcaaggacaatcatgttcttcccctagttaataacagacatggcattttacagttcataaagctcttgtccattcattagtctcaccattcagtcaatgaaataaacccaggtaataatcaggtcaggtattattcttttaaaataattttatccccatttactgtgaaaaaaacttcttgagacagcttgcaataaaaggtacacccaaagggaaaccaaaagaaaaattatttgtttatcaaatacataagaaaactcatttaatatggttattttgattgcgtgtgctcttgggttttagctccctaatagccagagcaaaagaaaaagaaaacataaaggacacatgaatatcatcatttaacaaagggaagtatagctgttcacaggaaaggaaatgatttttcttagaatagaattaaaaaaaattccacttggatccttacataaggcaaatgtaactaaatgatggataatgtctcccatgatggttttgcagaagatatgagaatgtcctcattcatcatgacatttgaagtagtccattctcacactgctaataaagacatacctgaaactgggtaatttataaagaaaaagaggtggactcacaaatggactcacaattccacatgtctagggaggcctcacaatcacggcagaaggcaaaggagtagcaaagtcacatcttacatggcagcaggcaagagagggcttattatttttagtagagacacggtttcacaatatgttgggcaggctgacaactggccaagaatagcatggaaaagaccccccatcttgattcaattacctcccactgggtccctcccatgacacatgggaattatgggagctacaattcaagttgagatttgggtggggacacagacaaaccatatcaatatccctaaccatcagcttttcatacaaagccaaaggtttctccctgtggatggtatcatagcactgatacccataagcctcacttccattccacattgtcctggatatcctagctagtgcagttagacaggggggaaatgtccagaaaggaagaaatgaaacagtcatcattcctaggtgacttgatcgtatacataaaaatccaaggaaaattgttatggactgaatgtctttgtctttctccaccaaatccacacgttgaagccctagcccccagtgcaatggcatttggaggaggtaatttggtttagacgaggtcacgagggtattacccccatgatgggcctagtgtctttccccagaaaaacaatatcctttaccatatcccgaaaattataacaataccagttttaagtacttactatgcatgcaccaagtgtttacaggttttgatttactcattgaaacctcacagcagcctataaacccagctagtatgtggcagagttgagacgcaaacagaaaagcagtactccagatccccttggatccttacataagggaaatgtaaccaaatgatggataatgtcttccatgatggttttgtggaagatatgagaatgtcctcattcatcataatatttatattagtccattctcacactgctaataaagacatgcctgagactgggtaatttgtaaagaaaaaaaggtttaatggattcaagttccacatgttgtcatatgccacacttcttagggatgaatgaacatcaccatgatgccacacttcctagggatgaatcaacgtcagaattttttttttttaagttctgggatacaagtgcagaatgtgtaggtttcttacgtaggtatacatgtgccatggtggtttgctgcacctatcaacccatcatctgggttttaagcaccacaagcattagctatttgtcctaatgctctcccacccctcaccccccactctccaactgtccccagtgtgtgtcgtttccctccgtgtgtccatgtgttctcatttgaacatcagagcttaaagaagcattcctgctctcttctctccccgctgggctgggcttcaggtgcctcctatatgcttcctccatatcacctccacccttgcttgtcattgtctgggtttgaattcatttcctgagacttttgtaacaatgatctcaaactaaatggcttcaaacaacaggaatttcttctctcccaggtctggaggtcagaagactgaaatcggttgcaataaactgaaatcaaggtgtcagtagggctcgttccctatagaagtgctaggggacagtctgttccttgcctcttccagcttctggtggctgccagcattaacttgcttggagtggcatcaccccaatctctgcctccgtctggatatcaccttcttgtcttctgggtgtaatatctctccgcctttctcttataagacacttgcaatcaaatttagggcccacctagataatccagaataatctccccatctcaacatccttaatttaatcatacctgcaaagactccttttccttataatttaacatatacaggttccgcggactagaacctgatatctttgagtggccatgattcagcctactataggtttcatcactatctctttatcaactctgaagtccttaacagcagagaccacctgtggccattttcaaatggctgtacattttttacatcaaagcaatctcttagggccaggcacggtgcctcacatcggtaatctcagcaatttggaaggccaaggcgggcagatcacctgaggtcaggagttccagacccacctggccaacacagtgaaaccccgtctccactaaaaatacaaaaattagctgatgtggtggtgggcacctgtagtcccagctgctctggaggctgaggcatgagaatcacttgaacccaggaggcggaggttgcagccagccgagatcacaccactgcactccagcctgggtgacagagggagactccgtctcaaaaaaaatacaaaaaacaaacaaacaaaaacacacaataatctcttgggatctacaccctctcccttgactttaatgacctccatgattgctttgatgtattgaatatggtggaaatcatactgtgcccttttccagtccatgttttaaaagactatcaagcgctacttcctatatcttgaaatactcacttttggaactcagacaccactatgctacgagaagcccaaaccacatagaaaggccacgtgaaagtgctccaggcgacagcaccaactgagctcctaaccagtagccaatatcatgccagccatgtgtctcagccatcttggatggccagcctagtcaagccttcagatgactccagccccagtcattatctgactacaactgcataggacttgaaatgagaaccacgtaggtgagcccaatcaacacagagtcatgagcaataataccaaatatttgtttccagccactgtgggatcaggctcttttttatgcagcaagagattatctgaacatcatatttgttgctgcataccaggtgcctggaactatgcctggaggtcttgatattcaatgaaagtggaataaatcaaataaataaaaatggaataaataaacgaaactctagaagctatggattctagggagttgagctggagatcaggaggaatggatattaggtctcaaagaaatgacaaggtaataaggtagaagaagaaggctgtggataaacaaattttctggggccttaatggtggtgagaagtgggcaagttcaatgttgagcaggaccaaattcaacagaccctcagcaaatgtttgctcacttagcagtacacagattctgcatacatcttccttccttttaaccattcctttaattgtataagcaatatattgagtatctactgagagccaggctttgagttgggtgaagactattcagcagttaagtccctttaatgcttatacactgttgatgggaatgtatattagtccagtcactgtggaaagcagtttggaaatttctcaaataacttaaaatagaactaaggttgaatccagcaatcccatcatgggtataaatcccaaaagaataatcattctaccttaaagatgcatgcacacatatgttcattgcagcactatttacaatagcaaagacagggaatcaacctagatgcccatcaattgcagactagataaagaaaatatggtacatatacaccatggaatatactatgcagccataaaaaagaatgaaatcatgacctttgcagcaacatggatggagctggaggccattatcttaagcaaattaacacaggaacagaaaaccaaatattgcatgctctcacttaggaggtaaacactgacttcacatgaacacaaagaagggaacaatagacactgggtcctacttgaaggtagaggatgggaggagggtgaggattgaaaaactacttaccaggtactacattcattacctgggtgatgaaataatctggacaccaagccccataacatgcaatttacccatgaaacaaatctgcgcacgtaccccccaaacctaaaataaaagttggaaagaaaataaaaatgaaaaacaagtccctttcttatggaacttaacaaccatagagtatttggggaaacctcaaaaccacaggcaggtggttcaagcccccatctctgaccttcattaccctgctgtatagccatgattacaaaaaaaaaaaaaaagccagaccattcaatgctattgcttctctcttccaaatgggatgaagtgcaggcagtaaaccagggaagatgaacttggccaagtccttctattcattttgtggcagtgatgacaatttcccattgtggggagctggaggggcagtctccttctgttcaaacgactcagcacacttttgagggggcataagaaccagaaagtgcaggtgctagtaaagcaggcctgtatttacagggagaatcagtccacagacttcagcttctcaaaaccattgttaatgtgcttttacaaaatgcaaaatgctgctagacagttcactgggtggccttgggcctacccagttcttccctctttccccaactcatggttcttaagaataactgaagaatgtgctagaaatgcaacatcttgagatagagagggactggccagaacgacccaacctctgttccagtccacccctagaaacaaaatgtcttaaacactttagcccagcaaatcacacatcctggggtataaaacacagaaccagctgctttctggggtatctgagcttctgtgtaagtgaggcatgcacagatatgactctacttaccctcagcaggtttccggggacttggaggaatagctcacaatgaatcctaggcttctaccatctcttgctgcctatctgtaagtaataaacctacctcatgtaacttgttgtgtgggagtgttctgtctcactggacaagttggtagccagtgaacagtgaacctgcctcacaaattcctctgctgtaaagtgcaccagaagctctcagtcatggaagttctgtgctcaaatcttccttcaaggtgaactgctctggaagcagagctaactgacaacctctagctgctgtaccttttgacccaccgaggtgttcatgctaggctgcacttccctggggatcttcccagccagtgactgggcacagcggaagtaatggaattaggtgattctaacccaactgggagttgtccaacagagagagttgccttaggaactattacggctggctgatacattctcagagttgtgctgaagcctttctctttctaactatctctcttccttcccactctgctttcagaggtgtcagacctgcattacggtctgaaatctctccctgctccctccccatttcccttcacaggcattttcttcaatgaatttcctgcacaattaatacttggttttctttcatgttgtaaaccactgtaggatgactacagttaacaatatgtagttttggccaggcgcagtggctcgttcctgtgatcccagcactttgggactctgaagcgagcagaccacttgaggtcaggagttcaaaaccagcctggcaaacatggtgaaaccccatctctactaaaaaaatattagtcgggcgtggtggagcgtgcctgtaatcccagctacttggcaggctgaggcaggagaatcgcttgaacctgggaggcagaggttgcattgagcagagatcatgctactacaaatcagtctgggtgacagagcaagattctgtctaaataaaataaaatgataatagtaataataatgcagtttcaaatagctagaaggaagatactgaaagttaccatcacaaagaaatgagaaacgtttgagatgatggatatgctaattaccctgatcaaatcactatacattatatatatcaaaacatcactacgtactccatcaataggtaccattatttttcaattaaaaaataatttttttaaaaaaagaaatatagaatgttatacttgtaaaaagaagaaaatggaaactgaggaatcaaattatgtaagagtgatcttccttctcatcagctatcattttagaaatttgtaggaaaagaggagataaaggaagagagcaagaggaagcaaataagcagagggaggaaaagaggagaaagtaaagaaagaattagaaagtaaggagacacaacagatcagatcagctaccataattcaaatgctcgccaaaatcacttcctatatttgcaatacagaagctgcaggagacatgttatttaaaattagtaagagggccgggcacagtggctcatgcctgtaatcccagcactttgggaggccgaggtgggtggatcacaagatcaagagatcgagaccatcctggctaacatggtgaaaccccgtctctactaaaaatacaaaaattagctggacatggtggcatgcgcctgtaatcccagctacctgggaggctgaggcaggaaatcacttgaacccgggaggcggaggttacggtgagccgagatcgcgccactacactcgagcctggcaacagagtgagactccgcctcaaaaaaaaaaaattagtaagagaatgagaacttcatacagaagttgagaagtggatttgaaatcagtggagactgggaccttgtacaattaattctgttttgccttctgctactcagaggacctgaactgactcacctaccgtctagagacagctactattttgtatttcttttttagtttcatgcatttaatttgcatgattatcattttgctttatttccccattttacattataatatgtgccacctcatgttactgtgcttcatgtctattattgatgccccataacattccattgtatggaagtatcataaatatcaactatttccctttagttggacattcagggtctttccagatttttttcctaattaaatgatgctgcaataaatgccttgtttcgctccttcagaacaggtcattgcagtaagggcctctccattggagtggtggattttagttgtctgggacttagggttttggttctgattctgctacatcctaacagcatgaccctgagcaagttacttggtttctcaggactcctgtttcctcacccatcaaatggaggtaacaccagacaaggatcctttgtgactatcagatttaatccatggcatcattttgaaaatattttcttttttcttttttttttttttttttttttttgacacagagtctcactccatcacccaggctggagtgcagtggcatgatctcagttcactgcaaccttcgcttcatgggttcaagcaattctcatgcctcagcctcccaaaagatttccatgtaaggtgcttgcaaagggaaaaataacaacttgtgtggtcaaaaagtttagaaacccctggtctaaatggcgttagcaggacttatcagagcctttattataacagcacacagtcccaaaggtagatccttatggtattatcttagtctattcagactgctataagagaatgccataggttgtgtggcttacaaacagcagacatttatttctcacggttctctccagaagatctgggaagtcccagatcaaggcacaggcagattcagtgtctggggaaggccttcttcctagttcatagacagccctcttttcactgtgtcttcccatcatggaagggcaaaggggctctctgggaccccttttaaaagggcattggccaggcgcagtggctcacgcctgtaaacctagtactttgggaggccaagatgggcagatcacttggatcaggagtttgagacagcctggccaacgtggtggaacctcatcgccctaaaaatacaaaaaaaaaaaaaaaaaattatccaggtgtggtagataattatccagtagtctcaactactcagaggatgaggcaggagaatcacttaaacccagaggcagaggttgcagtgagcctagatggtactactgcactctagcctgggaacagggtgagactcttgtctcaaataaataaataaataggcatgaatcccacttgtggagtccccaccatcatgtcctaatcacctcccaaaggccccaccccctaataccatccatcacactggggattaggtttcaacacatggtgggaacacatttagtggatagcaagcatgaagcattaatcaagcttatttgcccatcatgcccatgaaattctgaagtctgacaagcagcctgtgagaagaaagacatacaacaaggaggtaggactatggtgctttggggtggaggccactgatgaaaaactcacccctcgaaagcatctcctactttgatacctacggatgcaacatccaggtagaaccagcctcgatgtcttctggagcccaggacctgatctccaagctggcccaagacaaccctcagagtgccactgttcaagctcctcttgctccataatcactttaaagaggctgcccccacccctggggctcagagggcttcctgtgacctgacactatgatcgtgagcgagtgccgcgctctgttcccaactatgcttcctcatctgtcatccatggcttttcttttaaggagttatttacgaagagctgaagcaatttgcttttaaaaatgaaaaacaacagaactagtattttttgtaagtcagcttgataggcagtaaacaatcctgccaaagcaaagcagaaaatgctgaaaaggttcatgtctcttcaacgactctgaccaagacttcagaggatgctccaaggggagaaacatgctcagggctacagaagcgacaatcatggataccctaagctggtctttcccaggagcaattttaccatgcaattttccctggatcctttctctatcgccccataacacctctcccatttggaaacaaaaatataatctttgaaagaaaaatagaaatcactgtctaaataaaaataatacattcctagcattcattcaccctcttcatcctcctccctgcccctgcgggggggaaaaatctcatttatcatgttgaatttctcatctcttgtgaatgccacgcaattgggtaaataagttctgtgttcaatcttttgtttttttgtttgtttattgctttattcattcacaatggaaagaaagactaaacttcaggtagagataaaagaatataagatgtatttttaactgtccaagatcatgggatctccgaattctattcatgatagaatgtttgagcatctgtggaccccagtttgtgaactcttgccctgaaacaaagcctgccagttatctgtgttcaatcttttaacaggggttattcaatttactcaagccaacatgagaggtttccatgacaacctctcagcacattcagtcttcatataaatgagttattgcttttatgttctcatactctaagacaatggggaaattaacataatgtggtcatacaaaaaaaaaaaaaaaaacaatcaaaacaatcaaaatcctcatatcctccccagaaactcacagatagcattcggtgaaaaagaaccaaagagaaatgaagccttcacatctgacaacactgttaacattagagatttcatttcagatgcatttaaatgaagccagaccataatggggttcaaaaaaaagtgtatagacataactaaactgcagaggaaagagacgtaaagtcagggacccaaattcactttcaggccatatatcctccaaagataaccaccattctctgcctctctttctgcaccccatccacactagcattcctgccccaggaccttcgcacatgctcttccctatgcttggaatgttcttcccctgctgttcttccagtgctgctttgcttagctaactcctactcatcctcaggtctcagctcagcaaagtcacttcctcagggcagtcaagctttgccactcatcaagactaggtaaaattttcttgttaaatctatttatggattttcctggttctttgtatttttcatcatcttagataggttagatttccccagaaacaaatcctaagagaaggtgagatggtttggctgcgtccctacccagatctcaccttgaattgtaacaatctccatgtgtcaagggcgggggcaggtggagataattgaatcatgggggtggtttcccccatactgttctcctgatagtgagtaagtctcatgagatctgatggttttataaatgggagttcccctgcacaagcctcttgcctgctgccgtgtaagatgtggctttgctccttcttgtcttccaccatgattgtgaggcctttccagccatgcagaactgtgagtccattaaacctctttcctttataaatgacccagtctcaggcatgtctttattagcagcatgagaacagactaatacagaaggacttgaagataagtgggttgatttggaaagtgagcccaggaaacactgggatgacaatagggaaatgagacagagaagggaaaggagctaatccaggtcatgtttataagcaggctgctactatgggcaactggggttcaatcccactggggacatctgggagacagcatagcgcctgcctcaccctaaggtatggaaggcagggcaactgccctcagcagctggctgggggagatgtgcctgtgttggtttctctgcacttccagcctgccccacaagagcctaggttatggcagtgagacaaagccccaggcagtattgcagatgcttgcagtaggaatggtgagtacccagaggacataggcaaggcaacaactacatctgccaccttccccaatgcaaacagcataattattgctggagactggagatcagtggaatagaagacagaagatttaattcaaagccattagacaaaaaataatagtcccattgaagacaaaggcatgggaatacggggaaggtataaatccacatgaatagacaattttcaaaagaagataaacaaatggccaacaaacacgtgaaaaaatgctcaacatcactaatgatcagggaaacgcaaatcaaaaccacaatgcgataccaccttactcctgcaagaatgaccagaatcaaaaaatcaaaacataatagatgttggcatggaggtggtgaaaagggaacacttctacactgctggcgggaatgtaaactagtacaaccaccttggaagacagtgtggagattccttaaagaaaagtagcaccaccatttgatctggcaatcccactactgggtatctaccctgaggaaaagaaatcattatatgagaaagatacttgcacatgcatgtttatagcagcacaattcacaactgcaaaaatatgaaaccagctcaaatgcctatcaatcaacgagtggataaagaaactgtggtatatatatgccatataccagcagtatatttatactactcagccataataaggaatgaattaatggcattcacagcaacctggatggaactggagattattattctaggtgaagtaactcaggaatggaaaaccaaacgtcgtatgttctcactcacaagtgggagctaagctatgaggatgcaaaggcataagaatgatacaatggactgtggggactcgggggaaagggtgggagggggtgagggataaaagactacaaattgggttcagtgtgtactgctcagataatggctgcaccaaaatctcacaaatcactattaaagaacttactcacataaccaaataccacctgttccccaaaaccctatggaaataaaaaattttaaaaataaaaaataaatttacatgatataaaagaccttgactctaggcctgggtgactgattatatactggggtacaggttttagtcaaagagctggagactatatggaaaaggggtgtctaaggccctctctgacattctaacaacccccatcatctcttttgctggccaggggcccacctggtaggacagtccaatccagggtaattctggctcacaggtcacacaataccaatctttggtcccaaggttaggagtggctgctcccacaatggactttataataacctctccaacctctgtttgttgagcttagattcttaagcctctaagcttctgatgactcttattagagaaagtaatataattacccatcaataaagaaatggctcattcagcaaggatatatctgttcaatcaaatatatctgttcaatcaaatcactaaaaacaatggccgtttaagagtacatatacaaaaggtacgtgtgcaacagtataataagagcaaacctaaattatgcttgttgttcactgattgtctccccacagtagcatggaagttcagcaagagcagggatctttgtttttgttcaatgctaggtcctcagcacctaggactgtgccaggcacaaaaacatccagcacccaccaaggtaaaatttacaatgtctgacatcccataaaagttactttaaaaatagaggctgggccaggtgccgtggcccacgcctgtaatcccagcactttaggaggccaaggtgggtggatcatgaggtcaggagatcgagaccatcctgccaacatggtgaaacctgtctctactgaaaatacaaaaattagctgggcatggcgacacgtgcctgtaatcccagctactcgggaggctgaggctggagaatctcttgaacttgagaggttgcagtgagccgagatcgcgccactgaaccccagcctgggcaacaagagctagactccgtctcaaaaaataaaaaaatagaagccagtggccaggagctgtgaccgacacctgttatcctagcacttcgggaggccgaggcaggtggatacttgaggtcaggagttcaagaccaacctggccaacatggcgaaaccccatctctactaaaaacacaaaaattagccagtcatgatggcacacacctgtagtcccagctactcggaggctgaggcacaagaattgtttgaacccaggaggcagaggttgcagtgagccaagactgcaccgatgtactccagcctgggcaacagagtgagactctgtctcaaaataataataatagaggccaggcatagtggctcatgcctgtaatctcagcaatttgagaggctgaagcaggaggatctcttgaggtcaagagtttgagactagcctgggaaacaaagcaaaaccccatccctccaaaaaaactttttaaaaactagccatgcatggtggtgcatacctgtagtcccagctactcaggaggctgaggcaggaggatcacatgagcccagtagtttgaggttgcagtgagctatgactgtgccactgtactccagcctgggcaacagagcaagatcctgtctcaaaaaaaattaccttaaaataataagtaaataaatatcaattttacaataaaataaaagtgactcagcctaccctgggtggggttaagggctggcctctatcacacctatcagctcccagaggtcctggatcccccagaagctgctaggaggggctgagggccattactcagaagtgcagagtggagcaagctttgaccaataagagacaggaaacagcaggagctggcagatgactgactccagagttatcccatgcttgtgtttctgggaaactgcaactccactaggcaatatacacttctttggttttgctcttcctctttctctctttcccttatccctgctttcttgagattgcgtgacccaatgaaacatttgcatatttgtatcaggcactgttggtaggctaagataacctccatccccaaaacctatgacacatggggtatctcctgaaggatgccattcaagttaatccccaaacattatggcttaaagccacaactgtttttattatagatcatgattttgagggtcaggaatttaagcaggacccagctgggcagttcttctgctcacacagtatcatctgaggtcactcagtagtattcagagggcttcggggctgctctgaagggtctagtgcagttttagtgatgtgccaggcaccttggtgggtgtattagtccattttcatgctcttaacaaagacatacctgagactgggtcatttttacaggaaagaggtttaatggactcagagttccacatggctggggagcctcgcaatcatggtggaaggcaaggaggagcaagtcacgtcttacatggatggcagcgggcaaaaagagagcttgtgcagggaaactccctgttataaaaccatcagatctcatgagacttactatcatgagaatagcatgagaaagacccacccccatgattcaattacctcccaccaggtccctctcacaacatgtgagaattcaagatgagatttggatggggacacagccaaaccatatcagtgggacaggatggaagctgggctcagagcaacttctctccctttccatgtcatctcagagtctctccaggtttccctccagcaaaagccctcagatttcttacacagtggatcaggggtttaaaaccaagagttccaagaggtgtaaggtggaaactgcatgatcccttaaatgccaggaccagaaccatcatggtgtcacttctatggcaatctattcgtcaaagcagtcacaggccagcccaggctcaggaaaagggaaatagaccccatttctgaatgcatggggtatcaaacagtttgcactcatctttgacctgccacagatacacaagaactgggaggaggggtgggtggaagactgaagcattagagtaagaggggctccttcatcctccggtcatcattttccatgtgcacgtctgacttttttcaaataaaaactggggaaggacaaaaagtggggaggaaccatgtcaataagctgaatcctcatcttctatggcacagagtcaatagaaaatgtcttaaattgataaatcaagaaaaagcctcataagcatcttatttggagttacagagataaataactgaagacctaaaaatggaaacaacatttcaagcacttgcctccgggaaataagacttaaggaggggagagaggagagaaggggccaggaaccgctgctttcattggcagctcctctgtactttaactttgtacgatgtgctcatattactatgattttttttttaaattcaaaagggaaaaaaataagaacaaaatgatgatggttatttttaaaactatgtaattaaacctggaaaaatctcattttgctaaacggaaaaaaagtagcaggatacgaaactatattaatagtatggtcataagtatgtttaataaagaaagagaaaaacatatatgggaggagaaaaatctgaagaaatttacctaccaaatgatagtgggtgggtttctctacttttctaggtttcccacattttcaacaacgtgattctcatactttcctaatgaaaagaaatacattccttacataaaataaattaactgggccgggcgtggtggctcatgcctgtaatcccagcactttgagaggccaaggcgggcagatcacctgaggtcaggagttcaaaactagcctgggcaacatggtgaaaccccgtctctaccaaaaatacaaaaattagccaggtgtggtggtgtgtgggtgtgtgcctgtagttccagctatttgggaggctgaggcaggagaatcgtttgaaccggggaggtgggggctgcagtgagccgagattgcgccactgtactccagcctaggtgacagagtgacattccatctcaaaaaaaaaaatgaaaatggctgggcgccgtggctcacgcctgtaattccagcactttgggaggtcgaggcaggcagatcacgaggtcaggagttcaagaccagcctggccaagatggtgaaaccccgtctctactaaaaatacaaaaattagctgggcatggtggcacttgcctataatcccagctactcgggaggctaaggcagagaattgcttgaacctgggaggcagaggttgcagtgagctgagatcgcgccactgcactccagcctgagtgacagagcaagactccgtctcaaaaaaaaaattaaaaaattaaaaaataaaaataaaataataaaataaatgagccgagcatcaattaaagaaaatgccagaaggttctctgaagaactttccacaatagaagtgtattttaagtccctgagccttcatctcatacctatggacaggggactctttgcactggttctggaacgctccagtccaccatgcccacggatttagttaggaaaccttcccagaaagaacttagtccatgtcatttcaaaatgaattaattcaactcaacaggaacttttgtaagcctccaatgtatgcggttctgaacttttgtaagcctccaatgtttccagttctgaatctggaatgctcattcagccacaaaataaacatttattgagtacctactatgtgccagacaaatgctacttgcaggggtgacaatgatagagacgggcaaaatattcaattctttggagccatagactaatgggagaggcagacaagtgactaggcaagtgtaatacatcctaacagacactttggggaacagacaaggggctgtggaaggaggcaacctggagggcttcctggaaaaggccaaacatgggccaagcgccgtggctcatacctgtaatcccagcactttgggaggttgaggcaggaagatagatcacttgatcctgagagttcgaggccagcctgggtaatatggcgaaacctcatctctacaaaaagtacaaaagttagctgggcatggtggcatgcaactgtagtcccagctactcgggaggctgaggtgggaggatcacttgagcctgggaggttgaggctgcagtgagtcacgattgcaccactgcactccagcctgggtgacagggtgagaccttgtctcaaaaaaaaaaaaaaaaaggccaaatatgagctcagagctcagtctcaagggatgaaccagggcagatcaggttaaaggggaaaagctgttgccagtacagagaatagaatatacaaagacccagaaacaacagagaagatggatacattcaaggaactgagagtgatctcaaaaaaaagatttgtcatgatcagaagagacagtcccaaaccagcactcacttgggggctctgggactggactccctaaattggaatctcagccccatcatgtgagctcaaagtgcttcacctcactgtgcctcagtttccatgtctgtaaaacagggtagaagtagaacttagaagagttataagaattaaactagagaagtgagcattgtttatatgtgcttgttgctatggatccaaaactgccagtaataacaataataataataataatagcttatgctttcgttgagcccttgctttgcacctggccagtgacaggcacattatcagtaacacaaatgcaagtatctcatctaacccttgcatcaacgctcagagatgggttttatcaacatccccattttacagatgaggaaaactgaggcagagcagttgcacaacgtcgcagctgttcctggtgcttcacccagatcctcattgccagtaaaccattcatcattcagcctttgctgatctgtgcctaatggcttataccaatactttctccggagaattccttagctagcaaaagccatttcacccagggagttatgctctcacatgctgaactggccaatgactaagcgatatgaggcgagaggagtcacacaaaagtccagtcctcctgcttcgaggcagaatacactccagagacccacgtgagatcaaggctagccttagcctgagagcccattcttgcttggctctgtcccctcccccatcatcctccttccctcactttccttctcctgagaacccccaccttgaataaaccgcacctacccaaatctcattctcgggcttccaaggaacccaacccgtcacacaacttgcagggattcggaccaggttttctccttccaaagggccaccaagctgcaagctgcaccaggttcatctcaaaatcagagtcatgggatcaaagaacagttgctgatgccaacccctgccggcatgagcccaccgctggggaaacaaggcgaaccagacatctcagactagaggagtgaatccaaggagagaagatgacaggaggtgtatttgttctcacgctgctaataaagacctacccgagactgagtaatttacaaaggaaagagggtgaatggactcacagttccacatggctgaggaggtctcacaatcatggtggaaggccaaagaacagcgaagtcacatgctacacagcggcaggcaagagagcttgcgcagcggaactcccatttataaaaccatcagatctcgtgagacttactcactaccatgagaaccgtatgcggaaactgcccccatgttttaattatctccacctggccctgcccttgacacgtggggattattacaattcaaggtgagtttggatggggatacagccagaccatatcaggagagggcacagcattaggacgcagccggtggtactgtaattcgggtcgggggaggttgctgaaatacactcataagggtagtttaaaaagagcatcatcaaggagacaggctttccagccttggccttcgggagaaagaaagagagagtgaaaaaaacatgggctttaggcctgacgcgtggctcacgcctgtaatcccagcactttgggaggccgaggcgggcggatcacgaggtcaggagttggagaccaacctggccagcatggtgaaacctcgtctatacaaaaaatataaaaaattagctgggcatggtggcacgtgcctgtaatcccaagctgctcgggaggctgaggcaggagaattgcttgaacctggcaggcggaggttgcagtgagccaagatcattgcgctgttgcacaccaacctgggcaacatagcaagactcggtctcaaacaaacaaaaaaaaggggaggggcagggctttagacagatccaagctcaaccctgcaagttgccgggactccgtttctttatctgtaacatggagatcacgatgttcacctcgcagagtagattaagcagctggcatgtgtgaagtgcccagcactgtgtctagcatatgctaggtacttggcatgtgtttctttctttccctcccttgttcaaggccacatagtccatgactggcagagctagaagccttctcatttacccacaatcaaagaacttctacaaaatagaaacagccccctgccccctcctgcccccgcccacctgctaccttaataggttatttcccagttattcaatgcaagagacttagcccagctaaagttattcaaaatcgaccttgagatcaggaacaaattggctacagcagtcagcgattggcaaatgcaatctaaatgccccaggcggcattagagccttccacgttgacaggaagagtcaatgtgcatcttggaaaaatctgagaaaaaaaaattaaaggtcaccgcatttgtaggcagaatgggttttcttgagaccattacaaacagactgcctaaattgcaaagattccaggcttgacagctcccggaggactccagatggaaagaacaccacccccatctcttatacatccaggctgctgtctgtggacgtccgaaggttctcccaccacccatgctattattgaaattccacaatcaacctgcaatgccccagtgaaccattttgctgggatgggaggaccaacttagggccagccctgtgttccaaggggctgaccaggcaggacagccaaggaggcacaagtctgtaagatgggtccaaacatttctgtaggaagggggtcttgagccaaagcaggaaaaatcaaaccccaacacaaagtgtagagagagtcggatcataaatcacacacagacagggtccgagaaacatgggctggggaccagcagatgacaggctaggataattgatcattagaacatctgtgctgtttttgttgtaagaatagtatcaatattaataacaacagctaatatatattgagtggcttctggagccaggcactgtggtaaacttttgcacgtatcctctcacttaatcctcacagtgctctacaaagtgggtactggattcatgcccatttcacagagaacatatctgaggctcagagaggcatctacaaggtcaaccaggtaatcaggaaagccagatttcaagggcttgtccacatcactctatgacatgtggggaactcaagtgtgtgttggcttaactcaaataaatagtacaagttaggctgggcacggtggctcatgcctgtaatcccagcactttgggaggccaaggcaggtggatcacctgaggccaggagtctgagaccagtctggccaaagtggcaaaaccctgtctctactaaaaatacaaaaaattagccaggtatggtggtgggcatctgtaatgcgagctactcaggaggctgagacaggagaattgcttgaaccccgggagacagaaattgcagtaagccaagatcgtgccactgcactccatccagcctgggcaacaagagcgaaactccgtctcaaaaaaaaaaaaaaaaaaaccaaccaacaaacaaacaaaaaaacaaataaatagtaaaagttacttctcaacacgagccagtcattttttaaagtatcttacatttttcttttcctttacttattactttttgaattgacaaacaaaaattgtctataattattgtgtacaacctgatgttttgaaatatgtatacattgcggactggggaaatcaagctaattaacaagtggtggggatgcttcaaatttactctcttggcaatttgcaagaatacaaacacttttattaattatagtcactattttccaaacaaggaaacgaatgcccagtaaaagtacaaagtaacagaactcctcactgaagctggggtcatgggtgaaaaagataaatataggctgggcgccgaggcttatgcctgtaatcccagcactttgggaggcagaggcaggtggatcatctgaggtcaggagttcaagaccagcctggccaacatggtgaaacctcatctctagtaaaaaaaaatacaaaaaaaaaaaaaaaaagctgggtatggtggcaggtgcctgtaatcccagctactcgggaggctgaggcaggagaattgcttgaacccaggaggcagaggttgcagtgagccgtgaacgtgccattgcactccagcctgggtgacaagtgtgaaactccatctcaaaaaaaaagataaaatacaaatacatccatatataattaaaatatgatagtggtgtgttttcctgtttaacaaatatttacttccctctcattcccttcaccatgggaagaacagaatcctctgccccgttagtgatgggtttgttttggccaatggaacatgagcagagctgacggtgcaccagttcccagcttagaccttaaaaggcattgagtatttctgctcactcctctctggaagctgccaaccttcaccaggtaccactgcttctccaatctggacctcagaaataaatgtaagaatcagacttgaactcaacccacagcctaaagcagaatctctccagctaaaccacagacctatgagcaaaaaaaagtgtttatttttataaccatgagggtggtgttacttgttacacagctacaggtaactgatacatttacacgtgaatatgtgcacatactatacatgtgcatattatataggatacatatgtgtggccgtgttacatggaaatagatacatataaatccttaaaatgtatctccatatgtgggatatttatacatatctatttgggagatagtaaatgaggtagaatttggagactgctaaatttgcattcttgcattgacacaagctgtgcattttgggggaaattacttgacatctctgagcacattttctcctttgtaacatggagataaagatgaagcttatctcataggattactgtgagagttgagtaaaataatacacgtaatgggcttagcagggagcctaacacacactcgctcacacccattcattcaataaatgttattgagtaaccacatttgccaggccctcttattggtgtttagaacacagttactagctgtggggaaaaaagcaaaaataaaaaggataaggagagccagcagccccggaggaggagggaggcaggcataggatgtgcctgtgcctggcacgtagtaagtgctcaattattggtagccatttttattctcaaagtgattaacgtgagaacaagggggtcagctggagatttaaaaaacaataatcagtctctctgctccgcagcagacccctgagacccttggcaaaccccagcaatagatcaaggaccttcagtaggtgaatacagtcgcaggaactgctatagctgacacatagtccctgcaactccagccagacgccagcaccagctgccactgggagatgtgagcttggcttctccatgaaagagaaagattcctggggcctcagccatgcctcaaacccactgataacatcaaacacacattgctggggggagccggccaggtgctcagaagctgcagggtgaccctgcatgtaggtgtcgggaagtcagcagcgactcgcgggtggagaaacacccacgcctttgcaaacactcttaatgtaatgcactgcccttgaggccacctcccgtttttttggccctaattggcatgtttttctgtctcctcagaaacagccacgggagacaacattccatagcagttaaaagtgtggtctctgggtttgcaaccagactattccccaccagctgcaaccttgggcgagacacttaaccccaggagcttcccctcccgtggttgtgatgattaaatgagataaccagataaccccttagatggcaaacactcagcacagtgcctgatgctcatcattgtggcttttattacggactcattttataaacgaggacatcaaggcccagacagcttaagccatttgctcaaggtcagaaggtcactctaaccttgccatcaaatcttgggattttctttttcctccatcacaccatccccaactgatctactcctcaagtgaatttcagaaatcctccaaagatgaattttgatctacctagagctgtgctgacttaactggagcatagcacatattttcaaaacaggaggaaacttgaccacagctttgagccatgtggatgataaagtcatcgtaggtgaacttgagactgggattcggcccttgtgtcaattgtgattagcacagagtgaagcagcgtcattctctcgggggtaatacctgagattcgttgcctcataccaaaaacattaaggacacagacacacacaaagagtgagtttaaaagcagaggtttaataggcaaaagaatgagaaaggagaacactgtctctcttccgagaggggggcacccagtgggacttctggcccaagtcagagtgcaccagattttacagggttggggaggcggtgcctgatttactagggcccaaagattggttgcaccaggtgtgacatttacatagcgcatggggaagttggccgccccaccctagtgttactatgcaaatggggtctttgcctggctggctccttgttgcctgctccttactgtacacatggctggcaaagagaagggaagatggaactgccgtgttggacgtgcctagccccagctagccttttcttatgggcggagctgccggcattcacccgtgcaagcttccagcttgcttgcctatgtctgcagcttgattttacaggatgctctccgttagaaaagaaaaatgatttggggactgcttttcattaaaaggaaaaccttactgaggacttccttaccctcactatctgcctaaataatttcttcttaactcttacatcagtaatatgaactcaacagactgaaagtaacaatcagatcacaaacacagatgtctacagagtctggaggttactagggtgactatccatcctggcttgagcactgcaagtcccacactctgggaatccgctcaggcctgggcaaaccaagacagctggtcaccctcgccgtaacataagtgagtaaaggtataaaaagctgtgcctgtctcagcgttttccacttctgagaagcaatcatgtatggtggttaaaagcaaggactctagagccagactcacttggtctataccccacctccgttgcctaccagctgcaggacctcacacaggattacccaacctcaccatgcttccgtttcctcacatataaaatagagatattagagccccctaccctaggtcagcctcaacaccactgacattttggacctgatcgttctttactggggagtctggggacagccctgtgccttgtaggatgtttagcagcatccatggcctctacatactggacgacagtagcacagtataccctagttgtgaccatcaaaaatgtctccagacattgccaaatgtcccttatggggatagaagtgtccccagttgagaaccagtgtcgtaggcagtgttgtgaggataagggaggtggtacatgcaaaatgctgagaaaaagccatgacttggagagtctgtttctacaggaacagccaataaagccttagagatggagcaggaaggtggcaagccaagagctgagcaagcaggaccttggagggaccaagggcagggcagccaagccactgtgaagtggaacaagttctgcaaacggaggccagcccggccaccctccccctcacctctcacacaagattggacttctatttcaccccaggtgcggaaagtggagtgaattactcctcagtttctggcatggcaccacggtgcagtgcaaaaccccctcagctgaggtattcctcttctcttgaatgtgtgcgcattcttgtgaagtgcatttgctcatcaaatattgagtgttcagaatgtggcacgaagacagcggtgaacaaaatagacagaaatccctgccctcttgtagctttaagcatactgtcttgtgtacaaatacatttttaaccaataaaaattgtgtcatactatggtctagatatggtttgttttggcccctgccaagtctcatgttgaaatgtgatccccagtgttggaggtggggcctggtgggaggtgttttggtcatgggggcagatgcctcaggaatggctgggtgccattctctcaagagtgagtgatttcccactcttagttcctgcaagaactgattgtgtgtgcgtgtgtgtgtgtgtttcaagatggaatctcgctctgttgcccagactggagtgcagtggcatgatttcagctcactgcaacctctgcctcccggattccagagattctcctgcctcagcctcccgagtagctgggattacaggcacccgccactacatccagctaatttttgtgtttttatttttttctatttatttatttatttatttatttatttatttatttatttatttattttgggacacagtctcgctctgtcagccaggctggagtgcaatggcaagatctcggctcattgcaacctccacctcctgggttcaagtaattctcccacctcagcctcccaagtagctggagttacaggcaagagccaccatgcctggctaatgtttgtatttttagtacagagagggtttcgacatgttggccaggctggtctcgaactcctgacctcaagtgatccacccacttcggcctcccaaagtgctgggattacaggcataagccactgcatccggccgagaactgatagttaaaaataacctggaaccctcctctgtctcctattcttccctgtctccttcttccttctctcatcctccttcctcatacccctcttctctccctctctctctctctctatcttaccatgtgatctacacacaccagttcctcttcacttctgccatgagtggaagcttcctgaagccctcatcagaagcagatgttggtgccatgattcttgcagaatgatgagccaaataaactttttttctttgtaaattatccagcctcaggtgttcctttatagcagcacaaacaaagacacttgctataaattgattctgttgctcactttttttccccttgtgctttgtttttaagatccatccaggccgggcacagtggctcacgcatgtaatcccagcactttgggaggctgaggtgggtggatcacctgtggtcaggagttcgagaccagcctggccagtatggtgaaaccctgtctctactaaaaatacaacattagccaggtatggtggcgggcgcctgtaatcccagctactcgggaggctgaggcagaattgctggaacccaggaggcggaggttgcagtgagccgagattgcaccattgcaccccagcctgggcaacagagtgagactccatctcaaaataaataaataaataaataaataaaataaaagatccgtccatactggcatgtgaagatcagacctgtttttctaactaccgcagtcatatcccacagtgagtatctgtcatgctttgcttatctatccccttctgatgcgcacagcagtggcttccaataccccgctaccacaaacccacctccttgaacatccttgggtgaaactttctctggggtataaatccaggaggggaattgctgctgctcagtctttaatatgcacaggactcacccagggatcttgttaaaaggcagattttgactcaagaagtctggaaggagactcgagaatttccatttctaacaagctcccaggtgatgctgatgctgctggtctgggaccacagagaatatgcagccttcatttgctttagtgtcagatctctctagaatgaccgcgccagtccacagtccaagggcttgcttttagagggggccaaaccccactggcccccctaacacggtgtagacttgcagggctctgctgagagccaccattaaccacaagcatcatgtccgtattgctaccgttcgtcaatacccttgaccctcttgccttcaggaaccctctatttccaagcacatctccaaatcagagccccaccccctccacaatgcaaagtgggaccatctagaagaacatccagcccaacctcctggctttataaagggagaaaccaagactgagagacttgcaagaaatcacaagaaattcccgtttctttgcatcttactcctccagagccctctttgagtgatcagtaattcgtccacaatttataggacttagttcactttacccatctttttccatctccctgccccaccccactccaccctccccatcccatatcccccagcccaccctgctttttaatccttgctagaatcatccattttgcgaccaagtattgacttcaaatgatatatgagacaattgacatttcaaatattccaggcaggatacagaattctgatcacggcccagtctgaaacatctcctccacatctctttccttattccttctgggcaataattgtccccccaccagcccaccccactcccaacctcgacattaatttcccctgattcatttttcatgcctttgaattctgccttttcaaagcagaatatgtttctgtagctgtttctcatacctcccttcccctcatgaatatttcaaatgcaatagtgatatgatcgttcaaccttaagaggcacaccaactttatcttatttatcttaccgagctgcttccgatcccgggattaagtccaaaacatcctttgagagtttgtttgagttgttttccctcaggctgttgctgctgtgtatgtaaattacaaagagaagcagcctccccctcccctcagccccagccccgggcaccagcccccggcccgagacgcccgccctccctctgccaatccttcctgggagatgcaagacgcgctcctctcaaagccaattggcaggcctccggacgggtccctgccagggcatgtctccctgacttcctccagtggtctcttagaagcccaaaactcaccatgcgaccttgggtagggcgttccgccactcaggcaagtttccccatctacaaacaaggggaatagacacggcgaccctaaagtcctttcagctctgagactccatgtcacgtgatgtaatgtaacagacagagccctacctggttccaatccaagctctactactaaacgagtgatgagatggctcaccaactgtacctaccactgactagctgtgtgacccttaactaactgtacctaccactgactagccgtgtgacccttaactaactgtacctaccactgactagtggtgtgacccttaactaactacacctaccactgactagccgtgtgacccttaactaactgtacctaccacagactagccgtgtgacccttcactaactgtatcaaccactaaactatccatgtgtcttttaattgtatctaccattgactagtcttgtgacccttaactgtctgccactgactagctgtgtaacccctaactaactgtacctaccactgactagccgtgtgacccttaactaactgtacctactactgactagccgtgtgacccttcactaactgtatcaaccactaaactatccatgtgtcttttaattgtgtctaccattgactagtcttgtgacccttaactgtctgccactgactagctgtgtaacccctaactaactgtacctaccactgactagccatgtgacccttaactaactgtacctactactgactagccgtgtgacccttcactaactgtatcaaccactaaactatccatgtgtcttttaattgtgtctaccattgactagtcttgtgacccttaactgtctgccactgactagctgtgtaacccctaactaactgtacctaccactgactagctttgtgacccttaactagctgtacctaccactgactagctttgtgacctttaactaaatatacctgcctctgactagatgtgtggcccttaactaactgtatctaccactaaactatccatgtgtcttaaactatccgtgtgtcttttaactgtctaccattgactagctgtgtgacccttaactgtgtctaccactaactagctgtgtaacccttaactaactgtatctaccactaactagctgtgtaacccttaaatctatcactaactgtgtgacccttaactgtgtccaccactgactacctatgtgacccttaactaacagtatctaccactgactagctgcacaacccttaactatgtcaaccactgactagctgtgtgactcttaactgtttctacaactaactgactgtgggacccttaattgtgtccaccaccgagtcggtatgtaacttgtttctaccactaactagctgtgtgaccatgatgcgagttacagaagttctcagggtctcagtttcctcccctgcagcatgcattggttaacagcagctgcctctggggctgtagtagggtgaccagccatcctctttggtttatctaggaccgaagtggttccaggtatagggaacgctcagtgtcaaatccagtaagtgctaaagccaacacaagtttgtcacccaaggttgtagtgagaactaaaggtgaatgaggtgacatggataaaatctagcacatcaatataagttagtgtcattactattgctattgctattgctttttgtttgtttgtttagagatagagtttcactcctgtcacccaggctggagtacaatggagcgctctcggctcactgcaacctccgcctcctggattcaagtgtttctccatactcagtctcctgagtagctggcattacaggcacccaccaccacgcctggcaatttttgtatttttagtagagacggggttttgccatgttggccaggctggccttgaactcctgacctcaggtgatccacccacctcggcctcccaaagtgctgagattacaggcgtgagccaccatacccggctgctattgttaacggttctgctcatggctataaaggaattttttttcacttctaattttttctagaatttcagatttctctttatcaaagcagtacaagcaaatgatacaaatgacttgaaatggaaaacaaagctgtcttaccccagcccttctcccatcaaatccctctccccaaaggcaggcagttgaagtcctttttagcgactgatcttttaaggctgactctgcctcagtcaccctctgttcccactacttcaggccctcaccacattggccaggctggtcttgaactcctgacctcgtgatcctcccacctcagactcccaaagtgttaggattacaggtgttgagccacagcaccaggtccatcggttttcattaccaccacctgacaggtgagcaggctggttcacactctggtcacctggcatggcttgtcacatactggtgaagctgtcacccgcaaaatccagacctgggactgaggaaagagctaagcgatcctaaagagatacagtctctcaggtggcccttgatgggggcaaagagaggaagggacagttcctcttttatttgtccattcacacatgttgggagccaggcattaaatttgcaagccagaaaaggcaggaaaaaccaagtttatggcttttcaagttggttcagaaattactgtatgggccctccaaaaggtttaatgtctctgtggtgtcatcccaaagagaagcacagagaagcaagaggatctgcagctgaagagcccagaggcaatgaacactcaccttgactctcttctcatttctgaggctctatcagttaaggttcttagtttgcaagcaacagaaccaaatcttttttttttttttttttttttttgagacaaagtctcactctgtcgcccaggctggagtgtagtgcacgatctcggctcactgcaagctctgcctcttgggttcaagcgattcttctccctcagcctcctgagtagctgggagtacaggcacacgccaccatgcccagctaatttttgtatttttagtagagacggagtttcaccatattggccaggctggtctcaaactcctgacctcgtgatctgcccaccttgacctcccaaagtgctgggattacaggcgtgagccaccatgcccagccaacagaaccaaatctttacattaaaaagcggggagcttacaggatcagagaaagaatagagttcccagacttgagggggttccagttggaccatctttgtatggtggtggatctcaaccctcactgcagccaacagtcaaccaaagagacttttagaaaccactgatgctgggccctcaccctcagaaattgagatttaagccgggcatggtggcttatgcctgtaattccaacactgtgggaggccaaggcaggcagatcacttgagcccgggagttcaagaccagcctgggaaacatggcgaaacctcgtctctactaaaaatacaaaaattagctggatgtggtggcgcatgcctgtagtcccagctactcaggagactgaggcaaaaggatagcttgagcccaggaggtggagattgcagtgagccgagattgtaccactgcactccagcctagatgacagagtgagaccctggcagggcaaggcagggcaaggcagagcaaggcaaggcaaaaaggaaagaaactgagatttaactggctcaggtctgtcttgtttcacacctcccctaggtgattctaaggtgaggttgaaaaatgagattcactactctcgggatgcaactgcaccgtgagtccagaaaccagcagtactggcatcaccatctccagtagagctcgtcagaaatgcagactctctctcagaaccaccccagacctttcgagtcagaatctgccctcgaacaagatcctccagttagcgttaagcagattaaaggttgagaagcactaggctgcagggtcatggaatgactggactctaatcactctacatccttgatgatctctccttaagatgcaaattcccagaaggcaggcatttgatgggccatgcttttgtcacaccatgatagaagatctgggcataagaaattctgcagagtggtcccaccagacccacaggcaggagaagggccgtccctgaacggagtgggatgcggggctgataaatactacataggttaagcacagcgaccttcacagttcagagatagtgatgccaactaccacttattaagcacctactgtatgccaagcacagtgccaaggactcaaattactcatggaattccccctataaccatgaagccaatattattattactgctacagctactactactattattttataaaggaagaaactaaggtttagagcagtagatccaactttagcatggatcagaatcacctggaagatttgtaaactcacagacttctggaacctaccctcagagttgctggttctgtaagtctagggtaaagcctgagaatttttatttctagcaagttcccagatgatgctgatgctgtttgtccattcacacatgttgggagccaggcattaaatttgcaagccagaaaaggcagtaaaaaccaagttaatggcctttcaagtcagttcagaaatcactgtacgtgcccccaaaaagggaatgccaaacattaggcaagtccccatcttcacaatgagaacttacccacctcagagagatggtttccccaggaaacaagtgcagatggcattttgcagaaagtgcacattgaaagaaagcaaactggcttagaaatatggttaatgggaattctttggaattcatagcatcaggagagagtcgtttccttctaccacacacctggctgggagggtgacaatgtccttaggagggagagactgggaaacattaataccagagccctggctattatttgcaatgtatagcaatgtttttcctcaaggtagatctttggtgagctgtacacagtaaagctagccattcaggtggaattacatccaactagtcatctccgtcatactaaaacagtaaacaatgcttgaagaagtcagatgcctggcatcaaatctaagatccaccatttactggctgtggtcattaggcaagatgcttaacgtctttgttccttattatcctattttgtaaatgggggaattataataatacctaatctctaggttactggatggactaaatgaaataatgtgtgaaatttttagtaacatagctagaatattacaagctcccaataagtctattgtattagtccatcctcacactgctataaacaactggccaagaatgggtaattgataaacaaaaggggtttaattgactcacaacaggtctgcatggctggggaggcctcaggaaacttacaatcatgacagaaggagaagcagacatcttcacaaggcgataggagggagaagtgagagcacgggaaaaaactgccacgtttaaaaccatcagatctcatgagaactcactcactatcatgagaccagcatgggagaagccgcccccatgagccaatcacatccctccttcgacacatggggcttacagctccctccctcgacgcgacacctggtgattataattcaagatgagatttgggtggagacacacagccaaaccatatcacctattttatttatcataccattattgttattattattattggtggatgtgctggtggcgttaatattgttggcaaaactggaactagctggatctttatcaataattgcaatcatgattctgacatctgaccctttcatgccactggtaggcatgtaaacaggcacaatttttctggaaggtcatttggcaatatgtatcaagagccttacaaatacgcacccattttgacccagaaggtccactcctagaaatttattttaggggagtacatccagttgaggacaaagatgtatgcccaaggaagccatcacattattgcaaatggtaaaaaatgaagtgtcaaccaacagaaaaatgtttctgaaattacactatgttcgtacaatgaaatcttcttccaattattaaaataatgttcatgccttttaattggggtgattgtataattttatatctttataaaaatatatgtatgtaagacttcatatagatgatgaactcaattatgtaaacatatgatagaaaaagagaagggaataatccaaaagccatctgctctgggtcttagaatgggaattcttatggttttgtgcatttttgcagctatttctcaatagtcccctttataatcagagcaggctgggtagaatctggtacaggagattgtggcaaactagataattaacccagagaacattatttctgtctgggtatgccattaagttacaaagaccttttgtaaatgtgggtaataatgaaaagagggctatagtgttggaaaggaagacaggagataaggaggaatgaaaaggagtaggtattatttctacagagtcttgaaagattaagaaaaatgaggcagccagatgcagtggctcacacctgtaatcctaacacttcgggagatcaaggtgggaggattgctggagcccaggagtttgagaccagcctgaatgattgagtaagactcccctctctacaaacaaaatttaaaaaactagccaggcatggtggtgtgcacctatgctcaggaggctgaggtgggaggatcacttgagcccaggaggttgaggctgcagtaagccgtgatcacaccactgcacttcagcctgggtgacagagcaagtccctgcctcagaaaaaaaaaaaagaaagaaagaaacaaaagaaaagaaaagaaaaaatgaagcaaaagataccagcagcattggctgagccctagaggtaatgggaagggttgatggggcaagatcagagacttctgtgatgtttccatttgatgagacaaaactcagcattagcagaattaaagttacctaatctctagattaggaaagggaacagagaaatacctcatggcaacacatggcctttttgagttgcaagttgacagaaactcaagtcaaactggcttcactgagaaattcactctaggtgagatctgtcatcaggttggaggggatacaggctgttaggcagtgtgatcggctttccttctcctctctcagctcggctctcctgtgatttccttctcaggcaggctctcccccagggtgatgagatgaccaccagcagctcccggtttccaccctaccaggtttgcaaccccagcaaaaagagaacccctctttccctatccacctaacagaagtcctgccactgatgctctttgaaccaccttaaaggcaggtttctgaatcaatcacaacagccaggagaatggcattctcccatctgccaagcccagtctctcgagtcacccaaaacacatgggctgagaatggaggagaggtcccacctctcccccaaaaaagtgagatactggtctaagaaacagaaaaacgaagcttacataggctaaatgaacccagaagcactatgtggagtttttccttccagaacatgaaccaagtactcaagttacccccagatggtatcagaaggaaggattcaacagtgcccttaaaaaagggccatagttctcaaccaggggtgattcctcctcctcccctcaggggacatttggcaatgacaatggggcagggggttgtgctactggcatctagtgggcagagtgtagggatgctgctacacaccttacagtgcacaggacaaccctcacccaaaggattatctagcccaaaatgtccacagtgctgagactgtgaaacccagaattaggatgaccttataagttatcgcccaaaccagaatgctttcgagacaggcaaaaccaggaaagcagtcgtaacagggactgttgcagcaaatgaggacatatggttaccctactctcaacacaccgtccaaacagaaggcaaagccattctcactgaaggctgtgattcaagggaaacgtttcaatgctccccaccccaatcatcaattacaggaccacagagatgctcttcccagccgaggcttgtctttgaccccttctgctctctcccacttccggcatggctgacagtccctcccatctacttctaagaggtcactaaaaatcgaccagggcttgccagcctagtggggttgcccaaatgtctgcccacagatgccgcttcgaaaagctgtctctggcatggcccctactgcagcggcgcgtgacagactgccttgcttggtggaaggaatcccaccccaattaaattgctggagccctgctgggaaggaggtggaggcgggaggagaaggagagtagggagccgggcaagccactcctgcctctcctttttcatctcggaagagccaatttcaagcttgcctcgggtcataaaagaaattaatttgattctctcaaccttgctcagagtggacacacgtcttcggctggagcatctgctgctgctggatccagagcgaggagaccatcccctcgaaacgattccatttctgttgcaaggcagggccaaaatcatctgcctggagctggagaagcagctgcctggaataccctgggctgtcatttttgctggtaagatcgaaaaacggttctcacagctaaggtgactcccaagttgcaggaggtttacccagagagatactcatgggtagggctggttcttggaaaactcccaaacagaatttagcagtggcagctgcctaacccacttcatattgatcagcttgatcacactgagtcctcttaactgtcaggcatggcccctgggctgtattcctgattgcacacagctaaggtgactcccttgtacaagcctccccgcctgagagaggatggaacttgtgacctgcttctaatcaacagaatatggcaaaggtgccgaatgtcactctcttgatcatatttcatcaaataagatttccccttaggagacttagggactcccttgctggctaggaggaagtaagctaccatgttgtgacagggccatgtcaaagaatgcaggtggcctctagaagctgatagaggtccccagctgacagccagcaagaaaacaaggcctcagccaggtgcagtggctcacacctatcatcccagcaatttgggaggctgaggcaggaggatcgattgagcacaggagttagagaccagcctgggcaacatacagaaacctcatctctaccaacaatttaaaaattagccgcgcgtgaaggcacctgcctgtggtcccagctacttggcaggctgagatgggatgatcccttgaatctaggagttaaaggctgcagtgagctacaacttaccactgcactccagctcgggtaacagaacaagaggctgtctcaaaataataataataataataataataataataataataataataataataattttatttaaaagaaaaagaaaacaagaacccagctttacaactacaaggtaagtcaccagcaactgccatgaggacccattgtctaaatcttttaatgtaaaataaaactacattagaaaccacacaaaccaaatgtgtagcttcttcagcctttccttatttttctaaggttgtacaaaactattgtatttacaaaaatggcacaaaagtgaattcagcagtcaattcacatgcatacttccctcacatcttcaacaacaaaaggtattctaactccaactctacagagcttggcagttttcaggagtactggggacggattttgcaggatatatctctgtattagtccattttcatgctgctgataaagacatacctgagactgggcaatttacaaaagaaagaggtttattggacttacagttccacgtggctgtggaggcctcacaaacatggtggaaggcaaggaggagcaagtcacatctgatgtggatggcagcaggcaaaaagagcttgtgcagggaaattcccatttttaaaaaccatcagatctcataagactaattcactatcacgagaacagcacgggaaaaacctgtccccatgattcaatcatctcccaccaggtccctcccacaacacgtgggaattatgggagccacaagatgagatttggaacacagagccaaaccgtattagcctccatttgagtttgtctgatttttttcttttttcatgattagactcaggtcatgagtttttgcaaagaataccacagaggtgaagtgcccttcttttccaagcttgtcactcatccatggtgtggttcaaactttcccttgtctgtgatgttcctgcaactagttctagacttttagactgcaataatctcattataaggtacagagctcattcaagaaggataaggggcatattgatttcctaaggatgattaacaaaacagcacaaacgaggtggcttgaaacaagagaaatttattctctcacaattcttgagggaagaagtccaaaatcaaggggttcacagagctgtaccccgagcctctggggaagatcccatcctttcctttcctggcttctggtaaccataggcattcctgggcttgtagcagcttcacttcaatctctaccttgtgctcacttcggcagcacgtacattaaaatggaacttcaatcgctatccccattgtcacaagggggtcttccctgtgggtctgtgtccaaatttcctacttcttctaaggacaatctcgtattagattaagggcccaccctactccagtatcacatcttcgtaattacatctgcaatgaccctgtttccaacagaggtcacattctggggtactgagatgttagggctttcaacatatctctttggagaacacagttcaacctattaaataaagcatcccacaaaaccaaagtcagaaagcacagcagggttttgggatagaaagatagcaggagtcaacacagcctgtctctgtctttctgggagctcccggtctgtccttcctaagtctgtattgtgtcctcaatctcttctttctttctctctctctctctctctcactctctctcccccatcttctcgctccccatctccctctctccctctctctctctccgcccccccatgtattactctgttttcacaatgctaataaagacatacccaagactgagtaatttataaagaaaaagagtggtcacggactcccagttccacatggctttggagatctcacaattgtggcagaagacgaatgaggagcaaagtcacgtcttacatggtggcaggcaagagagtgtgtgcaggggaactcccctttttaaagccatcagatctcgtgagacctattcactatcacaagaacagcatgggaaaaacccgccccacgattcaattacctcccaccatgtccctccgatgacatgtggaaattatgggagctacaatttgagatttaggtggggacacagccaaaccatatcaccctgcatatcagttttttctattgcaattgtccacaggccaaacatgactatattgtcaccaactttctatccccctctagtttcaagcaccttccagagataagctcagagattttcaactccaaatttctgggagagagtccacatggcctggctgtaatcccatatccaaccccttggtacacagccatggccagagccaaaagaatcctatggggttctggatctcctagggctctgggaagggcaagtttctgaaggaggaatgggggtggacaaaaattattggctgagaaaatagctggtgaacgagacattatttctggtagggaatgaatgcaagaggccactatgttctggagcacagagaaaactcccactggattctcaggaccgtctgagaggagaggaatttgaaagcagctgaattatcacaggagaaacagaatggagtcagaaaaattctgctttgtggcacttagatcaattctatgtctcatatctttgggagcatgggtggtttcccccaccctccattttcctcttctctctgaacaaaagttttagtttgtgaagtcaaatctcatctttttttttttttttttttttgagacagtctcactctgtcacccaggctggagtacaagtggtatgatctcggctcactgcaacttccgtctccaaggttcaagtgattctcctgcctcaacctccagagtactgggattacaggtgtgcaccaccacaccttgctaatttttatatttttagtaaagacagggtttcaccatgttggccaggctggtcttgaactcctggcctcaggtgatccacccaccttggcctcccaaagtgctgggattacaggaatgagccaccacacccagcccaaaccttgtcatttctgaaatagagtgtcagggtagtgtcttagttagcttgagctgctataacaaattataatagactgtgaagcttaaacaacagcaatttatttctcacagttctgggggctgggaagtctgagatcagggtgctggcatggtcagggtctggtgaggactctctcctggcttgcagatggctgccttctcactgtgtcctcatgtggtggagagacgggtatcatctctctcatatctcttcttacaagggcactaatcctattcatgagggctccaccctcatgatctcattactttccaaaggcctcacctcctgataccatcacactgggggttagacttcagcctatgaatctgagggcaacacaaccactgtctgttagttcacggcagacagtgaaatagtggaaaggagggtgtgattgattctggggagggctggtgttgaactctgactgcaggataaagccctcattggttctctgggccccggtaactgcccatctccccaagagggttcccacatccatttcctcccactctgggagtgagcccagcccagcatttcatcaacaactgatctcaggagccaaaagacacagggagagtatggtgatcagggagctgaggaagagggtgaaaaaaggcaaggggtgccaagcaactcaaccagcacttcccctccatcttctgctggatttgctcctttgtctccccagcaggtaggagggattgtccaagacaaagcattggttaccatctttctgtgccaaggctctgggagacaagactggattgcggtcttccttccttattgtacttattgtctaaccttaaggtacttccttatggtaccattttcacacgctgataaagacatacccccacaccccagactgagtaatttataaggaaaaataggtttaatggattcacagttccacatggctggggaagccttacaatcatagcggaagacaaaaggcacatcttacatggcagcaggcaagagagaatgagagccaagcagagggggaaaccccttataaaaccatcagctcttatcagacttatttactaccatgagaacagtatgggggaactgcccccatgattcaattatctcccactgggtccctcccatgacacatgggaattatgggagctagaattcaagatgagatttgggtggggacacagcaaaaccatatcacttattctgtaggaaatgacttccaaggcattctccacccctgtctacatctgacagatagaattatatttaactatatattagtatattactatgacaataataactcatttattcctcacaccaaccctgtgctatccccgtttaaagatgagaaaacagaggcacagaaggtttgagtattatgcccaagatcattcagctgataaatgccatatccatctaactccaaatcccttgtggttgtacagtcagctgagctggcttttggataaaattggttggaggtgaatagagagaatgggttgggggaaagtggtggatgcccccagcaggtgtctcagaaataatgtgttgtcattttcactgtgaatatctcaggctcaagaataaaattacttttctatataatgatttgcaatagtcatgattctttatgatgaaaatataacccaaatcaaacttgcctaagcaaaaaaatatatatataacataaaattcaccttcaagggatggggctggagttacccccggaagcaagaagaaaaattatgcagagcacctggtatatccatcagagaccaccaatgtgttcctgtcactccaacaggaagcagagaacccaaggctgtgttggcaagtagaagaccctagggacccagagggcccagagagcccagggattcccagtgcaaaccctcagatgccttggtgccttaaggaaaaacacactagcctcatgctgcctaacttcagcaagaaaaaaaaggaccattcccttaatacaagcctcaattgccctgatgccttatggctgttattttagagaattataatgccacctatgattaataccgcaatgtggtcacacagcaaacgctcataagtaacctcccagcataaataccaagaaaatccagacttaccacggcttcatatacattttagatttttgctaaattggcccttgataaagcgtgtggccaccttaatcacagaaatcagcttcctccccaggcctaaaattagaagccccaactgccagtcgttaggtacagagctcaatgcctgctgagattcccctctcatttatcttctgcggggagcatttcaagttatcgccagctctcgtatcagctggcccggggaagggcagcaggcagcgagaggggcagctaacataggaagaggtcagcaggtgaggggtggctctggaggcggtggaactggctggtccctggaaagcttcccgctgcaggtctagagtggagaactcggactccaacagggaagactgtggctgggaagaattacagaccagatccagggctggattctgaatttagatggggcccgtaacaatttgcctaaatgatttatttcaacaatcaacacatccatatgctcagccactcagaatgatgactgaaataaaaatgaaaggtaacaggctgggcatggtggctcacacctgtaatcccagcactttaggaggccgaggtgggaggattgcttgagcccaggaattcaagaccagccctggcaatatagtgagactgcatctctacaaaaaaaaaaaaaaaaaaaaaagagcaagagaaagagagaattggatgcatgctataacagcctatgatggtagatccagctggtctggggaaaaaggagagtatccaactaggcttccccaaggtcatgaatttttttttttttttgagacagtctcactctgtcacccaggatgaggtgcaatggtgcaattacagttcactgcagcctcgaccttccaggctcacatgattctcccacctcaacatcctaagtagctgggactacaggcatgcagcaccacatgcagctaattttttgatttttttttcttttggtagagatggggtctcacttcattgcccaggctggtctctaactcctgggctcaagcgaacctcccacctcagcctcccaaagtgctgggattacaggtgtcagccatcatgcctggccagatgatgacatttaagctaagactaggacaatgaggagttatccaggtgtcaagtgagaggaatgcatttatacagagatagtaacatgtgcaaaggccctggggtgagaaggagttccatgtgttgaaggaattggaatgttgggaggaatgaaaagggtgtggcaaaatatgtgggctggggagggaggcaggggctagctcaggcaggatgagataaactctggtaagggttgtatgtgctcacagaaactcattaacacttcactgaatgctaatatttatttatcaggtttcagagtctgtttgttcgtgaggggagggttttccatcttctccacttgaatataaactccttgaaggcaatgacctttggttcacagttctatcaccagcacctagaacaagaactagaacaaaggcaaataaagacacccttatcaggcacaatgttgcaaagacttagtggttatcttccaggagccagtgaagggccagacctttcttaggaatgtgcaggatttgaactccccagacctgctgagtcaactctactgcaggggaccatacagagatgagaaagatgcgacattctttcacttctgggtagcagagtcaacaaatggaaccagggtgcccccaacgcccgttacctatgacatcttcctctgaaataagctcaacagaagatggtccctggctacagtgacttttgtcagggatctccaagaccgccctcaggcccattgatttgccagaaggacccacagaatcaggaaagccattgtcctcatgaacattgtttattgcactaaaaggatacagattaaaatcaaccaaggtacaagatgcataggtctctccaagagagaccaggggtaagtttccagtagttttctcccagtggagttagaaggatagctcctaatgctctgtattagtctgttttcatgctgctgataaagacacacccgagactgggtaatttatgaaaaaaaaaagaggtttaatggactcgcagttccacgtgactagggaggcctcacaatcatggcagaagagcaagggagagcaaagggatgtcttacatggcggctggcaaagagagaatgagagccaagtgaaaggggttctccttataaaaccatcagatcttgtgagacttattcactgccatgaaaacagtatgggggaaaccactcctgtgattcaattacttcccactgggtccctctcacaacacgtaggaattgtgggggctacaattcaagatgagatttgggtggggacacagccaagctataagagacaattagcaatgtatacaaagtactgccagccacagcagctcccccaagccttggtgtccaggggttttatcagcatttcatcacccaggcatggagcacctgcatgggtgacttttgttactcagtctccagcccctctagaggtcaaactgacacatacaaaaacaggcactcaccataaattgcattgttagcatggactagctagctcagcctgaggccataggtaaacaaagacactcttatcaggcagaatgttccaaagacttggcggttatctcccaggagccagtcaagggccagagctttctttggaatgtgcaggatttgaactccccagaccggctgagtcaactccttactgcatggggaccatatagagatgagaaagatgccatattctttcacttctgggtagcagagtcaacaaatggaccaggctgaacgaagacagtcaggtagaaccagaaaccacctccacctgcacccctgcataggacctaaaaaaatgtcataggaccatgacaacttttttgagacagggtctcagtctgccacccaggatgaagagcagtggtgcaatcatagctcactgcagcctcaacctcccgggctaatgctatcctcccatctcagcctcccaagtagctgggggcatgtaccacatctggctaattttttgacttttttttttttttttggagagatggggtctcacttcgttgcccaggccggtctctaactcctgggctcatcaggagttagatgatcacccagatgaacaacagggacctcatccctccccaggggtcctggggtaggaccctcagcagatgagaggagtagctctcctggcccatacccatgccctgttgtggtgtttataagcctgtcataggtcaggtttctagagagacaagctgtgggatggagatctgggtgcagggggtttactgggaggagcacctgctggaaagcaaggaagcagcattgggcagagaggggagtggcactgtggaacagtcgccaggacccctgagacaccccctgtgatggttaatactgagtgtcaacttaattggattgaaggatacaaagtattgtttctggatgtgtctgtgagggtgttgccaaaaaagattaatatttgagtcagtggactaggaaaagcagacccaccctcaatctgggtgggcaccatctaatcagctgtcagcatagctagaatataagcaggcagagcagcatggaagggcttgactggctgagtcttccagccttcatctttctctcgtgctggatgcttcctgccctcgaacatcggactctgagttcttcagctttgggactcttggacctttgaccacagactgaaggctgcactgttagcgtccctacttttgaggctttgggaattggactggcttccttgctcctcagcttgcagatggcctattgtgagagctcacctggtaatcgtgtgagtcaatactccttaatcaactccccttttcatatacatctgtcctattagttctgtccccctagagaatgctgactaatacactcccatatggaggggcaagggacagagcctttgtaaccctccaggattatgggatgcctaggaggggaggaggatttcccagcactaggtggcttcctacaggtgccttcttgccagaggcaggactttgctatgagctgttagcagccaggtctcccagcagctggggggacagagggcctcggtggtcctgcacagaggtctgagtggtatagcaccgacagcgaagctagtgaccaaagtggaaagacagagatatgaaaatctttcaactaattaagatttaaaactcagattgatgtgagaatcctgaattgactgtttaccaaagagactaggttttaaatgagaagggtctgggtttacattgacttggcaagactgagtgtcctatcactggagtgacaagggaggctggtggggatggatccagggaaaagaagcaaagtatggaacaaagaagtttagaataaagaaagtggccaaggctgggcgccacagttcacacctgtaatcccagggtggccaaggcaggaagattgcttgagcccagaagttcaaggctgcagtgagctatgatcatgccactgcactccagcctgggtagcaaagcaagaaaaaaaaaaaaagcaagaaaggaagggagggatggaggaaggaaggaagggagggagggaaagagagagagaaagaggaaagaaagaaaaagaaagaagaagaaagaaagaagaaagagaaagagagaaagaaagaaagaaagaaagaaaggaaggaaggaaggaaggaaggaaggaaggaaggaaggaagaaagaaagaaagaaagaaagaaagaaagaaagaaagaaagaaagaaagaaagaaagagacagacagaaagaaagaaagaaagaaagaaagaaagaaagaaagaaagaaagaaagaggcatcaaacctcacaggttgaggtaactgtaaatacacggtagtttatccctgagcacaaaatctcaatggcacagtcaaagccccaaagaagtaagaaacaaacatcatttccaccttttgggcctgaagaagcaggtacattagagaagggcagccacaatatctgtgaacagtcattaagctctcagacacagcatcccaccttcaccaatctgatctccttgatgggggtgatgctccctccaagataacaaagaaaacctggccaggcacggtggcccgcgtctgtaatcccagcattttggaaggctgaggcaggaggattgctagagcccaggagttcaagaccagcctgggcaacatagtgagacccccgtctcttaataaaataagaaaaaagaaaagaaaaccttccttttacatgaaggcatcataccttaaatgcacatcctatctgcccaggaggcccacctctagatttgtatcctactgatgaacacacaccaagatggacatactagcataaattgtggagaatgacagaaaatatcctgaatgtccaccatgagggaactgattaatttatacacatccatatactggaatactacacagctgataaaaagaataaggaatgtctatatggactgctatgcaaaaacctcaaagatatattgttgaatgaagtcaagatgcagtgtaatatgtacaatgggctatcatttataaaaccgggaggagacatatatacatatgtttttctatataaagattgtatctctggaaagtttcaagagaagccagcaacacttgtgaccttggagaagaagaactggtggttgggatggaaaacaaacttaattttcactgtatactttttctggtactgtttaattttttttttttaccatatgcacacgtttcctattcaaaagagaatttttttgaataggaaacaatgaaaaatcttgtaggcatacaaactaaattaattagccatccctatagcttcaacatgcatttcaatttgcaagcaccctggcctccaagattgattgattggctgtaaattgagaacctcagcaatttcctttcacagggacagatgttgacattgttcctgtgatttttcacagatgtttgccttccagcatctttaaaatcgagttttctgtcaatttggaaatcccaaatttctcatatcaaatcgagatgtcaggaaaatcaaaaccgttatcacattttgaaagagtttatggatggcaaatgacactgggaagggagatgtttaaggagcagctgacgtctcttaaccctttctcatcacttcctgcctcagtttacctaagccagaaaaaggggaaatttgattcaatatacagacaagggctttagagtctgcgtagctgtgcgatctcactttggctccaactctctagctgtgatactttgaaccagttcattaacttgcccagcctcctctctctcatctgtaaaatggggataatatccccagccttgcagtgtgattttacaattcactgatgcaaaaatggaaaatgcgtggcacttagcaccacctaaatgtttttttccttttttttttcccctttccctcctccttcaccaatcctccaagcagcttttcttccttcttcacgtccccattttgctcacgagattccaagatttacccactgaagctctcatgagattcccagatttacccattgttgagaaatcagaaacatcccccaccccctagaattctcctgacctgtgtcccctccccttaggactctgctctccctcagtggcaacaggcaggaatatgatctactcatacaaaccaaacctctgctgtttgtacatcttagctaataatgcccaacacgcagccaacatttactaagtcaggctcttgagagccacttcatctgcatgacgccacaaaatcctctcagttattatttctgttttagagatatggaaatgagcaccagaggtagatgtaacttgacaaatatctgggtggtagatctggaaatcaaagaaccctgaaccccaaccacagacacatgttcagttcaggctgggtctctacgctttgttatttttaacggggcattacgctccctggatggctatgacgctgcggttaactctgctcttgtggatgaatgcaattatctggggagctcgcacttataagatgtacagctatgggcaacctaaggcacatcgtggagtcttaatttcctcatctgtcaaatgagaatagcaaggatggcagggagggattaaggagcatttttggaaaaggaagtgctatgaaatgaacgtttgtgcctccacccccaaactgatatgtcgaagctgacaccctaattaccagtgttacggtatttgggtatttgaagatgcggctttggtgattatgtttagatgagatcataagcctaaggtcctggagatgcgatgtgtccatattagaagagacaccagagatatctttctctgtctctcactcttgcttgatctctccctctctctctcgcactctctctcatgctggcgtgctctctctctcccctgtgaggatacaacaagaaggcttccaactgaaagccacaaagagggccctcactggagaaacaaatcacccagcaccttgatcttcgaattcccagcccccagaatagtgaacaataaatgtctcctgtttaagccacgtagtatgtggtattttgtatggcagcctgagcagactgccacagtagatggttggtccttcctccaaccaataatagatggcttgtcctttccatcgcccaccttgggcaaggcaaacaggacagtgaaggcaagcacatctcacagaccccagcattcatgtgctaatgaggctcactactagtattggaaagatgggaagtcaaacagaattatgtccttgcgaacatacaataacttggaaaattttattgaaagacattaagtttgcatacacacaaaaatgagtgaagagttttttgttccattgaataatttagaggacatgtaagagaacacaagtttgaaatcttattatattttgtataatgatacataataatttccatgataaagctgatgtgtattgaggagatcatatgtgccaagcactcactgtgtgttaagcatattctattcattgtatcatttaatcctcaaaatatgatcaccgcctgtattgattggggttttccagagaaacagaaccaatgtctaaacagagagagatttcacgcaattatggaggctaacaagtgctgtcatctgcagggcgaggcagcaaactggagaccccagagaactgatggtgttagttccagtcctaaggccagcaggctcgaaacccggaaagagcagtgtttcagtctgagtacaaaggcagaaaaaagccaatggtgcagtttaaaaaccttcaggcaggaggaattctctcttacttcggaaaggaccgacttttgctctattcaggtcttccgtggattggatgaagtccacccacattaggaggggcaactgctttcctcaatctgccaatttaaatgacaatcatcccaaaacgccctcacgaacacacccaaaatgatgtttaggcaaatagctgtgcacctgtatccctaagagttaacacataaaacctaccaacccatcactctttccaaatagaaaaagtgaggctcagagaggttaagtcacttccccaaagtcacagagcttcttataagtggtggagggtttgactgaggacccatgctctattgtaatcatagaaaatcctagtggaattttccaatagaataaaatgcctgcccagctgcagccaaacgttccatagacaatgtctctgggccttttgtggcagaaaaaccaacataaggaaaagaaggccggagacgccagttttatcaaactcccataaggtaaagggaaatatctttctggggaaaggagactaaaggagaaaattaacagccacttttcagggagagagaaagagcagggacccagcccctctgagactgtgggctgggtgtggcctgagctgattggcagctccattgtaactatactgtaaaggaatgactctaccgaaactgagctaaaggagagtttgaagcatttttaaaaactctgcccaggccaggcgtggtggctcatgcctgtaatctcagcactttgggaagctgaggcaggcagatcatttgagatcaggagttcaagaccagcctggacaacatggtgaaacctcatctctactaaaaatacaaaaattagctgaacatggtggtggacacctgtaatcccagctacttgggaggctgaggcaggagaatcacttgaacccaagaggcagaggttgcggtgaaccaagactgcgccactgcactccagcctgggtgacagagcgagactctgtccaaaaaaaaaaaaaaaaaattctcagacaaccagcagtgatacaagagataaaaggcatctggctttacgctgcaaacaaaacggaaacaggaagtgagagagcagttggcctctaagaagcatccatttattttaccctgccaggtgcctacaaggtgatggttttgcctcccaaatataatcaggggcccaatctctgcattcaaagaagtatatttcagcaacccataagtaatccaaaagcagttccccacacatcagctcaaacagtgttacagggcaggcattcttggtgccatcagatccaatgtcccatgttttaaccaacaattgaaaagccctcttttttttttgagacagggtctcactctatagtccaggctggagggcagtggtgggatcttggctcattgcaacctccacctcctgagttcaagcgattctcgtgcctcagcctcccgagtagctgggattacagatgcgtgccaccatgcccggtacattgttttttttgtatttttggtagagacagggtttcaccatgttggccaggctggtctcgaactcctgacctcaaatgatccaccagcctcagcctcccaaagtgctgggattataggcgtgagccaccatgcccagctgaaaagctctcttttctaccctgaaaaaaaaaaaatgtgctgatcctataacccatctactcttctaaccaatcacaattgtgccctaattataataaaaaggagaaatgaaatgatgaggatttctaatgaaataatatatagagaaatgatttgggtttccaccaggaaagacggagcgaagcagtcaagtgctcacacacgtgtgtgtagaataaccagtgacagtcacaaacgcagacagcgtggtgtgttgtcgcatcggctttactgagagtgccatgttcttcaaaagagtggctctttcttgataaattcccataccaaacagagtcaaatcttctcttgatttacaccatagctgctacattcttggaaacatcagtgttcattcaacacttacatgtaaaatagaacatgtaaacatataaaatagaataggcagataaaatagaagaaggttggaccgggcgtggtggctcacacctgtaatcctagcactttgggaggccgaggtgggccgatcacaagatcaagagagcaagaccatcctggccaacagggtgaaactccgtctctactaaaaatacaaaaattagctggacgtggtagtacccgcctgtagtcccacctactcgggaggctgaggcaggagaatcgctggaaccggggaggcagaggttgcagtgagccgagatggcaccactgcactccagcctgggtgacagagtgagactctgtttcaaaaaaaaaaaaaaaaaatagaacaaggttatagactctgataatcatggttcttctaacccatatgaatttgggatctacacatatatatattcaaaaaactaccccacaccgtaatgactcccccatccctatcattagggcaaccaaaagctctctgcagatttaaaacacacacacacacacacacaaacacacacacacacaaacacacacacacaaacacacacacacacacaaacacacagacacacacacaaacacacacacacacaaacacacacacacacacaaacacacacacacgggacaattcagtccccagtgagaacctctgtaataaaaggtccaattcctaacctgcaataatattctttttttttttttttgagacagagtctcgctgtcgcccgggctggagtgcagtggtgcgacctcagctcactgcaagctccgcctcccaggttcacgccattctcctgcctcagcctcccgagtagctgggactacaggcatccgccaccatggccggctacttttttgtatttttagtagagacggggtttcactgtgttagccaggatggtctccatctactgacctcgtgatctgcccgcctcagcctccaaagtgctgggattacaggcgtgagccaccacgactggcccacaataatattcttaaagtcccctttcccgcctcctcagttctcccacaattcccagtttccccagaacaaaccccaagagatttctctgcccttccccccacccccaggcagagatgtcttccaactcttccccagcactgtaactctccactctggtcaagtggactccaccttggggaaagaatgtttgtaccgggcaccaaactagactttggagatacactagttcttagtatctgctagtatctgctactgtgataattaaggtaattatttagaccaggaatctgcaaaatacagcctgaaggccaaatccgagctgcctgttttcctatggcctgaaagctaagaaagaatggttcttacattttatattattattattattattattattattattattattattattattattattttgagatggagtctcgctctgtcgcccaggctggagtgcagtggcaccatctcagctcactgcaacatctgcctgccaggctcaagcgattctactgcctcagcctcctgagtagttggaattacaggcacctgccaccacacccggctaatttttgtatttttagtagagacagggctttaccatgttgtccaggctggtctcgaactcctgacctcaggtcatccgcccacctcggcctcccaaagtactgggattacaggcatgagccactgcgcccagctagttcttacattttaaatagttagtgggaaaaagacaaaaggaataatacgtcattacatgacaattatatgaaattccaatttcagagtttataaataaagtattgtctgtggctgcttttgcactacaatggcagggttgcatggttgcaagagagcacatggcccccaaagcctcagataatccactatctgggcctttacagtaaggttgtcagcccctggcttaggcactaaacaggtgctttcaagcacctactatatgccagacactaaagtaatagagaggggagacaatcaacaagaagcattctttctcaaaagttttaggctgggcacagtggctaaagcctataatcccagtactttgggaggtcgcggcaggagggtcaattgaatgcaggagtccaagaccagcctaggcaacatagtaagaccccgtctcctcaaaaaatgcaaaaaaaaaaaaaaaaattagttgagcatggcagtgtgtgcctgtagtcccaggtagttgggaggctgaggtgggaggatcacttgagcccaggaggtcaaggctgcagtgagccaagccatgatggtgcaatggcactgcagcctgggagacagagtgagaccctgtctcaaataaataaataagtaaattaattaattaattaattaaattaaaagcatgttattcagaatcacatagacttgggctcagctcttcagccataagcatgtttcttttctctttttctttttttttttttttttgttgagacagagccttgctctgtcacccaggttggagtgcagtggcacgatcttggctgactgcaacctccacctcatgaggtcaagcgattctcctacctcagcttcctgagtagctgggattacaggcacgtgccacgatgatcggctaatatttgtttttctttctttttttttttttttttgagacggagtttcgctctttttgcccaggctggagtgcaatggtgcaatctcagctcactgcaacctcctgccttccgggttcaagcgattctcctgtctcagcttcccgagtaactgggattacaggcgcatgccaccacacctggcctaatgtttgtatttttagtagagacagggtttcaccatgttggccaggctggtctcgaatgctgaacctcatgatccgcccacctcagcctcccaaagtgctgggattacaagcgtgagccaccgcgcccggcccatgagcatgtttcttgacctcagtttccccttctgtaaagcatggtgtggattgttcacctcgcatgggcatgtgaatatcaaatgagacatcctgtgcaatgtgcctcagacaaagaaaggagatcagcaaataatatttcctttctagttcatcctctcttcccatgtatgccaagaaagcaggcgagattgagtgagggaggtcatatcctctttgtctaaatgttttcttgttagagaacatctttcttcttaacatcccttcctacataaagaatctctgtcagaggaatattaaaaggccctaacctacagttagatggaaggcgagactccgatctcacagctgaatcactttagtctacctctctacccatctaatgttacccccttcaaaaataataataataatatgaaagttgggaagtggaaaaccatcctctggagttttcaaaaactaattccgttgtaatcatagaagactgaaggcaggattcatgtcacatttctcttcctcctgggcagatgaatctacaatttgtatttgattttaaatgtgattctcctgcatcttcagtgggtttgattgatagagcacatggggccactcagtaaaatgatacagtggagatcaaagccggagagataatttttgccaaaatgtctgcagccgacagtgagttataagcctttgtctcccactttacggaacacaattttatttaaagccgaaatctgtcactttggtattgtttattgaaatgcatcccataccacggtcccgtgaagaacaacgtcaagtcaaaaggtaaaaaaatccaatggttacaaacagcccaggaccaaataaaggagggagaatgcttccaatctgcataaatattacccaccagtgatgcatttggggcaagcaatgaagtcattcatctgcaaagtaaatatctggcattgtcagaggtgcctgacacagccccataaacccagtgagttctgttccattcagcagctcacacatctctatttgataactttgctttatttatgggtccacaatgggagtcataactgggtttttatctttgcacaacttttttactttattttttgagacagggtctcactctgtcacccaggctggaagtgcagtggtgtgatcacagctcactgcagcctcgacctcctgtgcccaagcaatcctcccacctcagcctcccaagtagatgggattacagaaatgcacttccacaccttgctaatttatattagtttttgtagagacgggctctccctaggttgctcaggctggtcttgaactcctgggctcaagtgatcctcccacctaggccttccaagtagctgggactacagatgcacaccaccatacccagctaatttttaaattttttatagaaaaggagtctcactatgttgcccaggctagtctcaaactcctggcctcaagacattctcccaccttggcctcccaaattgctgagattacaggtgtgagccactgtgcccagcttgcacagcttttttaaaccttttttttttttttgcattcattcacgcttttcatacatcatgattgaggatctaccctgcagactgtatggagttatctagaaggcaggaaggcagagaactaaaacctttggttaaaatatctggggttgagctcagtgtttcctgctctccagctatgtgaccttgatcgggtctcttcacctgtctgaacctcagtttccccactgcaaagtggagagcaaatgagaccatggacttggaaatgcttcatacatttctgagtgcctcacagatatgaagcccaaagatagcaccattctaggctctgtcaggacaatgaggccaaagttgtcactgatgccataaagttgtctctacagcgaaaggtccctggaattagcaggaggcttttgtggagcaaatgcctccttttctgcgtagaaagtgagatgcctcaatcactctgcctagatgcctctagatgcctcaattcctctgccaccaacagactctgtgacattgggtcacttttgagattcctgggtcctgcctacttcaccagaatgtcatgttctggaaccttctcagtctccaacctcatcactcacaagcttttcttatgctttgatagatgctacgattgcttgtcaaaaaaagagcctctcttctccgttgctaagagaaccccaatttttaaagtattgaacagtcacatgctttaggagaagttgcccttctgagcctcaaggagtgaatcttgactgacctaaactaatcatagtaatactgaccccctgtctagtgattgctttcgaataggcacgtgacccattgtgaccaatgagagttgatggaaatttcctccttgctgtcaacaatggacacaaggaagacacattttctcctctgacctttggacattgaacgttattgtgttaggatgtgatgtaaggcactgtggcacccattttgtgctcattagaggaaaagactggaattaagcccttgctctgtaagtcagagcacaaagatggcaagagcccaggtctttgatgatacaactgaactactgaataaaccaaccctagactcacctacccccaaattccttttaatgtgagagaataatgtcccatcttgtttaagcaatttcaggtttccattacttactaatgaatatatttggattccaagttgttatttccttgcatggaatgcttctgacacaactcacccttgctagcctcaagggtggtggccgaactggggagggtccaagaggaattgcaaaaaacagagctgcaaggagcagccttatctctgaccgctgtggtgagccctccactttgtataccctcccccaaccgtgtgactctggatcagccaatcaggtgatctctcttggcaccttgactcatgatgcaagaacacaggccctattgggtttccatgaattctctgcagggagagcaggggtccccagatcagcctatccctaacgcatgcccttggaggagttgccgctataaagctatctggagtcaccttgtatggggtgttttccaaggctgggccttcagcagtgccttcggcatgttctctttctttggtaagagtcagtttctggggtgaacaactgagaactcagggacatagacaagaaatcatgtctcattcttaaaagcctcagcacaagtcctggcatagagtaagtgttgaagggaggttggatgaatgaataaaggagtgagaaagttaattgcttcccttctctgggctgctgtatcaatcaaggttgtggcaggaaatacatagtaaactcaaatggggtaactaaaaagagtttagcaaagggctatatatagctgtataagtgggattaaaaaaaacaaaaacaaaaagggaggttgcagtagccctaactagcagcagtgaggagccatttctacccctagacctggaggggaaatagttatggaacccaaggagagtagccacagtcttcagggaaagacagctgcctggcaggagcttccaacctatggcaacccaacaggaaggagccacagaaataaatatccgaatccctctctcctcccaccttctagtattctatgatccccaccccattggccaaacccaagcagccacaagaggatgggagaccacatgtgatgtagtccatagaagtcagcctcctggggtacaaagcaggaaatgggggtggacagtggatgtaaaggagcaaatacaaaatatccggcacagatattgctatggtttgcatgtgttccccaaagttcaagtgctggaaacttaatccctgatgcaaccgtgttgagaggtgaggccttcaagaggtgtttggatcatggggacatcatctttctgaatggattaatgcctttatcatgggagcgggctggttttcacaggagcaggtgctctctctcaccctctctctcacccatgtgatgccttgggtcacaccatgatgcagcaagaaggccttcaccagatgtaagctctcaacctcggacttcccagcctccagaactgtgagccaagtaaatttctattcattgtaaattacctggtctgtggtattctgttatagcagcacaaaatggactaagacagatagtatctagtgataggatagactacaagaatctctttcacccagatcctgcagccacaaaagggccaacgctctttggagagtttatctctcacccaagcagccaccagcatcatcagcaaacagcaatgttcctctacacgcttgtgtgtttccttcattggtacaagtttccaccattgttttgcttataagagaaaccattctccaaagcccagagtaattatagagcccagaagtcttggggctttctgaatttgaagcagattcagggctcaagagagccaagaagtcatatcaatgccaggaatctggaccccaggcagacagcgtggataacctaccccaacagaggtgcaggctctcttcctttcacccaaaaaatagcaaacacatttattgatcaccgtgggccctttccttccacctggaggttagcaggaactttcaaaggtttagtgtcatccatatcccattgtcttcttcatgcacagaaaagagaaacttcttcatctctggaaaggagacatggactcacactccccttattctgaatttttgcccactaagccatttcacaggaagttagccatggtttgtggatttttaaatgcttctgggaggagaaggatttactagtgataagaaataaaaatgcaaatgttttactgatgacatatgcatgtaaagtgcttgatataatgcctgacatggaaaaaacactcaataaacgttagtcatcagtatttatatcatcattccttttaatacacgccatcgactgggtgcagtggctcatgcctgttatcccagcactttgggaagcagaggcgagaggatcacttgagcccaggagtttgagacgagcctgggcaacataagaagaccccatctctataaaagaatctttaaaaattacctaggtatggtggcatgtgcatacagtcccagctactcaggaggctggggtgggaggatcaattgagcccaggaggtcaaaatgaggctgcagtgaaccatgatagtacaaaaaaatagttagaaagaatgaataaggccgggtgcggtggcttactcctgtaatcccaacactttgggaggccaaggtgggtggatcatgaggtcaggacttcgagaccagcctggtcaatatggtgaaaccccatctctactaaaaaatacaaaagttagccgggcgtggtgacaggcgcctgtagtcccagctacccaggaggctgaggcaggagaattcctggaacctgggaggcagaggttgcagtgagccaagatcgcaccactgctctccagcctgggcgacagagcaagactccatctcaaaaaaaaaaaaaaaaagaatgaataagacctactatttgctagcacaatggggtgactataatcaaaaacaatttaatcgtacattttagaataactaaaacagaataattagattgtaacacaaaggaaaacgcttgagatgatggataccccatttggcctgatgtgataattacacattgcatgcctacaatatctcacgtaacccataaatatatacacctacgatgtagtcacaaaaactaaaactaaatataaaacaacaagcatttatcatctaattgtctggatttggaacccacaagccaactcagctaagtgctctggcttagggtctcccatgaggctgcaggtaagatgtcagccaggactgcagtcatctgagcgtttctggggctgaagactaggcttccaggctcactgtgtggttgtctctatcccttactggctcttagacagaaacctcaattcctcaccacgtgggcctctccgtaaagtgccttagtgtcctcaaaacatggcagctggcttcctccaaagcgactgatccaagaaagagagagaaagagccaacaatggaagctgcagtctttcatgacgtaatcgcggaagtgacataacatcacttctgcggcattggtcacacacgagccccaacatggatctttccagcgtgggaggggactaaacaaggtgtgaatggcagcaggcagggattgttgcgggccatcttgaaaactggttccctcagaggagagctggaaggctggggacaaggacacaagagaggcttttttatttttttatttttttgagaccgagtctcgctctcgctgcccaggctgaagtgcaatggcgcgatctcagctcactgcaacctccgcctcccgggttccgggaattctcctgcctcagcctcagcagagttccccaagggtgcctgttggcctagtttgagactcttggctctgttagtgggagtctcaaactatgctccaggctgctgattgttctgagggatttctctctctttctttctaacactaagaaataggaacttggcctcccagagtgctgggattacaggcgtgagccaccacgcctggcctgtctgtaatctttaaaagtaatagcatattagctctgagggtcggttggattttttttttttaaacagttggcagtcatttgtagccaagtcaggtgaaaagggtaggtgatcaagctcattacaatttttattgaaataaaatttatctttagtaacgagattgattttttgtgtgtgactccggagggcagtttgcccagagcagtggttttcagactcttaacaaactatccctgagaggaaaagagaatgaattcatactctgtggagtgtagcccaaaataacctctgcaagggtgaaattttctttgaagtcttattttaccttaggtatttgtgaactctgcgttctattttgtgccacatgtgttttaagttactattactctgctaaagtttattcatcctccaggaagatgatgatgtttgtactgtagttttttatgtcccagggatacagcagggttccccaagggtacctgttggcctagtttgagactcttggctctgttagtgggagtctcaaactatgctccaggctgctgattgttctgagggatttctctttctttctaacactaagaaataggaaatacagttttcagtttaaaaataacataattaaaaagtgtagaaaagtctctcttggccgggcacggtggctcacgcctgtaatcccagcactttggaaggccgaggcgggcggatcacgaggtcaggagttcgagaccagcctcaccaacatggcaaaatcccatctctactaaaaatacaaaaattagctgggtgtggaggcaggcagctgtaatcccagctactcgggaggctgaggcaggagaatcgcttgaacccaggaggtggaggttgcagtgagctgagaatgcactactgcactccagcctgggtgacagagtgagactgtctcaaaaaaaaaaaaaaaaattacaggcaaaagaggttgcccatgttctcatcattggcagcagcagcatcaaaatatggcacccactccagtgatgcctttccagaaggagcaacactcatgtgaaaccaccagctttgctttgttttggttgttgctgttgttgttttttcagagagagtctcactctgttgctcaggctggagtgcagtggtgggatcatagctcactgcagccttgaactcctgggctcaagcgatcctcctgcttcagcctccccagtagctgtggctacaggtgcacaccagcacgccttgctaattcaaaaaaaaaaaaaaaagaaaaagaaaagaattgtagagatggggtctcgctatattacccaggctggtctcaaacttctgacctcaagtgatcctcctgccttggcctcccaaagtggcaggattacaggcataatccagccattgtccctggcctggcttttttttttttttttttttttaatgtagctcacgaccacaaacggagtttggtttccttgctctctctttttcccatttggtacttttctttctctcccatgcactcctcttcaaaccaaaagtgaatcttgttatttcttgaaaaatgtgtagatgttgaagggatgaaaaacctgaactctaacgtctgactatctgaacccaaattctagccgccccactcagttgctgtgtgactgtgagtaagttcttaccctctctgagcctgtttcttcacttggaaaataaaagtatacatatatatagctgttagccagaactcagcctagggtaacctttcaataaatattagcatcatcaaggaaatcacttgacaaattaattttcattaagcaatgagggtctataacagtgatgacttctgaccaaccagcccaatggctgacaaaggactgataacactttacatttttataatttccctagatttcaaattctccataaggagcaagtacagtttttataatcagacatagaactcgcgttcactctgctcatcctgaccctagccactggccaccaatttctgggttggctgctccaacctgagagcacagctactggaatcagaggcagaggagctcctcttgcgtttcgttgctggtttcccttggttttgtaaaaataaataaataataaaatagggatacacccttcagacaacaggtaacttcctaagctaagatgaacaggaggaaatttaaatgtctttctccggttcaaatcccctaccctctcccatctgcctaccctgggctccaacactcgggagaaagaccataagtcgttcagatgatgctttggagctggacaatcaatcgtgatcaaaaacaggggcatgggagcccggctaacgtggaaggatgggagaaaatcaggctgaattagagaagggtacattgtggagtgtgttttacaacgccattagttctaagcacataaggatttcaaatcaaggagcatccacacacacacaaactcttggattacttaagagataaggcggatccaaaattagcatatagatcagaggcatgcagttgagtgctgctaaagtgggctataaatgcttgggggaaaataaactagttgtttttctgaagaaagctttacaacgttccaaaatcttgtccaggaagtgtgaactctaagtccaatggactgaactgtgtcccctcaaaattgatatgttgaagccttaacttccattatgatggtattaggaggtgggcttttttggaagactattagtttagatgagatcatgaggatgaggtcttcgtgatggaattagcatccttacaagaaaagacaccagacggcttgctctcttgctctgtctctcctcttccctccctccctctctctctccctctctacctccgctccccccaccccccacttcctccgtcatgtgagaatgcagagagaaagcagctttctgcaagccaggaggagggtccgctgggagctacatcagccagattgtggcacttctcagcctccaaaactgtgagaaatagatttctgttgcttaagccatccagtttatactattttgttattgcagcctgatatggttcggatttgtgtccccgcccaaatctcgtgttgaatcgtaatccccagtgttggaggaggggcctgggggaaggggattggatcacggggacagacttcccccttgctgttctcatgacagtgagtgagttctcacaagatctggttgtttaaaagtgtgtagcactttcccctttgctctcttcctcctactccagccatgtaggacatgccagcttccctttcaccttctgccatgattgtaagtttcctgaggcttccccagctatgcttcctgtacagcctgcaaaactgtgagccaattaaacctcttttctttataaattacccagtctcaggtatttctttataacaatgcaagaagagactaatacacagcccaaactaactaagacaaacccactctgacccattctgacacccaaactaactaagtcctggtttgaacccttcgctattgtgtcaccttggggcaagtcacccaacttctccaaatgtttgtttcccaccaggaagatggaaatgacagtacctctccttcctaccccgcaagcctatcaggaggatcgaaagggacatggcaagcaaatactttctaaactgtaaagtgctgtgcaaacgcaagacagcattactctctttttatggagttatttatactctacctggttacagcagaggatttatggtagatgtcagtaaggctctttattttgaattttaagagagaaataagaatctttgttatctgtagagaaacaaatataatttccatggggcactaatataatataatataatataatataatataatataatataatataatataatataaatataccttaccgaataaaccctttgctcagacgtagtgaaaaggtaaattccccttcaacctaatgaagtttcagtcgctcacattttctgaatttgccgaacagaaatgcgatcaggtgcatactaagtgcagtacccagcatgatgtctagcattgaaacatacagtgtatacaccagcacctccaccaaacccatatccagcatgcaaaacatacccttttcaagtcggaagcacatagatagattttttggagttcaaaaggtcttaatgcaaactggctccaattcctttttttttttttttttaaatctttgaaacattggttaagtcttctcagagctatcattttgcacacatggaaactttagaccatccatccttcaagtgtcttggggtaattagagatactgaaggttaaggacctagcatactactaatagattttcaacaaatggtagctactgttatttctcatcattgcagatttaagagtgccaattctcagagcacttcagataaaaaccctacctttcttaaggcaaaaaacaacggcattaacttttttttttaattaacctaagttcccattatgtttagagaagagatcacaatgataaatgcttgccctgtctctcttttttaaaaatttactgttcttacatgtgacatatactgtggtacttagtgtcaccctacaaagaataaatttaaattgaagaaacagaaacacgggagagtccttgtttgggtttaatttgtatctgactacaataaaattctatcctggaagctagagtcataaaactaaaagtcaggaaggaaaagaatggctaattaagctccgaaactaaaagctctttccttattgctatttctttaagtcctaacaattggtcaggcacaggggcttagctgcgccattctagttaatggtcggttacaaatttccaccataaactcatcttccttctagcaacttaaatctcaggcactgggatgtaataaggagagaaagctcttaggcccagggcaatctctctcaatcccaatctccctttcccccatccctatcccaccacaataactgttagtaagagcttttggttgcatgcccagaaatctaactctggctaaattaatcaagaaacgaatatactggtttatccagctgaggtcatttacggaaagggagtgctaaggtttgaatgtgtctcctccaaaattcatgttgaaacttaatcctcattgcagtggtattaagaggtgaggccttttaggaagtgattcagtcaggagggcttggcccttaaggaatgaattcatgccttataaaggggtagagggaactaacttaggcccttttgcccttccaccttccacatatgaggatacagcattcatgccctccagaggacacaaggcaccaccttagaagcaaggaacagagccccttaccagacacaaaatgtgcctgtgccttgaccctggactcctcagcctccagaacggtgagaaataagtttctgtcctttataagttatctagtcttgggtattttgttacagcagcaaaaacagactaagacaggaagagaaaagaaccagagccccagggactagaaacaggactcactgcctcaaagtacatgtatactctctctctctctcgctctctctctctctctctctctctctctctctctctctccatttctcttcactgtttgtctttgctcagccttattctccatctctctccatgtgggagggcaagtagaggctggcacctccagatatatatcctctctgttcaagaaccacaataagttaatccccagggaagattctgatgcctgtgccactccaaggtccaacactgctgggtggatagatcctgatgtttgaccagatatgtgccacttaccaaccatagcagacactggcaatggccacccatgtcccttggaccctccccatcccatacaagctgaaggcatccctctgcaagcacctgcaactccccacctgaaggccttttctcggcctcggcaagacaggccagaagttcaaggatgtcaaagtccctgagagaatcccttggtcaatgtcagatgagtgatgaaagataaatatctcagttttctcaacactcaggtgggacaatttgaggtgtgttccatgccatcaaccaaagcccatcaaaaggaccaagccctggctccccatagaagtaacttactcattaccttgctttattctggtttagatttccttgtctcattttgccctgtgatggttaattttatgtgtcaacctgactgggacgctgagtgcccagataattggtaaaacattattctgggtgttcccgtgaaggtgttttcagacgagattaacatttaaatgggtagacggaggaaagcaggttgcactccagatgtgcatggtcctcatccaatcagttgaaggtctaaatagaacaaaaggccaacccttgcctgagtcagagagatctcctcctgcctgagggccttcaaactgaaacgtcaaaattttcctgcctttagactcaaactgaaacacagctctttctggatctcaagcctgctggttttcagactggaactacaccactgggtctcctgggtctccagcttactgactcatcctgcagatcttaggacttgtcagcctccataattgcatacacacacacacacacatatatataaaagtgcatatagatacatatatgtatgtgaatgtatgtatataaaagtgcatatagatacatatatgtatgtgtatatatatatacacacacatacacacacatatatgtgtgtgtacatatacatgtgtgtatatatacacacatgtatatgtgtgtatatatacacacatgtatatgtgtgtatacacacacacacacacacacacacacacacacacacacatatatatatatatatatatatgaagaccatagagaagtctctaagccaaagctggggacaggggaatcctgtgtctcctggggagaggtctgctttagtgtccctgccatgctcagtcattacccaggagcacctcatggaaggaagcatatggattccccatatgcttatatatgtgtgtgtgtgtgtgtgtgtgtgtgtatatgtatatgcatatgtgtgtgtgtatgtgtgtgtgctattctattggttctacttctctaaagaaacctgactaatacactcccattctcctactggtgcttcccagagtcaccctacaaataaaccattacatggaaatcctcatcacaggatctgcctctgggaaaacccagcctaagacatccatgactttcataggagaagaaagagctctagaattggcagccttactgaaccatgtggaagaggaaaggagaccacctaaacaaaagggtattaaccaattaaaataacctaaacccacacttgtccaaattgctgagcaagtgggatggaatggaacaactttcaaccagtgtccaaatattgctgtgactcctagactggcttgacacaaaggcagtgtccaccagctctaaacatccatctcaactaagatttctccaggaaggctagaactgacaccctctgcttaggttctcagtgacttcacccagccagcaaaggagctcttaggaaggcagacaagccctgaagtctgtctgctcagactccagctacctgctctattcctgctttatcaacctctagcttagtcgctcaatctccagctttgctccttcccattagattctatggctgaacctgactgccatagtttgtttctcagatgaatttaaggcaagggttgcaaactttaatgcacacatgggcagacaagtaacacaaatgagtgaagagtacagattagggcaactgggtctggtggagactgtggcaaactagagagcacacaccctatctaaggaggcagcgaggacttaattttgcaagatttgtggaatggactcccaatgttgccaaactgccactattttttaaagagaagcaggaaatccaggggtttttaaagatgtaaaatacacagtttgttgaatgctggcaactgatttttttttttttttttgagacaagagtctcactctgttgcccaggctggagtgcagtggcatgatcgcagctcactgcagcctcctcctcccacattcaagaaattctcctgcctcagcctcctaagtagctgggattacaggggtgcaccaccatacccagctaatttttgtatttttagtagagatgaggtttcccccttgttggccacgctggtctccagctcctaatctcaagtgatctgcctgccttggcctcccagaatgctggagttacaggtgtgagccacagcacccagccctgattttttttaatgtaaatactgtatgaacccagacaaatgttctgccaggccagtgctgcatggctcaccatgtggtggccctgagaatgggcctcatcgacctccctctactgggagtgtaattaaccagggccccagctgctgcgctggggaatccatatgcttccttccatgaggtgctcctggctaatgactgagcatggcagggacactaaagcagacccctccccaggagacacaggattcccctgtccccggctttggcttagggacttccctatggtgttcgcaccctaacttttttctcctctctcttttactcagagtcagacttgcattactgtctcaggttctcccagctttatgtggcaccttctttgctttctctcaagggcatttcccttaataaaaatcacatatgtgtaaacctgtatgggagtttgtttctcagaactgggctgacacaccatcttgcaaactctgctttcggcattcagctcacacttacttacaccctccaaactccaactatttagggctaattccattccagctcccaccccttgaatcccttcccccctccccccacttcctcctcccattctgctttcctggaaacagcatttccacttacttttgaacaatggtccttccttcactgttcattcatggagtttggatagcaccatcttctaaagctagagctgagcacatgatcaggactgactaatcaccctcttctacttccttagccacaataattcgttcagagatgggcacctgactcttacaatgcaatgagagtcagcttcttatgccagtgcttttggcaaaggtaggttcattttcccctgggattactaagctggtaggaggtaagtcagcagctgctgatggcataagaaaagggcctgataatgaagccaacatggatgaaaagagagctgagaagtagagatcagacagatttcaaagcatatcatttaagcatctggatccagccatacttgaagtccagtctatctgtgggctttgaagttgcatggaacaatagcaagatgtagctgagagagttttggctaatataccacctcacctctcattcagtttcatggaatataacagacattgccaactaaaatttacaaacagcattgatataaaagctccgccatttaaaaaaggaaactttctattctttcactgtgtggccttgggaaatttctaatccgttctgaacttcagcttttttccctctcaaatgtagcaaatacaacataacttgcttgccatggagggaaatcagatgcccttatctaggaaagtaaagatagaggtataaaacattgttatttcaaaaaaaaaaaaaatccagcacataagtctaggagcattgaacaagggtcagattgcatggattcagattccagctccattactaacaggctgtgtgaccttggacaactcaattgacctctctggccctcagtttccttattagtaagacggaaactccaatcatatctattgcacgggatagttgtagaaattaatagatacataagtgcttagtgcaacatgtggcactcaaaatatgtgtggtatgattgttattgacacaatggttgacccatgaatgattgtgatgccaaccccctcacagttggaaatccacctataacttttgactcccccaaaacgtagctactaatagcctattgttgaccagaagtcttaccaataacacaaacaatatacacatatgttgtattttatatgattatacactgtatttttacaataaaataagctagagaaaacaatatatgattaagaaaatcataaggaagagaaaatgtatttattattcattaagtggaagtggatcatcataaatgtcttcatcctcattgtcttcacattgaggagactgaggaagaggaggaagaggaggaattggtttcgccgtctcagaggtggcaaaaacagaaaaaaatccatgtataagtggacccatgcggttcaaatccatgttgttcaagggccaactgtatttatattacaataaatgctgttaatgttgtcactgttgacccttctagtccattcccaacatcacttcctacgcccagtggaaaattccatcttaaaatcacccagcccaagccctcttcagtagactcagatagatggcttgtcaagggcatgacttaacttctccaaacacaaccagcccagtttcaactgccatttggggaactttcccaattaccacatttccgcacatcaagtatgaattactttaattgccccagaagaacgcactgttgaaatatttgacttgcccagaactaattgtctgtcaaaaagagattttgcagccaagctgatctcttcattggacatctaatttaactgaaaacctttttccctgcttgttttatgctttcttctcctgtttttgccaaattctggatgctgggcactgctttcggaaataatttatcttgttattttctattataaaagtaatacatgttcattatagaaaaactgaaaaaaaaaattccaaatgaagaaaaacagttgatcctagactcattgcccagaggaagactatgaacattccacatgaagaaaaacagtggatcctagactcattgcccagaggaggactatgaacattccacatgaagaaaaacagtggctcctagactcattgcccagaggaagactatgaacattccacatgaagaaaaacagttgatcctagactcattgcccagaggaggactatgaacattccaaatgaagaaaaacagtggctcctagactcattgcccagaggaagactatgaacattccacatgaagaaaaacagtggctcctagactcattgcccagaggaggactatgaacattccaaatgaagaaaaacagtggatcctagactcatcgcccagagaaagactatgaacattttagcacgtctccctcccaggtttcctagaatagatgtctgtacatagttaataaaaacatatattcaagttttgcagctttttgttccactttacattttaagttgaacgtttacacttcccattccaagatcttcagaaacatgtttagaaacagaagagtatcccaacaacagtctgtttaacctcttcccctaatgctgaactattgttgctttaagaatacattttctgtgtgtgtttcagatgtagtttccttaggaaagattctctatgctgtgcaacaattccccatgtgtctcttacatttctgcacatcttgtgtcagcttttgttctagaccgtctttataaggatgtttgtatagctaatagcattagaagatagggctagtatagtagaagacagatttatttgctgattaggattataataataatatctctggaccaggcgcagtggctcatgcctgtaatcccaccaatttgtgaggctgaggcaggcagatgacctgaggttgggagttcgagaccagcctggccaatatggtgaaactgctgtctctactacaaacacttaaaaaattagctgggtgtggtggtgggcgcctgtaatcccagctacttgggagacaggtgggagaattgcttgaacccaagaggcaggggttgcaatgagctaagatcattccactgcactccaacatgggtgtgacagagcaagactctacctcaaaaaaacaaaaaacaaaaaaagaagaagaaaaagaaaaagaaaggattataatgacaatgtctccctccatccagggtaaaggttgaaaagaccaagattcctaaacttggggttcctcaggtgtgatgcaaatccactgcaggcacagattctacctggatccatccatgtattactcatttctcacactgctaataaaaacatacccaaggctgggtgtggtgtctcacacctgtaatcctaacaccttgggaggccgaggtgggcagattgcctgagctcaggagtttgagaccagcctgggcaacatggtgaaacctcatctctactaaaatacaaaaaattagccaggtattgtggtgcacacctataatcctagctactcaggaggctgaggtgggagaatcgcttgaacccgggaggtggaggttgcagtgagccaagaatgcgccactgcactccagcctgggcgacagagtgagactctgtctcaaaaaaagaaaaaaaaaaggctaggcatggctgtaatctcagcactttgggatgctgaggtgggcagatcacctgaggtcaggagttcaagaccagcctgaccaacatggagaaaccccatctctactagatacacaaaattagctgggtgtggtggtacatggctgtaatcccagctactcaggaggctgaggcaggacaattgcttgaacctgggaggcagaggttggggtgagctgagatcctgccattgcactccagcctgggcgacaagagtgaaactctgtctcaaaaaaaacaaaaaaacaaacaaacaaaaaacataccctagactgagtaatttataaaggaaagagatttaattgactcagggaggcctcgggaaacttacaatcatggcagaagggaaagcaaacatgtccttcttcacatggcggcagcaaggggaagaatgagcaaaagaagaaaaagccccttataaaaccatcagattttgtgagaactcattcactatcataagaacagcatgaagataactgcccccatgattaaattacctcccactgggtcccttccatgacacatggggattgtgggaactacaattcaagatgagatttgggtggggacacagccaaaccatgtcaacctgtgtcacccttgagggacttgggggtcaaagggaactggtgcagacatgaagctcaagcttcctgttgtgccatgaaaaataaagtcctttatctctcaatccagagtctcatgtcttctgcccacatccataaaactcactagcctccatgtaggataatatcttagaccagcacagttcttgacactctagaagtgaatttgttggatcaaaaagcatgaacaattgctaaaactcttaatatgtcttgtcaattagctctccaaacaaatgagtcattgcctgaaatctcttttgtcatcaggaagggatagagctgcttgactcagatctcccaggtggccttagaccgtaatgtcttcctttcgtgcagagctcttaccatcctaagccactactcctacctaatattctataaaaagctttttctccctacccagtgtctccaatgagctgactttcttttctggattactcttttatgtaataaaaagtagacatgagggtcaaagggaaaaaggggaatttgtttaatttctaccaagtgccaggcatagtacaaagaacatttagataaggcagaaggcattaattatttttatctacccagaaccccctgccccacctaagcaccccagcccctgacctggccacgtgggtggctatgtgacctgagctgaaccaatcagagtccttccctgggatttttttcacatcataaccacatgagaaggtctcccattatgaaacagagaagcttgttggcagccatggttctagccaaggatggaaaaaacaaccaaaaaaagaaaagaaacaaaaaaaaacccaccatggtaaaaaaatacatatataaaaataaaaaagatatgacagacagacagacatggggaatggtctctttccagttgcccctgccactcaactgctctcctaccttcctggatttggttatgagagtcaataaattatccccttttattgcctaaatgacttccatatgagtttctgctccttgcaaccaacataatcttgacaattaatagtagctagcattttgtgagtgtttactgtgccatgcccattaatacacctaatcctctctacaattggacaggtaaggtgcttttagtaacctccaatgtacaaaaaggaaaacaagttgggtgaagtgaaatgacttgctcacagtcgctgggctaacaagggggcagagtcaaagtttaaagccagagcccatactcttccctattgtataacacagacatgctgtctctgttcccagtgctggggaatgcagagaactggggactgaaggaagagcaggcgttcaggtaagcattaatcaggggaccttccacaagggaaaagggagtactggcccagttgaagtccagccagcactcagcatggtcaaggatggggtggtgctctctccagccattcaaggtgctgagaaaagaacagaactttcatctgaggaatacaagccttttaaattattaggcccagagaggcaatagaatgagatagcaatcatgtcctacataccccctttgagctcggtattcatttcttaaaactgcttgccattgccacaagtagctatcaattaatctaataatgccccactggatgctataacccacaccttatagcttaacaatgtatagccaatcactcgtcaatgttatttctgaaaaccagtgagaattcctgacaaccaactgtgtaccagcccactccatgtcccccttttttgcctttataaatccacttgtaactgctgctaattggagtgtatattcagggaaacttgaatctacgctccctggctacagtcctcaagcttggcccaaacagagtctttacttatattaattttgcctcagcttcttccttttaggttgacagtgctacaggctgaattatgtccccctaaaattcaaatttgaataaatgttcaaatatgaatttgaggccaggcacagtggctcatgcctgtaatcccagtactctgggaggccgaggtgggcagatcatcttaggtcagcagtttgagaccagcctggccaacatggcgaaaccccatctctactaaaaatacaaaaattagccaggtgtggtgacgcatgcctatcatcccagctacttgggaggccaggataggagaatcacttgaacctgggaggtggaagtggcagtgagccaagatcgcaccactgcactccagcctaggcgacagaacgagactctgtctctctctctctctatatatatatgaatttgaagcccttcaaccatatggatcatatgttgaagtcctaaccccctagcacctcagactgtcattgtatttggagataggggctttaaataggtgattaagtttaaacctatttagctcatttagggtgagctctaatccaatcagactcgtgttcttataggaagaggagattaggacacacagagagacaccaggtatggacaggcacagaggaaagaccatctgaggacacaccagaatcgaccatctgcaagccaagaggaggtctttggaggaaccaaccctgctgacaccctgatctcagacttccagcctccagaattgtgagaaaattaatctctgtcatttaagccacccagtctgtagtactttgttatggcagctccagcaaactatatctacagtaatccatcaccacttatgacaggctctgccacatagtaggtgtgtgtgcacacaccacacacaatcatgtttagaatatgaaatccgtgaaccctactcccacactgataacagttcaggaacagttgatttttcctcagggaatctggtttgttttcctagtttccatcccatcaagaccccttcccacctgctgggaaatacttgcctgaacccctcgttcctttcacaacacacacctgatggtaggaagaagcttccaactctgatattgacagggtgcttgtaacctagcaccctttctcctaccttgttatggaaaaataaatcctttatcctatttcaactacagtcttggcaaaggaaaaaacaaaacaaaaaaggaaaccagcctagaaatggaaaccaaagatcatgaacagtgctatgctgagttacagctaagggttggcctttctggagctggctgccttcagatggcagggctctgagagtgtgtgtgtgtgtgtgtgtgtgtgtgtgtgtgtgtgtgccagaagcacaagatgacacaccctgtggtggggtcaggcaagctgattgtgggaaaggtgggaacagaatattttacaacaatgttggaaaaatgggtttacgttctctgagaggaagatacccaaagcttcaagctcacctcaagggaaaattgagctaggttcccatgctctccacttggatctcacgcacatgaacacacatacaaccttctcctcaatattcacaagaggcctctgttgtctgcttctccagagagtggaggtgaatttacctgaagctaatgaggcttgggcttcagggtcttttccttgtacctgtctctttaaatgctggacttggggaaggctttaggtgagaagggaaagctgggtttcaataatgaagcacctctatgttcacatttctgattaattgcctacacagatcccagaagaatggaatggaaatagctaaaggctccagaattttctctttttatttttttgagacaacatctcactctgttacccccaggctggaggctggagtgtggtggcaagatcatcgctcactgcagcctctaactccctggctcaagcgatcctcccacctcggcctcctgagtagctgggactacaggcacacaccaccacacctggctaattttttgaatttttttttttgtagagatgggggtcttgccatgtcgcttaggctggtcttgaactcctgggctcaagaaatcctcctaccttggcgtctcaaaaagctgggattacaggcatgagctaccatgtccaggcagctacaggaatattatacttaatttctcattccaaaataacattctcttttgtgcctaattttaaattcataattttgtattctttttcttaaacagagatccccatattatataagcttcagtccccacaaaaactggatctggttctgccaaaatgatatatcctttatgatatttatagagacgttctgattatttctgaacatctcagactttctggaaccaagacaggttcgattatgaacatctgttgtctaattttaaagaccaagggggaagccgggtccttatgaaggccataaaggctccaagctagatggatattgggggagtgggttagcagagatgtcctaaaacaatgtattacactaatgggaagaacaaaaggtaagtctaatcacagatgtcttggttttcaagctagtcagacttcagataactgtcaaatcttcagccataaatcgaaagtggaggagaattaaagacccatccttgtttgcttacagaatttacttaatttagccactctatccttaattgatagcaacaggttttttcaaaatagccaaagtaatctatgctttgctacataatagcaaaagtaatagccaacatacatcaacacctactatgttatacccttgacaggttttcctattttagtagtcaaagcaatttcatggagtagcaattacagttgtaatttcactagtgagaatgcagagtgaggctcagagaggttaaggaacttacccaaggtcacacagctagtgagtggagagttggaatttcatctctctgattttaaagtctgggccctttcctctactgcctctctctgaactcaatgacacatcctaagtaagtaagggcttctacacaggatgggttagactatgctgcagtaacaaacaacccctggatctcaggaacttaaaacaaaatttcaggctgggtgtggtgtctcacacctgtaatcccagcacattgggaggccaaggccagtggatcacttgaggtcaggagttcgacaccagcctggtcaacatggagaaaccccatctctactaaaaatacaaaaattagccaagcatggtggtgggtacctgtaatcccagctacttgggaggctgaggcatgagaatcacttgaacctgggaggcagaggttgcagtgagccgagatcacaccattgcactccagcctgggcgacagagcgagactcttgtctcaaaaaaaaaaaaaaattctagaaataactccaaccttattttcttgaacacgactcatcctgaccctccagcactccattgatctgggctaaatatatggaatcctgcagatgaagacaccagcacccaaagctaatgggacacagaaaacagaggccactcaaataaatgtcagcactcctagttactgaatactctgtgtctggcaagtttcatcattagtcagttattcattcactcaatcaacaactacttactgagttaatatagcagcatggttatgagcacagactctggagcaagaggtcctaggttcaaatcccagttaccctgcttatcagctaaatgacttctcagtgccttggtttctccacccagaaaaatggggattataattaataattgcctacctcattgggttaagtggataaactaagaacagtggcatgcccatatgacatgctctataatttttattatcactgtgtgccaggcattattctatatgatggaggatgcagctatgaatagggcagacaaggtgcctgtctttacagagcttctattctagtgaaggagagaggctttattagcgagtaatccttgatcgagccatacctgaagctaactacacatccttcaaccttccaatttccccaggcattaagttcttttttcttttctgcctaggctagcttgcactgagtttctctcccttgtgaaccaaagtgtcctgaccagtacagaggtctaaagcctaagctctttccagtctgccccttgcccctttccagctgaagccctattcatttgcacccaacatcatcattgcgtccagtgcctcaccacttggtgagacccttgaatattcaaaccagcgtgtaagcagagagttaggaactataaacagtaaattataacaagcatgaagtggaagcctgctgctgatcattcgcaagagagcaatcaaatctgtcttggtgcctacatgttttatggaaaacatgtctatgttttaaaagtgtttttgaaataaaaaataatttactaactaaattagatttccacatgttttatctagttaacccatcccttatcataagaaacgtaacttcttattttttttttttttttttttttttttttgcgatggagtctcactctatcacccaggctggagtgcagtggtgtgatcccgactcactgcaacctctgcctcctgaattcaagtgatgctcctacctcagcctctcaagtagctgggattacaggtgtgcgtcaccatgcccagctaatttttataattttagtagagatggggtttcaccatgttgaccaggctggtcttgaactcctgacctcaagtgatccccctgccccggcctcccaatcatggtgggattataggcttgagcccctgtgcctggcctagaaagctaacttcttaattgcaagctactttcatcaatataatgcatttgtctcactccttaaaggactcctgtcacagtgaattggcaaagaactggtcagacacaagaggcagtggagtattagtaaaatacacgtggatttggagtcagaccttcctaggtttaaatgctggttttatcgcatactagttgtatgccttcatcggggtttcccaagaatcagaccctgagacaagactccaagagtaagtcatctatgtgggaggtaaatgaaacatgacacaggaaatgaaataggtcagggaggcagccagtaaagggcatattataaaacaagttaccacttgggacaataactggagcttaaacttgctggaaaactctaggatacactgtagaacatctctagcaatgtgctggtagatgtttaacaaccaacactgcagaaaaatattaaaagcccagatttgtagtgtctgcccatatccatggtgtaaatcctcccaccatggctgatttcacactaccttgtccctgaacaaggacttggggaaagatgcacataccagctcttgcttcatagttatctgacctaaggggtgagggagatggggtagttatccacttacaccaactctcatcagttcctggtggagggatgctcccagggcaggtgttgattcctccaagacttccaagccatcatacgggtgggcaaagacagtacaaccagaaaaagacctcagaaagagggccaggcatggtggctcatgcctgtaatcccagcactttgggaggccaagacaggtggatcacctgaggtcaggagttcgagacagcctggccagcatggcaaagccccacatctactaaaaaaaaaaaaatagctgggcatggtggtgcatgcctgtaattccagctactcaggaggctgaggcaggagaattgcttgaacctgggaggcggagattgctgcgagctgagatcacgccactgcacttcagcctgggcgacagagtgagactccatctcaaaaaaaaaaaaaaaagaaaagaaaaagaaaaagtcctcagaaagagaatgcaactacatttggatgggtcagtggatgcttaagaggtaaagggttagaagatacaagggaagcactgaaagcatctgttactctgtgcaattgtgaaaacgttatttcatttctctaggcttccaatattgcattggtaagatatgattcattgaatcttccaacaaatattcatggagcacttagtatatacccggcaatcttcaggccacaggaaacagaatgttgagttaccatgacaaagtcactgtcacagagccagtggggaaagcagcctctaaacatgccacccagtaagtaacaaagatcatttcaggaatggtgaggactatgatgttagagagggtgatgggagggagaataatgtagcggagaggacatgaacgggaaaatctttctgaaagggtaacgtgtaaggtgaggctcaacagatgagaggaaatgtgttgtaaaaagatctgggagcagcattccaggtggaggaaactgcatgtgcaaaggcccagaggtgggaaggagcttggcttgttcatggaaaagaatggaagccagtgtgtctagatcaaaatgaatcaggcagaaggtaaccaggaaacagagtggagaggcaggcaggaatcagtgtctgcagtgcgtgctcagcatcataaagggtttgagtagtaacacaaccctgaagagttgttaaatgagctcccatgcatgtaactggcattactcatgttattaacctgggaaactgtcacgtctcttacttttccatttaatctcatgcccatcctctttgctcacaggagccaagaagtccagtatctcactccacatctgccttctcgtggtccaacactctgccgactcagttaatccaaagatcacttccaaacttcaggctgatggaaacctgaggagtcggatccattcataggcagccccattttcaccttcccttgtccccgaggctgccattaggttgaaaaccagtctggtactgtcagcgtgtctttgtctacagctatgaaaaagtccacatagtccagtctctacatagggcacaatgattctcctctacatctcagctaccaggaaccagcttgtcgaacacacatgcaaacattcaaacccttctcaggttcccctctagggccttcagggacttatccggcatacctgaggttggggccattgcaatctattcttagtctagtgttaagccgggtcaacagcggagatgctccttctccttgaactaattttatttccagagtttcattttccttccctgcaacattaggcaccatttggggatatttttatccatccatatggatttcaaaatctcataaagaaggagctgggagaagaatgaggaatcactgattttaatgactgtatttgttgatctcttactccattcctggacccatgttgaataacataaatatatatgcatgtacacatgctatacatggtatctagatgctatatgtgttatatataacatacatgttacaatatatgttagatatgtatgtcatacatatcataatatataattatacattgtatattatatattatactattacatataatatataattatacattgtatacttgtatactattacatagtataatatatacttatgtttatataataaaatataatgtatatgaaatatacataatacatatatgatatattatataattatatcatataatatataattatgtatatttcatataccatatattttatcatacataaatatataagttatatataatatataatgtcatatattatataaattataattattatatattatataaaacatgtattatattatatataatacatggtttatatgttatataacatatataacaaattatatattatataacatgttatataacaaattatatattatataatatgttatataatataacaagttatgtaatatacaatatatgttattaaaatagatattacataatatattaaataatatatgttttatatattatattatatatgttttttatatattatataatatatatgttttatatatattatttttgtttttttttgttttttgggggttttcttgagacagagtcttgctctattgtccaggctgcagtgcagtggtatgatcttggctcactgcaacctccgtctcccgggttcaagcaattctcctgtctcagcctcccaagtagctgggactacaggtgcccacaaccaggcctggctcatttttgtattttctttagaggcaaagtttcaccatgttggccggactggttctcaactcctgaccccaagtgccccgcccaccccatcctcctaaaatgccgggattacaggcatgagccactgcatccagcctatatatgttctttcatcatcaccacatcatctaattttacagatgagaacactgaggcttggggagatattaaatgtcttatccagattgcatgcatgtaagtgacataagcatgatttgaaactaagcaatccaacacgagagtcctaggtctagagcctctctgacctgctttctacctagaaattatctgagttctttatgcaaattgatgcactttttcatccctttggtctcttgaagtggcagcttttgctgcacccagttctcacaacaacttgcaaagaggatcaacacacacgactgatcacgagataaaggaagtctgaagcagtccccaccaaacatgcaaattcaatgaatgaagatccatttcttgcagctttctgctttgcataataacatttggctgtgatgatctattatgacactaatccttgcacagcccagagaagatgggcaatagttttctggatgtcagtgggactctggcacaagggccagccaattttggtgagcgcaacaggaaattctttgcaatgtccttgtgaatctgaggttacaaagactggctcaatctgtcacaggaagcatgctggaatgcctttgtccttctttctagtttttctttctttctttctaataattctcagtgtgggagaatattattctttctaataattctcggtgtgggcttacatcctttgctttggggaaggtttctatcattagacctctcttttcccccaaccatccagctgtgaagcggttcactgcggacccaacctctggcatgactgtggatcagcagcaccaatgccatgaagactgcagacacactggagaaccaaggctaattcccttagccattgagcctccgctttccatccatgaaatgactctcaaaatgccagcttgggctattgcttgcttcagagcacctaagagcatctgaacaaaaggaatatctttttcacagatgtaaatgaggaaagcgaggattatacagtagaagaagtgctctataaggctgctgaagatcacaatttttttttttttgagacagtctggctctgtgtcccaggctggagtgcagtggtgcaatctcggcttactgcaacctccgcctcccaggttcaaacgattctcctacctcagcctcccaagaagctgggataacaggtgtgcgccaccacacctggctagtttttgtattttttagtagaaacagaatttcatcacgttggccagacttgaggtcaggtcttgaactcctgacatcaagtgatccacccgccttggcctcccaaagtgctgggattataggtgtgagccaccgtgcccggcctgaagatcacaattcttatctaactctgctattcattggctgggccaccttgggcatgtccattagctttctggttcttaggaccctcatgtctaataacaaggtctttcctacctgccccacagggctgttgggaggaccaaatgagatcaagaatgcaaaagctctctgtcaactgtgaaacactaccaggagtaaagattcacaaggcatgagttgccacaaggcagtatagcatggtggttaggaggttaagctcttaaaccagattatttggattccagtataaccccaggaaacttaactttgttttgtggtgttgttgttttgttggtgttgttgcttggtattttgtctaatttttagaaacagggtcttgctctgttgcccaggctggagtgcagtgggcatgatcatagttcactgcagccttgaactcctgggcttaagctatcctcctgcctcagcctgtggagtagctgggactacaggtgtgcaccaccgcacctggctaatttatttaatttttgtggagacagggtcttgctttcttgcctcagcttgtctcgaactcctgacctcaagcaatcctcccatcttggcctccaaaagagctgggattataggtgtgagtcactgcgcccagccaatttaaattctttaagtctcagtttttccatttgtaaaatgggcatagtaatagtacatttgtcacagagttggtttgtgataggataaggtgatgcatgttcactagaaatgaagagagaagggttatgattcattgaaaagaaagaaaaacctaggctgggtgtagtggctcacacctgtaatcccagcactttgggaggctgaggcaggaggatgaattgaggacagaagttctagaccagactaggcaacatagtgagaccctgtttctactaaataaataaataaataagccaggcatggtggcatgaaccctgcagtccaagctactcagaaggctaaggcaggaggatcacctgagctcaggaacttgaggctgcagtgagttataattgtgccactacactccagtatgggtgacagactgagatcttgtctctataaagaaaaaaagaagaagaggaggtagaagaagaaagtctgaactactccctgcaggaagagtagacaaggtaaagagccctagaaaagattcgtccccgtgctttcctctagaatgaggactccagtaatttataccagtgctggagcacaggcttgacaatggctggagctcagcctccacagtatctgttgtgattagtgctcaaaagcataaagcataaatggaactaagaagaaacaagatgctcaaggtctccccttcagccttccttccaagtaacagaatcatgatttgatgatttgaccccttcttctaccacctcaatattgaaatctgtttccaattcccgttaccttagagaacaccatcagatgtccattgtatatctcagattcatttctttccaaaaacgaatttaacttgccttccaaataattttactcctaatttttagctcactttctccatgaatatcatcaccattcacccagttacccaaaccaagagcctgaacaacatctttgagtccttctccatcacaccctacattcaaccaattgccaccttctcttttatatacctccttaagtcacggccttaatttgggaatgatcgtttctcatttggacttgacttcatggtcaaatatggcatccagagatctagccattgcatcctaattcaagaccaacaacaggaaaaatgggcaaagaaatatatggtcctcattctgagaaaatgtccatattactcttctctttgcattccttggccaaagctaaatcacatggcttgggtagcttcatgagagattgggaaattagagggttttggttttgttgttgttgtttaaagcagagtctatgtcaccctaattaaaatcagtgtttcatcttttattcttcctcaaatattcagtgttaaagtcactaaagggcaccaaccaaagtaagcatcaacgagaggggataggacagagatctggcatggggtgttgaagcctagaattggtgcacgacctagttctagtcacgaaaaagcatcagacaatccccaattgagagctcttatacaacataaatggcctgtatcttcaaaagtatcaaggtcaagaaagtaacaaagagactgatgaatctgccggaataagacgtgacaattaaatgctatgataatcttgccctgcaagattataaaggacattattgggatggtcagtgaaacctgaatggggcctttggattagatggtggtaatgtatcaatgttataataatttcctgactttaatggtcatattatgggcatataggagaaggtccttattgcaagacacacacagtaaagtattgggaaacgattcgaggagagggaaaacttaattgtactgttcttccaactattgtctcagtttgaaatttttcccccgaaaataaggtgttatttcagagaagaaaagggaatgtagatgtttcaatatgtaaatagtaggctccaccacagatggtatttaaataatgtatcagaagaggtcatcccaagggagtaatatttaaatccagagccaaagatagaaagccatccacgtgaagagcaaggagacaaagttttcaggcagaaggaacatgtgagaagtagctgaacttgttttcagagttataaccctagcaatatggtggaaaataacaaataactagcaatatggttgaaataaacaaactgctattccttcagaaacatgagtaagcaccactgtgtgcaggaacttgcagcagtcagctagatgctgtaagacaaacaaccccaaatcccagaaagagcttatttctctgccatgcccatatagcttggctggagcagctctgctggaggttgcaggtctgaagacatgctggggcggctctgctctagatgcatctcatttttctaggaccagcgaccaactaagtcatgtttttctcatagagaaggcaaaagcacaagaaggcaaactcatcacacgagagcatttcaagcctttcataagggttatgtcctctcacatcccattagccaaagaaagttaagctcaactcaacagtcgaagggtagggaagtacactatgccatctctcagggaaaaggaagtcacatagcctagctgaacatcaatgatgtaataggagagggaacaaatatttactaaacaatagtctcatctaccgtaaagctcaaatacttcacaaaagagccacccttagaaatagcttttatctcatctattttatgggtgagtggggaagaaggatgacaaagcccctttaagaattttatataccctagacacattcacttttggaggtctcaccagataagcatttgaaacatgctacaaatttgcctgtatcctacattaaatggaattttggctctaaacattttttgagaaaattttaaaattctgctcctgaaattatctggcaataggtgatttatttaaatttagattggatgtgatttcttggtaattgtgcatattcaggaggtctagaaagtgggaaattctaactatccacatttttcagatgtaatgaaatccctaggaatgttaaatttaacaattagtgatattgacaaagcagcacaatttgtaggtaattttttttttttttttagaaggagtttcactcttgttgcccaggctggagtgcatggcatgatctcggctcactgccacctccacctcccaggttcaagcaattctcctgtctcagcctcctgagtagctgggattacaggtttacaggcatgcaccaccataccaagctcattttcatatttttagtagagacagggtttcaccatgttggtcagcctggtctcgaactcctgacctcaggtgatctgcctgcctcagcctcccaaagtgctgggattacagtcgtgagccaccatgcccagcgtaggtaatttttaagatattcattaatttcaattttgtcattttctcttttgcatttttaagccaatgtgtgtgtgtgtatgtgtgtttgtgtggtgttttttgtttgtttgtttgtttgtttgtttgtttgtttttggtctcaaacatttctgtagatcttgaaaaacgtataggtcccgggaagaccctatgcctaacggattaaaaatgcacatgttgcctggaatcaaagctaattattattggttgggaaatggataccctcccactccagactcctcagcacaggaaaataagagcagctaactccaacagaacccaattcatttaggaggctctctgcctctgcataagggtgaatggtttgggattgctgctcagcagagcccttcatctcattcacgaagccattcacactgtatccagtccatttgtaaggcaaataaaaatgtcgtcttccaatcttggctcatttcatcttataagaaaagtctcccgtccgatgcctagccaacatttccctgttgtgattaaagaaacagcaggtaataaaagctggactaacggttggtcctctaaggaccaaaatatgattgaagaagcaataacttaccccagtgccgccaaggcaagttgtctcaataatgtaacaaagctatacttaatggcaacagagcacgtttcactgatactacaccataaactgcccgctttcaattagttgcatatgtattaaagggagtcaacacatatttacagcaatcatttctatgtatacaagatgccacaaaaatgtagctttctgctccttctggtcatttggccacataggaataatcaccaaccatagatgcaattctggaaaagtcattaatgctcatctctatggttgcaagagattattgggcttctatttcatgccaaggcactttacatatgtaaataatggtgcatgctttgaatgaagtcatgtttttgtgacctacaatccccactggctgctgcagcacctggcacatattagccactcaagaaattctcgttgagtgaataaatgaaacattcaatggctctgagaccctacctttcagattatcagcaccatgaccctgcttttgagacccctactctctctcccttccctattatctcttggtgaatattggggaatggctcacctgaactgccccacgatttcatgcctgttttcgccattacctgtcaccttacctggccacagtcattccttccaaagccactattcacatctctatcagatgctctgcagttctggggctcctgcctcttgggacaaggctagtactgtcataccaggtgtgatggttaatattgagtgtcaacttgattggattgaaggaggcaaagtattgatcctgggtgcgtctgtgaggatgttgctaaaggagatttacacttgagtcagtggactgggagaggcagacccaccctcaatctgggtgggtaccatctaatcagctgccagcatggctagaataaagcaggcagaagttggaaagaacagacttactgagtcttccggccttcatctttctcctgtgctggatgcttcctgccctggaacattggactccaagttcttcagcttttggactcttggacttacaccagtggtttgccaggggctctcaagcctttggccacagaatgaaggctgcactgctggcttccctacttttgaggttttgggactcagactggtttccttgctcctcagcttgcagatggcctattgtgggacttcaccttgtgaccgtgtgagtcagtaccccttaataaactccccttcatatatacatctatcctattagttctgtccctccacagaaccctgtgtaatacaccaggccagcagaagggagacatttgctttcctggacattttctgttcattttacatttgctcaatgaaaaaaatcaggttgcaatacatatataaatagaaaacacagagagacataaatattttttaaaaagaatcagaaacatatgccccaaaatgctaatatgattacatctgggtggttaatatttattttctgtttctattctctttgtgtttccccaaatttgcttgttgacagcacatgtgcattgcttttggccaataaatgtttggcttatttaaagagttatcttgatgatagccaggtgtggtggctcacacttgtaatcccagaactttgggatgccaaggtgagcagatcacctgaggtcaggagttcgagaccagcctggccaacatggtgaaaccccatctctattaaaaatacaaaaatcagtctatcttaaaaaaaaattagctaggtgtggtggcacgtgcctgtaatcccagctactcaggaggctgagacatgagaattgcttgaacctgagtggcagaggttgcagtgagccaagatcatgccactgcactccagcctgagcaacagagcgagactctgtctcgattaaacacacaaacacacacacacacacagttatcttgatggcagttcaggaacttgggagatgagggctgttctcctgaaaccctataagaaccctcaggtgggttatgccacccgttcactaatatcccatttacgggtgaagggaaaggtggaggagaccaaccaacccaccagcagtggcctcagtctcaaataaaacttagtccctgagttagaagccaacttaaccatggagaggaaagagttcatccgatgggactaaacctgctcacttccttccaagaaccaccccaagggttcatttcccaggcaccaggagccacccagctccaacatgctgttttctgtcttctggtgacttatcacttgttgtttcttcaagaataagccttcgttgttccaagtaaacatctcaaatgcacacattcttaaagtagtaagtcatgtatccacctgtgcatccaacaaattattatgtagtgaacacccatgagggacgtgctgctgtgttcaatgctggggacaccacagggggccacccacggacttggttcctgccatcatggagctctcggtccagtggaggaattagacatgaaccaaataaaacacagtcatgaatgtaaaaccagaaactagagtaagtgctcttgaaactgtcttagcaaaattatgactgagacagtgaaagagatttaacttgatcaattccatctttcttctaacctccaagctgtccttattcattcttgggtgtaggctgacctaactttgggagaaactgagttcatggttcatagtttgtagtttaaagcaaagatgataacagccctttcccaaagcagacctccttcttgcctggggactagattgcctttgttaggactaaaatcagccacaagattagaaactatggtttaggagtcaggcggctggaggttacaagattctgaccctccctaaactgttcctaagatcagtgcttgagataatttgcagaccctgcacgtgacgggtcaggtggcaccacccagatcgatcaactggctcatctgatcttgtggccccaacccaggaactgactcagcgcaagaggacagcttcgactccctatgatttcttccctgaccaatctgcactcctggctcactggcttcaactaaccacccctaccaagctgttcttaaaaactctgctccccaaatgcttgtggagactgatttgagtgataatcaaactccagtctcccacaatgcccctctgcatgaattactctctctgtattccaatccccctgtcttgataaatcagctctgtctaggcagcgggcaaggtggacccaatgggcggttacactctgtcgagaaggaacacagggagctgtggaaggcttccagaggaagtgcctgggctttgaagaatgagcaggcattaagtgggcaaaagagcatgtgcgagggtactgtgcaatgtgtcaccacccagggagagaggagaagtggactatgaggctggggacataaacacggtcctggccatggagggccttgtaaaccccatgaaggatgtttgctctttatcctaatatcaacatgaagtgattagaaggtagcaagcccttgattaaccaacaattctagatccttctccaaacttctcttttagggaaaggaaacctagaagtcaaaatataaggtggtgggatttcagttgaaaaggtgcccagggtcggcctcgggtcagtctatctttgggtctatcacaaacactatattaattgcccctattaatctttcatcatgtgccaggcattgtgatgatgtatactttatatccattggcacatgtaagcctcaccacaagatttagggcctatcattatgcccatttcacagatgaggaaactgaggttcaggggggcttgtaacatgtcccaaatggtgtagctagtaagtggcaatgccgaggctcaaatccctccaaagattctctctccaaaggtcattttcctttccctaagccatgctggtgcatctggggtcctggaaactaggagatgattttcagaattataagacttaggtcgtgcaagcttcttaatcatcaaagaaagtctggaaagagaagaagatgtttgcaggaagctgccacagaagagaacattttagacagaggaacagcatgaagaaccgaacacacgtggcatcccctaggggccatgaatatagcagggaggcaaccacagagttgggaagatccagagagaggcgggacagatacagtgggtcctgaaagtatgttaaatagagtcacagtgacacggcaaccaggagtggcaagggagccacagacacacatgattagacacaacaatcatgttttcaaggcacagcccacttagagatcacagcaagatgctttatccaatctccgccggcaatcagagcttgaaaaaggagcattgtcgtcaatcaacttccctttgggcaaaaggcacaggcaaaggagaagatacttcacccaccttttaataaatgtgtcttgaggagagagttggcccacagagtacggtctccaagatctaagactccacatgggtagtggcaggggagacaatgggaaccaacaggacattggctggaatcacaagtcacaccttcagtaaaccagaggagtcatttctctctcccttattgactctgggccctggagaaatgccacagaaattcatgagaagaggagttgaaggtagacggcacctggacattatttctgccagcccatttgagttcatctggtaaacattttgcatttggaagttgacatcgtttaataataactgtcaatgtcaatgatcaatgccatcataatggcacaaatacccttgtgggcttggggttgggaggggtacggtggggactgacttctttgtctcctgtcctttcaatggttataaataatgatgataataatttctatttgtgtagctttgtgattgcagagagctttaggcttcctgagagctttcacctatattacctcagctgatccctctacaatgtgcagtatctattttggtcccctctgggaacctgaggcttgacaaggtcaggaaaggccacaccatggcctgttcctgaaataggtgccacaaatgaaaatccttgcagagagtccaggcagataacataagtgaagaaagggaggaatgagaagcagtagggaatggtggggtctgtggtgaattggagtgcatgccccattgaaagacgggggtagctgcctatcttgtatccaccaactgtctccacgtgggaacatgggcccaatgctgtcagagcttctaataaattaagagaagctaaaagccagatgctatgtcagtctcccagtttttaaatgatcgcaactgggagtcttgcaactctgtctcccaggctgtaaggcagtggcacaatcctagctcactgcagcctcgaacccctaggctccaaagatcctcctgcctcagactaccgattagctcgaactacaggcatgtgtcaccatgcgtggctagttttcacaatgtttgtagaaatggggccatctcactatgttgcccaggctggtctcaaactcctgggctcaagcaatcctccctgctcagcttcccaattagctagaactacaggtgtgcaccaccacacctggctacaaactctccttgtcaccccctgttgacaggtctctttccttcacaggctgagacaactccaattcaactctgaatccccaatacaggacctgcccagggaacagggctcagacatttatgctgcgaaatactcagcttttggggctcagcgtccttttctgcaaaaagagttcccctcccaagaggaaatcccctaagcctaaggacaggaggtgatggaaagatggacggatgggcagatagatggatggaaaaaaaatggacagttggaaacagacaaacttggtggatgagcagaaataagcctcattctcgcctgacaatgggacagcctgggggaggggcgggacacaccaaggctcccagttgacccccagcaattggacaagagagtttataaaccagcatcggggttttaggagcattgtaagctgcagagtgcatggggtcttcagtgggaagcatctccttccccatccctgttctctgtcctggggttgcccatcaagctaatcacatgtccacccctggggtccctctggcctctgccactcttcaccaaagtacagttaaactccaggggcaaatgatgtgttgggggtgtggcagacagggattgtgtctcagcagagagggcacagcactcacaaaatagcttcaatagttccagggtcagtagatgtgcccgaagaggaaccccacatcgcaagtggcctaagcctggggtagggtgagcactgctcactcctgcccagaggagtagctgaggggcctaagctctagctctgagcccaccagccattccatccaccacccacctgaaactgttctgttgacccacagcaattggtcctggtgccaggcacagaacagatgctcagaagatacggttgatcctgtctgggtgcagtggctcacgcctgtaaacccagcactttgcgaggctgggatgggaggattgctggaggccaggagttcaagaccagcctgggcaacatagtgagatccccatctctataaaaataaaaattagctgagcatgatggtgtgcgcctgtagttccagctactcgggagactgaggtggaaggatagtctgagccaggagttcgaggctgcagtgagctacgatcatgacactacactccagcctgggagacgcagcaagaccctatttaaaaaaaaaaaatggtatggttaatctgcctttactgattacaaatcaataaatttgtattatcgtaataaatctgtctttattgattacaaggcactttctcatcccccatcacctaagacaactgcataaagaccgcatgagctataaagaccatttccttgccccaggtcacatggaggaaaagagacagagccaggatttaaacccctgcccctggctttcattcctttgctgtgtccctgcagacccgaggcccacctgggtgaagaacaggtgggtggacattggcagtgttcaccaggggaagcatgccaggtgcaaggaaacatgtgagcacctgtccgtgcccaatgggtctctgtttgtctccctgcatcttcacccaaaccagcttctcacacccccacggccaccaccagcactccaggcctctacctgggccctttaatgccccttccccattcctcaagagcccactggggtcccttccctgatggcctgctggcctcctgcctccctccctgacctcagcctcctcggattttcaacagcctggggttgcaggctgagctcagcatctggcaggggcctggaagaaatgacctctagagggcccacactctctgggtgtcatattttggggctattatcacaaaataccttagactgggtaatttataaatgacagaagtgtgttgctcacagttctggaggctgggatgtcccagatcaaggcacctgcagattcagtgcctggtgaggagggctcactctgcatcataggtggtaccttgttgccatgtccttatatggcaaaagaggcaaaggcgcttgctcaagccccttttataaaagggggcactaatcccattcatgaaggtggattcctcatgaattagtcacttcctaaggggcccctcttactactatcacattgggtattaagttccaacatatgaattcaaggggaacaatgacattcagaccatagcaccagacgtctatctggggaagcccccaaatatttgtcttttttttttttttttttttttggaggcaaggtctgcctctgtcattcaggctggagtgcaatggcacaatcacagctcactgcagctttgaactcctgggctcaagtgatcctcctatctcagcctccccagtagctaggaccacagatgtgcactaccacatccgactatttttttattttagtttttttgtagagacagagtctcaccatgttgcccaggctgatctcgaactcctgaccccaagcaatcctcccaccacctcagcctcccaaagtgctgggatcacgagtgtgagccatcatgcccagccagccccctcatatttgatccaggcattaagcctcctggcaagaccagcagctccctgcacctgaggcagggctgagtttcagaagctgcttttcattctcagactatgctgagcctggtactgtgcacacagcacatctgaactttgttcaacatatccctgcaccaacctggcaggacggcctcaggccagggaggaaccggggagatgatgtgggatgagaagagagatcagacagaggctgtctagacacagtttcctggcaaagtcaccaagagccctgcgagcagctgtccacacctcctggcactctctgtatctgtcccgtccctgccagctccccacccgcccagtgcttcaccagctcacccctcagacactgtccaggtgggaaccattcccctcaactccctccagaacaaccagatggcacctgccagcagccctgggagccagaatcccacccacctgacccaagggctctatctgatctcagcctaacccatgaatcaggccctttggagagccaaaggaaaattgggcttccctgccagctgactatgtgacagttcagatgtcccagagcacaggaaagaggcagagacagggtcgtgaggagcccttgcttctccttcaacatctcccataaacagctggagaggggctctcacagggtccatgggaagagaccaaggaggggcatggaggagaggggagggctgagaagaccagggtgaaatggatgaggagaaggaagcagatggcagggaccctcccatctcccacatgggcctccttaggtgctactggccttgtgcaaatttgcacactcacattcacacatttctgtctgcttctctccaatctttcagatacctagcacacaccccagcctctagaatcaggtagtcagtctagcagagtctttagcatttgacttctgggtttaaatcctggctttagcacttcctagcttcacggccctgtttaggcagtttatatgcctccctgagcttcccaaattttggggaggaataaatggcatagcagatggggaacatctagcactgtcctgctatatcatagactgtgaaagatcactgtttttgtactattggccttgctttgtagtaattatcattaacttttttttgagataaggtctcactctgtctcccagcctagtgtgatcatagttcactgccacctcgatctcctgggcttaagtgatcctcccacctcagcctcccaagtagctgggactacaggcacacaccaccacacttggctaatctctctcctttttttttttttttttttttttagagaccgggtctcattatgttgcccaggctggcctcccaaagtgctaggattacaggtgtgagccactgcacacggcctactttgtaataataacaaacaatacagccgctactttttggtagtttcaaaccatgatcccagaattttttgattcatcaaaaggtagaacctatgtcatctaccgttgaatccagactgtgcgattgcttgaccaatagaatatagaagaaacgttatgcgacatccaaggctacatcataaaatgtgacagagcttccactgggttctccttgtcttagagcccagccaccatacgatgaggaagcccaagtagctgaagagaggagaggcccaaacaaaggaaccaagtcccctggaccacagcctagctgagctcccagccaaccagaaagcgccaacttagcaaccactagaggagccatctcagaaatgaattctgcagccccctggtgagctccagctgatgccacgtggagcaggaacgaactgtcccctcaacatcctgcccaaattgtggatgtgtgagcaaaataaatgactgtcatgttttaagctactacatgttgggtggtttgttgcacagccatagacaactggatgacaaacacatatctgacgctttatccgtcattgccatgctaagctgcagatatttttgtaatctacacgtttagaccttttccagcttttagagctcacacttcccttcagtacacctgcaagctccctgaattcattttcatgtaatcctccacttttttccttcagccggttcatgttaggtttctctcatagcccctaaacacagtgctcaaataccaataacctggatcccatcttgcagctctgcaggaagctgtttttgcacaaggttcttccacatttctgggaacccaggagatgtctacttcagctacaatctctcctgctcgtcccctgtcccctcgggagggtctggctcagaacagatttcactgtgggacccaagccaacctgttagccactcctaccccaggacggttgaaacagtctttcagtaacaagacttacttttgaaggatggaattacaatatggaaaaaatacaacttcacaaggtacacgttcagttcatagcagcagccaagactttgaaggaagagttcaagtcgccacaaaaacatagcagagggaatagtacggattttagagccagatagtactggagacttggagactgcagggctgggagggtcacagacagtcctgagttcaaatctccactccaccactcattgcccacgtgaccttgagcaagttatttaacctctctgagcctccatttcctcaaaggcaaattggggataataaacgcagtgtttgtgaggatagataggatgcatattctgctcgtggttgtgccaaccaaggacacattcagagtaaattcaagactcttcttgaagagtcacgagcacagtggcccatggcagtaatcccagcactttgggagggtgaggcgggtggatcacttgaggtcaggagctcaagaccagcctggacaacatgttgaaaccttgtctctactaaaaatacaataaattagcagggcgtaggcatgcctgtagtcccagctactcagaagtttgaggcaggacaatcccttgaacctgagagatggaggttgcagccgctgcagtccagccagcctggatgacagagagagactgtctcaaaatacaaataaaataaaataaaaaaagaatgagactcttcttactgcaaaaactgacctctgcggggtggaaacaaacaaacaaatgagcaaaaaccattgttcttgcctagctgttaaagaatattgcgttttctcataacttgacacgatacagaaacatacaatgaagaatctggtgggtattgaactgtcaattgcaaaataattattcatcactgcaggtccagcctgttctccgggaaggactgtttgaatgtcctgggcctccaagccaagctcccagagcccagaccatctctttggctaatgctggctctatctcctgaagaaaatagtttgatgcaaggaagaactttcattatcttttgccctggagcaccagtaactgtctacaaagagcagagcaagggaagaagggcagtgagaaattaatctttgagtttcctccttggtgattcatccatttagaaatgggtagattcagagaagtgtttcttcatccggtccctctgttcccatgatctcaaaaatgaaaaggcagccaaccctgatcaccacccatcagtcagcctcttttcacaagtgggaggcatgggctgtgctggaccaagtgcaaatgcaagacatgtctctaacaggccttctggaaccaggggaagctggtggcttggatgcacccactgtgaggtagagtgttatactgcagcccccataaccctgcacttctccaagtctatgattatttgactctggaatctggtgtagcacatctgctcagttgctcagtcattacttactgagcacttacaatgtgccaggacaggcagggtataaaggattgagaattgaacaaggtagtcaaggtagtatgatccctgccctcaaagagcttgttttagtatatagggtttctcaactttggcaccattgtgggctgaataattctttgttgtggggctgtcctatgtactataattttttttttttttgagacagagtctcgctctgtcgcccaggctggagtgcagtggcgctatctcagctcactgcaacctctgtctcctgggttcaagtgattctcctgcctcagcctcccgagtagctgagattacaggcaccaaccaccacgcctggctaatttttgtatttttagtagaaacgcggtttcaccgtgttggccagggtcgtctcgaactcctgacctcaggtgatccacccacctcggcctcccaaaatattgggattatgggcatgagccaccacgcccggcccactataaaaactttagcagcatccatggcctctatccactagattccaatatcacaccctttctcccaattatgacaaccaaaaatgtctccaagcattttcaaatttcacccgagggtcaaaattcaccccaccccactcctaccattcacgattgagaacctctattccaatgaaagaagcaggcagcttagtggaaagagtgtgagcttcggagccaggtgggcctgggttctcccttccactttattagctgcgtgatctttggggaatcacttctctctcttacgcatacgtagattatttgaaaattatgggtagcaatcatatttttacaaggttgttgggtgagctaaagatcaaatgtgtaaagaactgtggcaggctgggcacggtggctcacacgtgtaatcccagcactttaggaggccaaggcgggtggatcacctgaggtcaggagttcgagaccagcctggccaacatggtgaaatcctgtctctactaaaaatacaaaaatcagccaggtgtggtgccacacgcctgtaatcccagctacccgggaggctgaggcaggagaatcgcttgaactcaggaggcagaggttgcagtgagctgagatcacgccactgcactccagcctgggtgacagagcgagacaccatctcaaaaaaacaaacaaaaaacaggggcagacactgtcaacaccaaaagtcatcctcttgtcttaattcttcttgctaacagaaccccagttctttcaagggtccctatctcagaagttgggctcagtccctagagggggtgggcatgcaaaccaggtctagttaatgagctatttgagggagggggccctctgggggtagaaggttaataaaaagtttggttattttatttttatgcttttatttttttagagacaggaccttgctctgttgcccaggctagagtacagtgccacaatcatagctcactgcagcctcgaactcctgggctaaaggaaggtggggactagaagatggataagcactccacacttgttagctatctattattgctgttagcactgtcattatcagtattttttttttttttgacggagtctcgctctgtcactcaggctggagtacagtggtgcactctcggctcactgcaacctccgcctcccaggttcaagcaattctcctgcctcagcatcccaagtagctgggagtacaggcgcctgccaccacgcccggctaatttttgtatttttagtagagacagggtttcaccatattggccaggctggtctcaaactcctgaccttgtgatccgcccgcctcggcctcccaaagcgctgggattacaggcgtgagccaccacgcccagccctttttgttttttttttttttttgaaacagggtctcgctctgtcacccaggctggagtgcaatggtgcaatcttggctcactgcaacctccacctcccaggttcaagcaattctcctgcctcagcctctcgagtagctgggagtacaggcacgtgtcaccacgcccagctaatttttgcatttttagtagagatggggtttcaccatgttggccaggctggtcttgaactcctgacttcaggtgatccacccactttggcctcccaaagtgctgggattagagacatgagccaccgcgcctggcccaaatttcattttttttttttagacagagacagtgtcttgctctgtcacccaggctgcaatcagtggcgtgatcatagctcactgcagcctcaaactcctgggctcaagagatcctcctgcctcagcctcctgagtagctgggactacaggtacatgccaccacgtccgactattatttttattttttgtaaagatggggtctcattatgttgcccaggctggcctcaaattcctgggctcaagccatcctcccacctcagcctcccaaagtgctgggattacagatgtgagccaccacacccagcccaaattccaattttctaaagaatctggggctctctgtgttttaagactattagactctccccagtttcaggggatgaatcttgagcagtctgatggagggctggcaaaccattgcctaaacccggcccaccacctgcttttgtatggctcaggagctggaaatggcttttacatttttaagtagttagaaaagatcaaaagtgtaataatatctcctaacacataaaaattaggtgaaattcaaatctcagtctccataaataaacccattcacttatttattatcatctatagctgctttcacactgcaacagcagaacagagtggttgctacagaaactgtgtggccacaagcctgaaatatttattctctggctcttcagaggaaaagatcttaggaaaccagaggttctcaaactcagtgtccatcagaaacccccggagggcacgtttaaacatagactatgggccgggcgcagtggctcacgcctgtaattctaacactttgggaggctgagagtttgagaccagagcattgtttaagccaagagtttgagaccagactggacaacatagcaagaccctgtctctacaaaaaataaaaaaattagctgggtgtgggggtgcacacctctagtcctggctacatgggaggctgaggcaggaggatcgctcgagcccaggagttggaggctgcaatgcgctatgatagtgtcactgtactcctgcctgggcaacagagaccccgattctagtaaataaataaataaaaacatagatcccacccccagagtttctgatttagtaggtctgaactggggtctgagaatttgcagttcttaaaattgcctagacatggcagatgctgctggcctggggatctcactttaagaagcactggtctaaggcaaccttggtaattccattcccttgccagcaactggcttagaaaagggcacgtgatacatttctgaccaatgcgatgaaggagaagtcagctggcagcttctgagaaaatgagaaaatgatcataaaaagggacagatgggctgggcgtggtggctcacatctgtaaccctagtgctttgggaggttgaggcaagaggatcacttgaggcccagagttcgagaccagcctgggcaacagagggagacctcatctctagaaaaaactctgaagttagctgggtatggtagcatgcacctatagtcccagctactcaggaaactgaaggaggatcacttgagcctagaagttcaaggctgcagcgagctatgattgcaccactacactccagtctgggtgacagagcgagaccctgtctcaaaaacaagcggggaacaagtggaagaaggctctcttctctcttgtccatattatcttgagaccatgatggggtgtggctgagggcaagagccagctgctaagaatggaatagtggaaaagtggaaggaaacaaggcccaccattccacaatggagccactgaatcaattaaccacatggccccctgcagagaaacaataacttccattagcatctacaccacttccagttgggttctcagtgatttgaagccaaacacaacctacctggcaaccctacaacttcacccctcaccactgtttggacactaccaaacttaggccatgatgattaaggccaggcatgagctccaccctccctgccaccctatgaggaataaagcagatatggggaaggtgaaagggcatgatttagggatccataaagccccagattggagccttagttctacaactcaataatggtgggctagagctctatgcaccccatactctaggatggggactcatacctgcatggttgactagtgcagtcatgtctgtgcatctgagcagttattttcttctctggaccattattaaccattagagctagcatttgtccccaggtcccgggcactgtgcaagtcttcacctacattatcctactacctcataagatagtttggatgtgtgtcccctccaaacctcatgttgaaatgtgatccccaatgttggaggcggggcttggcgagaggtatttgggtggtgggagcagatccctcatgaatagcttggtgccctccctgagtaatgagtgagttctcactcttttagttcacggcgaggtctgattgttaaaaaagtgtttggcacccttcctgtctctctctcacccctcttctcaccatgtgacacacctgctcccctttcaccctccacagtgaagaaaagcttcctgaggtctcaccagaagcagatgctggcatcatgcttcttgtacagtctgcagaacgtgagctaaacaaacctcttttcttataaattactcaccctcaagtattcctttatggcaacgcaaaacaggctaagacacctcaatggactaatacataacagccccataaggtgagtgccaccatctcccccaccttacagatcaggaaacaggggctctgaaaaactgtggctcactcaaggtcatactgcttgttaagtgcagagataggattccaactcagaggcatctggctcaagaacccatgtgtctgtgtttcaggttgcaatgctgaggttaaacaagaggatgtgtgctaggagccccagcacaccacaggggctgggaaacgttattgcatcgagtttgagtccaacacacggtctcattcctccacccaccactcagcctagaaaaagggtcggaaggttgactccactttcagaagcttgccagctccagccagtcagccagagtgaagctgacaagagcaatgagggaaatacggaaagataaatccagatgtggacaatgagaccgtgtcccctgagaactgtggtggcagcgggactcaaagatccaggcctgctcggtgtggctgcggctcgggttcctgggccacagggctgccttacctgccagtttccatgcctggctgactccccccaccgcccctctggcttccacaccagcccactgatgccaccccagagaactcggctgtttgccttgctcctctagagggcaggtggatgcggtgaaacgggcagcgattccagagccatcacaactcctggctgaaaccaaacatgacagatttaccattgggcaggctgctccatttattatttaacgctcgcaataaatatttgcatgacccagtgctggagggaacgctctgtgataactcactgcattttcctgccaaacaccagcacagtcggattccgaagctgcagcagagaatattttatgctattctaaaaatccaggtgatggccccttgttagaaaaccttttctcatccatttccatagaggaaaaaaggagcagggagaccttagctccgagaagcaactagaggaggaagaagaggaggaggaagatgctgacaggtgacatttacttagcacctactgagtgccaggccctaagctaaggacttcacactcattcattcaacacctctctctagagggtagggttgccagacttaacaagtaaaaatatacgacacccaattcaattttaaatccagtgaaataaggaatgattttttaaatacaagttatgtatctgatgtaatactggaaaattattcaatgtttatctaaggttcaaatttgggtgcaatggcacgcccttatattcccagctacttggaaggctgaggcagggaaatcacttgaacccgggaggcagaagttgcagtgagccatgatcatgccactgcactacagcctgggcgacagagcgagactctgtctcaaaaaaaaaaaaaaaaaaaatagaacaaactgggctacaaagttttgccaggcatggtggctcacgcctgtcaccccagcactttgggaggccaaggtgggcagatcacctgagatcaggagttcgagaccaacctggccaacagggcaaaaacccatctctactaaaaatacaaacattagccaggcctggtggtgcacgtctgtaattccagctactcgggaggctgaggcatcagcatcacttgaacctgggaggcagaggttgcagtgagccaagatcatgccactgcactccagcctgggggatagagtgagactctgtctcaaaaaaaaaaaaaaaaaaaaaaatgtaactgggcatcctgtttgtatctggtaacactccttaaggttggactaactatgcgaagacactgaatttaaaaggcttttcttttcatttattttttaagagacgtatctgtgtaactcaggctgcagtgcaatggctattcacagggatgatcagggctcactgtagcctcaaactcccaggcttaagagatggtcccacctcagcctcccaagcagctgggactacaagtacatgacactgcgtctggtgttcagtggtgcaatcacggctcactgcagccttgaactcctgggctcaagcaatcctcttgcctcagccaccagagtagctagaactatgggtatacagcaccacgcctcgctatttttttttttttttttttttttttttttttttttttagagatggggtctcaatgtgttgcccaggctgatctcaaactcccggtctcaagtgatcctcctacctcagtctcccaaagcactggaattacaggcatgagccaccacgtccagcctcttttttttctttaaggaggcttattttttagtgtgggttagggaagagccatgtgtgaagttgactctggagcagagatgtcaaagatgagaaagagctacccataacaaaaaaacggggaacaggattcctggcaaagaccccacaaagaccctggggctggaaaccatgtggggcattggaggagtcaagggaggtgacacttttggagctgagtaatggagaggaaagtgacaggagcagactgcacagggccttggtcacaatgaaggatttggatgctattctaagttaaagggaaggtatgggaaagcttttcagctggaagtggccaaactggggaccgactctggctgtacggatttctgagcctggagatggcacaaaggacctgacattggcaggaaaagaaaagaggaggaacaagaacacgagaaattgccttaaaagggagttggtcaggtctcgccagaaaagttcacgcaataacaaaccagtcgcccacaacagacatctccacattttcccagagctgtcccccagccaggcggccggagtgaggggatgccgacggtgacaatgctatcaatttccattttgcttttgccaaatacggaaaaggacacttcaaagacttttaaaaataacttccaaacaactcaagggtgaaaaaaaagaaagaggtaaaaaattacagtctgcctgcttgagaatagcgataatgaaaataagtgatagaaataagaacagctgcttttgcacacgttatgtcatctgctccttagcactctatgaagcaggcggaacaggtcatggtatccccatttcatagataaggaaactgagacccagaaacataggatacaacagagaggaaatgatcaggtgggtgagaagctatgtttgtctggccccaaagcctgggttccccaaagccctctgcaggctgatatgagcctaaccccagcccggctcctggctctcagccatctcatcctcccagcccagctatggggagcaagatacctcctaccatgtcccttgcagccttcctccctcacctgcaggggcttcctgcctggaaagcctgttcctttgcccttcttctccagaggattcacgtacctcagcacatgttcgacgacaaagtcacagcactgcagggacacctcccctggagaggaacaggatggtagagtggaaggggcacagctttgccattagaatgcctgagttcaaatcccagctcaatcaccaactggttgggtatccttaagctcttccaaggagtgggggataatccaatccatccccacaggatcctggtggggattaaatgagatgctgtatgtaaaacatcaacacagggccaggtgccatggctcacacctgtaacaccagcacattgggaggtggaggcaggagaatcgcttgaagccaggagtttgagactaacctgggcaacatagccagacccctatctatacaataaaatgtctttttaattagctgggtgtgatagcccatgcctgtaatcccagctacttgggaagctgagacaggaagattgcttaagcccaggagttcaaagctgtagtgagctatgatcatgccactgaactccagccatggtgacagaactagaccccaactctaaaaaaataaaaaacattaaaaaaaaatcagcacagtgcctggcatacagtcagcacctaataagtagtagctgttttttgttttttgtttttttttccatctctgaaaaaaaaaatcagccattttttaaaattagctgagtgtaatggtatatctctgtaatcccagctacttgggaagctgaagcagggggactgcttgaccccaggagtttgaagcttcagcgagctatgattgtgccactgaactccagccatggtgacagaacaagacccaatccctgaaaataaataaatcaattggcacagtgcctggcatatagtcagcacctaataagtagtagctgttagaatacttacaaaaggccaggcgtggtggctcacacctgtaatcccaacactttcagaggccaaggagggtggatggcctgaggtcaggagtttaagaccagcatggccaacacagtgaaaccccatctctgctaaaaatacacacacacgcaaaacaaatcactgggcatggtggcacatgcctgtagttagtctcagcttcttgagaggctgaggcaagaaaatcgcttgaacccaggatgcagagattgcagtgagccaagatagtaccactgcactccagcctgggtgatagagcaagactttgtctcaaaacaaacaaacaaacaaaaacaaaaaaaacactcaaatcatgggattgagtgttcaatcattcaatcaatttttattgaatgcctactacatgctaggtacttagggatataacaggaaataagacatacgtgattctaccttaatgaaacttagaagaaggaatatacttatggtgtagtgaaagaaacatatttattagaaatcaaacataaaaagcataaaaagtgttgaagagtgctctaaaagaacagaggtttctgtgaatcatctactttatttatttatttatttatttattttgagacagagttttgctctgtcacccaggctggagtgcagtggcgtgatctcagctcactgcaacctccacctcccaggttcaagcgattctcctgcctcagcctcccaagtagctgggattacaggcacccgccaccatgcctggcttatttttgtatttttagtagacacggggttttactatgttggccaggctggtcttgaactcctgatgtcaggtgatctgcctgcctcagcctcccaaagtgctgggattacaggcgtgagccactgcacccagcccagaatcatctactttagactgaggcatctgagacgtgctcaaaggacatttcagtggagaaccatgggtgtgaaggagggagtcacacggagactgggaagggacagacctttgtaggacagacggcaacacgtgcaaagcttgtgctgggaggtgaagggagaacaactcgctggaggaagcaaggaagaggagatttagttagagcagacagccaggatcagagcatgcagggtctgatcatttatttccaagttattctgaaatcaaagagaagcaggcttttaagctaagaatgcagcacatcggctagcatagaataagagttcaaaaaaagtgtaagctcccttccctctcctgaaacaaccaaagtaaataaaaatggcccctctgttttgaattatttatttatttgtgctttcaaactgttttcttaaaaaaaaaaaaactacagagtagtgagtgggggcgggggggtaaggggtggaatactcaaaacgtgttcaaaatcaaacgagccagaaactcctcgctggaaattttctctctagatctctgcaggaatcagtggaaccatgagagacagagtcgaaagcagcagagcctggaattatttctctaagcaagacccagacgccaggcaggtagtgaaattgctcctgccccacctccatccttgctgcctatctgagaacagagtctgccaacccctcctgatgagagactgacccctcatagccactgcaggctggaagccataagcttaaaccacttcgataccatgaaagcaaaatgtatggttggcaaaaagcaaaaaaaaaaaaaaaaaaaaactggttactggcgagtgcagaaccacagtctgggtcgatgacaaattatccagcatgaatcttggtgtgacttaggcccctcttagtcctctaaaattcatcacattttgtttattcgttcactacccacttacagtagatgccaagaaatatatataacaagattatagatataaatttaaaattaggactaaagaaagataatctagaataagaggtaaaagcagaacagagcaggatggaaggtagaataaagatatacaggccagaaggccagttactaaactggatttgagaacatggcgctgagttccctggtggccaagtcaaaaagggcagttggagatgttctcatggtccacaaaaagaaacacacttaactttgcagaacaagcactgtcctgccgtgtgacctcagataagtgatttaacctacttagactcagctgcctcattgccaaaaagttagtgaaaattattgaatgtttaggtaaaaagttgtaataaaaaacaagaatgggaaaggattccctatttaaaatggtgttgggaaaactggctagccatatgcagaaaactgaaactgggccccttccttacacctgatacaaaaattaactcaagattgattaaagtcttaaatgttagacctaaaaccataaaaacccaagaagaaaacctaggcaataccattcaggacataggcatgggcaaaggcttcatgactgaaacaccaaaagcaatggcaacaaaagccaaaattgacaaatgggatctaattaaactaaagagcttctgcacagcaaaacaaactatcatcagagtgaacaggcaacttacagaatgggagaaaagttttgcaatctatccatcgggctaatatccagaatccacaaggaacttaaacatatttataagaaaaaaacaaccccatccaaaagtggccggaggatatgaacagacacttctcaaaagaagacatttatgtggccaacaaacatgtgaagaaaagctcatcatcactggtcattagagaaatgcaaatcattgtcagagtgctcagagagggcatgttccctgggtcttggtggatttagaggtcaagggaccatttctggaagctcactgtgtgccagggcagcttatatcagagctccgctctttttctttttcttttttttttttaagacagagtctcactgttgcccaggctggagtgcagtggcaccattttggctcactgcaacctccacctcccgggtccaagagattctcctgcctcagcctcctgagtagctgggactacaggcatgcaccaccaccacacctggctaatttttgtatttttagtagagacggggtttcaccatgtgagcaaggctggtctcgatctcctgacctcaggtgatccacctgccttggcctctgaaggtgctgagattacagtcatgagccactgcgcttggccagagatctgctctggaagaccccccaggctggagggcactgccacaagcagacagtatggcgagggtccctatgaccacctggcaggcagggtggattctggagggaggtggcctgggagcaggctgaggatggggtgagggcatttgagcagcagagtgtctgcgtgaccgggcataactggagggacagtaaatgactcttgtgtgagaggatgagggaggggtgagaggggctgactacccccaggacttgaggtgcagtgagactccttagctttaaccagactcatgggagccatggaggtttgaggcagaggtgtgggctgctgggagagtgaggactcaccatccagagaggaaggtgaagctttcaactctaaatgccgttttattttcgtgtgttttttttttttttgagacagagtttcactcttattgcccaggctggagtgtgatagcacgagctcggctcactgcaacctctgcctcccgggttcaagcgattctcctgcctcaccctcccaagtagctgggattacaggcatgtgccaccatgcgtggctaattttatatttttagtagaaacagggtttctccgtgttggtcaggctggtctggaactcctggcttcaggtgatccgcccgccttggcctcccaaagtgctgggattacaggcatgagccactgtgcccggccccaaatgtgttttacattttcttcctatttgattcatctttgtcgtgcaacataaatatgctacttttccactgataaaaagacaaaatggaatttaaaattggcctggacttctcaaaaaagtcagtgtgatgaaaacatgttctagataaaacagaaatgagactgggcatggtggctcatgcctggaatcccagcaccttgggaggccaaggaaggagaatcacttgaggccaggagtttgtgaccagcctgggcaacatagtgagaccgcagatctactaaaaatttaaaaattagctgggcatggtggtgcatgcccgtatgtctggaggctgaggcaggaggatcgcttgagcccaggatctggaggctgaggcaggaggatcgcttgagcccaggatttggaggctgcagtgagctatgattgtgccactgcactccagtgtgggtgacagagtgagaccctgtctctatttaaaaaaagagagacaagatgatcaggatgagcgcagtggctcacgcctataatcccagcactttgggaggccaaagcaggtggatcacatgaggtcaggagtttgagaccggcccagcctagatggtgaaaccccgtttctactagaaataaaaaaatcagctgggtgtggtggggcacgcctgtgatcccagctactcgggagactgaggctggacaattgcttgaacctgggaggcagaagttgctgtgagcaagatgacaccactgtgctccagcctgggcaacaggaatgagactctgtctcaaacaaaaaaaaaaaaaaaaaaaaaaaagggatgatcaaacacaatgcgtcaacctcccggagctgttgtgagcaagatgacaccactgtgctccagcctgggcaacaggaatgagactctgtctcaaaaaaaaaaaaaaggggatgatcaaacacaatgcatcaacctcccggagccgtataaaccctaaacctaaaccaggaagcaggcaagcctgtgtgtgagtttccactctattgctggtaccactcggctctggcaacctggaaggccaccttcccctgttgttactgtgtaaggaggaaggagcactggtttgcaagtcagaagcctgggttgaagcctctgcttgagttcctgctggctgtgggaatgtggggttacctttcccggctggcctcgtttcctacatgtccaatgcaggggttccagtcacatgcattgggcaccattacatgtccaagctgtgccaggatctagataaatggctgggctcagtccaaggggccttcctatctggcagtgaaaataagaggagataccaagggccctgagcctgagtctggaggaaaagtcatgagcacagggcagtgccagggcctgggagctgccacagaggagcccaccttggtgacagacacctgtaggctcatatgatgccgagtgcccaacacagggaactggacaaaggtttcatgcacgactcttttccctccttggctaccttgaggaccttgattataatagttagcctttttttttttttctttttttgagactcttgctctgtcgcccaggttggaatgcagtggcaaaatcttggctcactgcaatcttcgcctctcaggttcaagtgactctccttcctcagcctccctagtagctgggattacaggcatgcaccactatgctcggctaatttttgtatttttactacagatggggtttcaccatgttggccaggctgatcttgaactgctgacctcaggtgatctgcccgcctgggcctcccaaaatcttgggattacaggtgtaagccactgagcccagccggattataatagccttttcatgcaccaggggctttatactcattatctcatttcattcatatgagttgaagtcagcttatcccccatttcacagatgaggaaaccaaggcccagagaggttaggaatttgtccaaggtcacacagccaggaagtaggattcaaacccagacagccaggctgtaatacctaggctcctctcaggctcatgcccttcccaggggtctgggaagccctgacctgcagcctgtcacctttgtttaccccccagcctccaggatattacgtgtgcaccggcgtgggatcctggaactggcaggaactgtgggttgtgttggtccctgaactcccatcgcctatgtgaaatatggttgcttttgtggcttgggaggccatggccagccccgcgatgccattgactggtgagtgcatgcctgggaccaggctgcaaaatccctcacactctggggtagtcaaggcttatgaggaagtacccaaaactgaagctggggtttggtccagggagatcccagtgtgcagtactactttgcaggcaggcagaggcctcttggataacatggccagtgaagccagatcttggtactagctgtgccttaccctggccatgggctgaaaacgttgccttaaaaaattggccaggagcggtggctcactcctgtaatcccagcactttgggaggccgaggccggcagatcacttgaggtcaggagttcaagaccagcctggccaatatggtgaaaccccatctctactaaaaatgcaaaaattagctgtgtgtggtggcaggcgtctgtaatctcagctactcgggagactgaggcaggagaattgcttgaacccgggaggcggagtttgcagtgagttgagattgcaccgctgtattccaacctggacaacagtgccaaaccctgtctcaaaagaaaaaaaataataataatataaagtgaccaggtgtgttgactcatgcctgtaatcccaccactttgggtcgaggcaggaggatcactggagcccaggagtttgaaacgagcctaggcaacagagtgaaaccctgtctctatattaaacacacacacacacacgcgtgcacacacacacacacacacacacatacaaaggcagccagactatgcactaggaactgccctgggaatccctttgtgttctcacaacaatcccatttcacatgaagaaacctaggcacagaaatattcagtaacgtgtccaggtgcggtggctcacgcctgtaatcccagtactttgggaggctgaggcaggcagatcacgaggtcaggagttcgagaccatcctggccaacatggtgaaaccccgtctctactaaaaatacaaaaattagctgtgtgtggtggcaggtgcctgtaattccagctactcaggaagctgaggcaggagaattgcttgaacccgggaggcagaggttgcaatgagccgagatcacaccactgcactccaacctgggtgacagagcaaaactccgtctgaaaaaaaaaaaaagaaatattaagtaacttgtctgaggccacatagttaccaagacgtgggagctgggacttgaacccaggcagtctggctggattcatgcctgcagcctctgcactcctgctacttactgtgtgagaagcgtctgttctgtggaaggttgtgggctgagatctttccatgacttccactcatttacccccaaggctgttcttaaagacgggcatgacagttatgcccattttacagatggggccctgaggctcacaagggcacgccattcacccatttccacaaagctatagttagttagcagagggcagaattcggccgcctctcccctagcttgtaggctgtgattgacacagaggtttttttgttgtcgttgctgttgtttgttcctttttcttttttttgagacagggtcttgctctgtcatcccggctggagcgcagtggtgcgatgtcagctcactgcaaactctgcctccaagatgcaaatgattctcgtgcctcagcctcccaagtagctagaattacaggtgtgcactaccacgcccagctgttttttgtagagatggggttagtagagatttgtttaatagagacggggtttcaccatggtctctactaaaccctgtctctactaaaaatacaaaaattacccaggcgtggtggcacatgcctgtagtcccagctactcaagaggctgaggcaggagaatcacttgaacctgggaggtggaggttgcagtgacccaaaatcatgcactctagcctggggtctcgcttttgcccaggttagagtgcagtggcacaatcatagtggctcactgcagcctcaaactcctgggctgaagggaatcctcccacctcagcctcccaagtagctaggactataggcatgtgccatcatggcgagttaattttttgtgtgtttttattgtctcgagacagagtcttgctctgttgctcaggctggacagcaatggcgtgatcctggctcaccgcaacctccacctcctgggttcaagcaattctcctacctcagcctcccgagtagctgggattacaggtgcgtgccaccatgcctggctaatcttgtatttttagtagagacagggtttcgccatgttggtcaggctgctctcgaactcctgacctcgtgatccacctgcctcggcctctcaaagtgttgggattacaggcatgagccactgagcctggcctggtgactaatttttaaatttgttatagagacaagagtctctcttatgttgcccaggctggtctcgaccccctggcctcaagtgatcctcccacctcagcctcccaaagtgctgggattacagatgggtgtcaccgcacctggcctctgaggaggatttcattataaacctgccctgaagggagggaatccaattttacgagagggtgtagcctggtgaggcctggatgacctccggaggcaggggcttgtgcctgggctgaggcctaagggacaatgggcagacatgaagttgccccaggcagagggtacagtgtgggcaaagtcaggaagtggcagggcttggatcactccaggaagagagaggagtcatgtgtcacaggagctcgagacccagagagggaggcaggcaggcaggcagggaccaagcttgggcacagccaggaaggcagagggcatggtggggccaatggaatcattacccaagacggggattttcagggaaacagcttagataaggccaggcgtacagtagctcccacctgtaatcccagcatttggggaggctgaggtaggaggactgcttgagcctgggagttcgagaccagcctaggcaacatagtaagaccccatatccataaaaaatttaaaaaaggagtttgtgttcctgtagtagcatagttgggaggttgaggtggcagtatcacttgagcccaggagttcaaggctaaagtgagctgattgagccactgcactccagcctgagcaacagagagatacgctgtctcaaaggaaatacaaattaaaaaaccagccgggcatgctggcgtgtgcctgtagtctcagctacttgggacactgaagtgggaggatcgcttgagcccaggagttcaaggctgccgtgagctatgattgtgcctctgcagtccagcctgggcgacagagaaagaccctgtctcttaaaaaaaaaaaaaaaaaaaatcttagataagaggatgctgtgcctccctgggggtcttcagtcacccatagtcctggcaagaggagggccaggagagagcttcacccacctgctgtcctgcccatgtgacatccgcaggtgctgccatggccacgactgttgttacactcgagctgaggaggccggctgcagccccaagacagagcgctactcctggcagtgcgtcaatcagagcgtcctgtgcggtgagtccccagcagcaccatgccacccaccccgagtatcccctgggcaccctggcatagccagatgacttccgtgcccctgttgcaataaccactgcttccaagtctctatagaccaccccttgggtatatctaatgtaagtgatatttattttatttattttttgagtcagtctcgctctgtcacccaggctagagtgtgctgatgtgatctcggctcactacaacctctgcctcctgggttcaagcgattctcatgcctcagcctcccaagtggctgggactacaggcatgcaccatcacgcccagctaatttttgtattttttcagtagaggtggggtttcaccaagttggccaggctggtctcaaactccccacctcaagtgctctgcccgcctcggcctcccaaagtgctgggattacaggcatgagccgtggtgtctggccctaatgtgagtgatctttaacactgagcacttgaaaaagaaaaccctgaagaaacctaattctttgatgtctggatgacaaggaagaagatagaaatggcatcagataataaacagtgtaaatgtttatcagaaagaggctggtggtcgggacaagtaggaggattgcttgagtccaggagtgcatctctacaaaaaagttaaaggattttttaacattggccaggcgtggtggcacacatctgtgatcccagctacttgggaggctggggcaggaggattgcttgaagcccaggaggttgaggctgcagtgagctgtgatcgagccactgcactccagcctgggtgacagagcaaactccagtctcaaaaaaaaaacaaataataatattttacataaccaaccacttctaaagattaaaaaaacccctacgattaaaaacctcaggtccctcaggcaatcataccagatattgaaacaaagcaataacataaggactgcagtattcattttatttttatattatttatttattcttccttagtttcttgagattatcatccgctgagggtggaaggggagtgagcagacacactcaggaggtgtcttgagattatcatccgctgagggtggagctgagggtggaaggggagtgagcagacactcgggaggtgtcttgagattatcatccgctgagggtggaaggggatagagcaggcactcggcaggtgtcttgagattatcatccgctgagggtagagctgagggtggaaggggagtgagcagacactcgggaggtgtcttgagattatcatccgctgagggtggaaggggatagagcacacactcggaaggtgtcttgaggctcagggagttatcaattatagaatgttgttgagttggaggaggtggctggtggcccatcctgttttttaaagtttcagctgtgaggtagggccagtagggcaatcctgaagaatgacgatgctccactgccgccattctgacctgtagggccaaaggagggaatgttttcacacatattcatttgatggacaaaattaccgccaccaacacagtctgcaccttctgttgctggtgatagatttttgcacctttccatcctccaggtttcaaaatagcagtgtcagtgtcataatatcacccttccactgagtactgccgacagctagggggtaaagaaaagtcattgggacacactgttgtctccacatgccactgtgtctgtctgcaaatgtaggcaggctggggtcctgccccagggaagacagagtcataacagagtaataaagaagcatgtttgagacacaggagtgtctatgtctatcctcattcctccctcacagccatcaccagagcatgtttcttgcaccaggtcaatagacagtaagagacagtaagagaggcatgaaaagcccattgtccacacatgttgcagcttctttttggagaatgttttccaggccttttatgttctgtctctgattctcagaactctgcaaggtcagtgtgaccaccctgctccaaatctaagaaaacagaggtttccagaggaaggagaaattgtgcccagggtcacacagcttgcaagaggcagagtggaagttgattccagctctgcctgcaggaccctctcatttcccctctgtttcccttcttgacaaaggatcttcttcactctggaggtgccacccatgagaacaaagagctctggagagatgtggattcctgaagagctgcaggggaactgggagagggttttctgacagaacaatcttacctcaagaagtcagttaggcatggctgtaatatttcttttcactcccaggtaataccaaattgtaagtgcactaggacataaagaatacttttgtccatggaaaaatgaggtgggaattctaaacaaagcaagttttaaaactgtgtttcacttcaagtgtacaagtcccatcgcgtgtaatcataggactcggcagcttttgaaggtacagaggccacacaagaaccagcttagctgagcatcatttaaggccctcatttggaattgtccctgtgggtaataagttacattcactcttcactaatttacagtcagggcccatttgctattacaaatacggaacctctgacacttagaatattagatgggggccccactgggtggggatgaaggtgtttttgcgcaacacagttaccaacagggatgggactgtgatgcttgtaggcagccttcctctctgccatctccctctgcagggcttgagcacagagccgtagggagaaaaatgtatccatgtcctgacctggcagactatgtccaaaagcaaggaaaacaagcaaacttacccggttgcaaagaggctttcttgcagaaggggtgatctgaaaaagccaacacatgagaaattgaatgttgagagagtctaagggccgtggcatcatctgcatcagcactgaactatcctgcaactgcggggaggaagctccttactttgcatctgtagtagtcctctgcccgccgccgcaacgcttgcgcacgttgaaacatttccctatggattacaatcactttcatcagataaagcaccactttcaggatgattttaaataatctgccatgtttctgttatcctcacaactgtacccttacacaatctatctctacctagaaaacgtatttcagatggctagaagagtacagtctgagccggtcacggtggctgacgcctgtaatcccagcactctgggagggcgaggcggatggatcacgaggtcaggagattgagaccatcctggctaatacggtgaaaccccgtctctactaaaaatacaaaaaattaggcgggggtggtggcaggcgcctgtaatcccagctactcgggaggctgaggcaggggaatcacttgaacctgggaggcggaggttgcagtgagccaagatcacgtcattgcactccagcctgggtgacacagcgagactccatctcagaaaaacaaaaacaaaaacaaaaacaaaaaaaactgtacagtctgatccaaactgttgctatattgattcctcctcttgcttactgcctgctgacttctgagatgatagtttccttccccattctcagtatatccctaattcatccttcattgagcatcttttatcataaagctgtattctctttgtattaatatctttaccgtgtttcacagggcagaaacagctgggcttataaacaggcatagtccttttgaaggatgtggttgatcctacaacaacacactttcctaaggatgacaacaactcaccccacccctagaatggctggtatgaaccgagtttccacacagtctagctggcaatggggtcaggagccgttttgctacttcacatcttttggtcactggtaaatattaaggtactttgttttctgttttgtgaactctctctctctcacgatatgtcttctgaccatttgtttctatttctgcatttactgggtctaaacattgtacaaaggttaaaaacaacactccaatgggcgtttcccaagagggtggggttcagtttctgaactcacatgtaggtgtgtatttctttcatatccaatttcccattttcctctgcctctgacacctgcctctcctcttctctgtgctcacgttctttcatgcttagtttcctcagactagaagggagagaaatgcacacacatgatccaccagcacgtgtgggattccctctgcccttctggcatctgaaggctgtgattcaaagatcccccctgcaaccttcccacaaatgaaccaactgattctcacaactgaagggagaatggacacctcccattgagggataaaaaaaatcacactctggcctgctggcaagtcacctgtcatttccagctcatcttcatagttccatagttagtcctattctttagtaaatataaagactattaaaagcttctatgaggtgcactatgtgcgtctctggggtcagtcttgtgcttgacacagcgaaagctcattttagttcagtgtgaaaaaccagacctcaccaattcatcacaactaactccatcggaagcagaggattgctcctcatctgactcctcctgtgtgagacctgattctcagtcagaggctgatgccggaactgagaccatcagccatagagagatccttccagaatatggtgtcattaaccccgcagttcactactgcactttgccatgattcaggactggaactcttgtcatcgactttaaagatcctgaaaaggcaatctgaatgctgggcgcatctattgaattagaaatgatcggaatggctcctaagtcagggtgttatgtcctgaaaataggtgacaacggcaaaccatccaccctggtgttgactgactttaacaaggttcaattcacagagattgagggcagaaaaaggaaacggcctcaaaagggtaagtttgctgtgttgccctcacaccacttgattcatggtcctgatcctaaggatctcacctgatacttggttttataggaaggatgtgtaaaattcccagaacgctaggaaacagggacgaaaacacttcaaagagaaagttaatgaacttgtttctgaccacagggcatccttcagcacatgctgtctggagtggcctcaaacaaggagtgtgtggtgaggtgctgacaatgcaatgggagcagggtcctgtccccacgctaaagaagctcacagtttaatgcaaatgagaagccagtgaggacatcactactcctgctgtgcacttgggaactagaaacacaaaacctgactctggagggaagctaaggaagcattctactcttgagttgacataagtgcatctgaagcttctgatctccgatgagaacaatgggggacaccaaacagaatataaaaaccatgattgaatacatcaaattgctaacatggcagtaaacagacatgaggtgaagatggagaagaaggaaacccaggacgaaagtcagcctcgcatttggaacccatttccctgagtttcattgctgaattccagaaggaactactgagatgcaaagaagcacagcagcttttgcacacatgcgtggggttagatggaaaacaagtggattgagggtctgccaatgaaagcgatccatactgaagtccactggctctggttgagacccagaagagtcatgcatcagaatagaggtggacaggaaataccctggcctttgtagggactgagcctgcagagacgacctcaattgcagcctgtacggaggacccctgaccatcccccagaagtagactcccatctcttctgcagcaagataacatgctactaggcctcaatgcattgttaaatattttttaaaaagtatctcacatttaacaaaaaaagatcagtcatatggcagcaaaatacaatgtagtatgaccaaaacatgaaagactgtgaaaatgaatctggaggtgacccaagcattgaattcaacaatccaggctgggtgcggtggctcacactgggaggctgaggtaggcagatcacctgaggtcaggagttcaagactagcctggccaacatggtgaacccgtctctactaaaaatacaaaaattgggctgggcacggtggctcacgcctgtaatcccagcacactgggaggccgaggtgtgcggatcatgatgtcaggagttctagaccagcttggccaatatggtgaaaccccgcctctactaaaaatacaaaaattatctgggcatggtggcatatgcctgtagtcccagctactcaagaggctgagggataagaatcgtttgaacctgggaggcggaagttgcagtgagccaagatcatgccaccgcactctagcctgggtgacagagtgagactccgtctcaaaaaaaaaaaaaaaaaaaaaaaattggccgaatgtggcggcacacacctgtaatccaagctactcgggaagctgaggcagaattgcttcaaactgggaggcagaggttgcagtgagccaagattgcaccacagcactccagcctgggcgacagagcgagactctatctcaaaattaaaaaaaaaaaaaaaaaggctgggtgctgggtgtggtggctcacgcctctaatcccagcactttgggaggctgaggcgggtggattacctgaggtcagaagttcgagatcagcctggacaacatggtgaaaccccatatctagtaaaaatacaaaaattagctgggcatggtggtgggcacctgtaatcccagctacttgggaggctgaggcaggagaattgcttgaacccaaaaggcagtgagttgagattgtgccattgaactgcagcctgggcaacaagagcaaagccccatctcaggaaaaaaaaaaaaaaaaaaaaaaaaaaaaagagaaaggaaaaccaatgccagtactagcaactcctcttcccctgaaaaaatgacaaacaagaatgtaggaagggaaaggaattatacagcttaaactaatgaagcagaaaggacaaactcaattttgaacccactgaatttgccacaaatattgtagaaaatattctcaaggactttacagttgtctactttgattggcacatggttcatacaacagtatttgtgtcaaggcacatcttactgttctttggcggtcttcctctttccattgattttgtcatgacggttgacttttgttgtcaccttcatcttacggattttagctcgaactttggtttccacctgtctccataaagtaaagatgtcttccaggacaattttaattcctggaaaggaagaaactcttttctttgtgtgcatacaaatggacttcagcccttggtgagagtgaggagaggagaaggtgagaaacctgagggcaagaagctgttctttccctttccagggcaaactcatttccacactatggggactccaacagagccataccttcctgtctacggcggttggacctcctggctctctgctgtacatccgtggatccatcatgtccattttgagatgggaagatagtcttcaggaaagacacctaggaaataataatataagaatgacggctgggcacggtggctcatgcgtataatcccagtactttgggaggccgaggcaggtggatcacggggtcaggagttgaagaccagcctggccaagatggtgaaaccccgtctctactaaaaatacaaaaattagccgggcatggcagtgggcgcctgtaatccgagctactcgggaggctgaggcagagaaccgtttgaagctgggaggcggagtttgcagtgagccgagatcacaccactgcactccagcctgagcgacagaatgagactctgtcacacacacacacacacacacacacacacacacacacacaaagaatgacatgaggctggcagggtggctcactcctgtaatcccagtactttgggaggccgaggcaggcggataacctgaggtcgggagtttgagaccagcctcaccaacatggagaaacgctgtctctgctaaaaattcaaaattagccaggcatggtggtgcatgcctgtaatcccagctagtcgcgaggctgaggcaggagaatcacttgaatccagcaggaaaaggttgtggtgagctgagattgtgccattgcactccaacctgggcaacaaaattcaaactctgtctcaaaaaaaaaaaaaaaaaataggccaggtgctgtagctcacgcctgtaatcccagcactttgggaggccgaggcgggtgaatcacaaggtcaagagatggagatcatcctgggcaacatggtgaaaccccgtctctactaaaaatacaaaaattagctgagcatggtggcccacgcctgtagtcccagctactcgggaggctgaggcaggagaactgcttgaacccaggaggcagagggtgcagtgagccaagatcccaccactgcactccagcctggtgacagagtgagactctgtctcaaaaaaaaaaaaaaaaaaaaatgacatgaatatacttcacacaactgaactgtacacttcaacacggttagatggtaattatcatcttgtaagtattttaccacaggttaacatgtttcacaacttgaaaaggaagtaattaattaccttcagctctctgagttctagaatttgtaacatttcaccccctgctccttcctgatctgcactggagcatctttcttctgtccctgctctactcagagttcactttcccttccctcacatcagcttcgttgaggctggtttgaacttaacgcaaaacattctcactaatgactgaattcccaccaagatttccatattatcacagtatgcttttaatcttcgaagatattaaatatttgttctcatcatagctaaaatgcaatgcaaatcccatctcagatgtgggtcagatacctatgaatctcctgaggtagtcattgaaatgacttttttcttgagacggagtgtcactcaaccatgctgaagtgcagtggcactaccttggctcacggcaacctccacctcccagattcaagcgattcttgtgcctcggcctcccaagtagctgggattacaggtgcctgctaccatgcctggctaatttttgtctttttagtagagatggggtttcactatgttggcccatctggtcttgaactcctgacctcaagtgatccacctgcctcagcctcccaaagtgctgggattacaggcatgagccaccacacctggcctgaaataatatctttcaaattctttgtagaacttgttttttcctgatttctgcacataggattaaaaaaaaatcatgtactaggatttcaagagaagcaatgggtaatctaaaaagatgaaaagagcaaccacgtctatcccacagctactgctagatttcataggaaaggtagctggcccagtttggagctaggagaaatgtcaaacacatgaagaaatgagaagcaaagaaatgccatcacacatgaatgcttcatggcacccatgatgtccctgcttaggaggtaatggtatagatgactagatgacaaggacaaagatgagaggtgcaaagttgtccaagtccaacagctcaactgaactttcctaaatggaattgttaaaaagtggtaaatttaaaaacttcccctggctcacgtggtgactcacgcttgtaatcccagcactttgggaggctgaggcgggtggatcatttgaggtcgggttttgagactagcctggccaacatggtaaaaccccgactctactaaaaatacacaaattagctgggcatggtggtgggcacctgtaatcccagctacttgagaggctgaggcaggggaatcacttgaagccaggaggtggaggttgcagtgagccgagatcacaccattatactccagcctgggcaacagagggagactcctcttgggggtgagaaaagaaaaaaaaaaaagcttcctccaatttataccgaaaattctctgttcaggactaagtggcatagagaatgttaaatgtgcctagatatcttcataactcatatattttctgttttctacatatcttgaaaggcagtgccaaatgacgtgtaattatctaggcggtaaaactgaaacatacttcctcttcccttgaatataaaaaagcattgtggtttagtacttttatcttggatcattgttcagaaggaggttcagcccccacacaaccacatttttattgtcatgaatggcaagacaaaatgtagagctcaacttacgcaaaggataaaaggctcaaaagacaaattatggcacaacttagcagccaaattcttaccaagtatagacttttgacatactgatctcattccagttgcaagtgggaacatgcactttgaatgatgtcattcaaaattaccctgcccagacacacttttcattgattctcttggagggcagttctaagagattctctggggctttctctgcatcatgagacgcagtgcagttctgcccttcaccttccggcagtttgtcacctcgtccctatgacctcagaggaactttgtctcaggccaactgtttgttccttgggctctttcatttcccctaaaaatcatttgctgcccctctaaatggcctacatctccatctatctccctctaccctcagaagagggtgctctttaagcatcaaccatccagcccttctagcagtctcatttttcagctggttcccatgtttatgcctgttctatgtttttcttttcctgttaagctgtctgttgtcagctcatttctgcagtgaatcttcagagaggagattggaagctttccttccacccatacgatagaactataaagcagaagagtttagaaagactttcccatttaagtgacgaaatctcatactccatttgtgacaaatagcacaaaggttaaaaaaacttatttttgaccaaaagctctgttgacattctattaaacaccgacctatttaattttcataatgtaaatggcagatattttcataattcttatgctaataaatcatttccctgattttttgggtaaaaccacatattcataatgaagtccagaaacgtgaattgtttcatataatttattcttatttgtgattacaagtatacctctacagaaagttagtatactcacacaaaggtaacttgtgcagagggagatggcaaatttataacttctcagaaacacagtaatgataagtaaccaaggacttccaccaaagtcagtcccacgatgacgatggtcagccagagtattgataacctggaataataatagttgaaataatgaaaaggtcaatgacactgacaatatttcactcagaaagaatcatccttagaaaccgtcaacctcctccaaaaggtaaccacatccctcagatatcaccgtgggattccactgctacaaaaaagaacagaagttagagaagtctcatgtttttcagatggctggtagtgtttttaggcattgcaaatgtggggtgttgtctttcttggtataaagcagggatatccaatcttttgacttccctgcctatattaaaagaagcaaagttgtcttgagccacacataacatacactaacactaacaatagctgatgatctaaaaaaaaaaatttttttttttttttttgagacagagttccgctccactcagtcgcccaggctggagtgcagtggtgcaatctcggctcactgcaacctccagctcctgggctcaagccattctcctgcctcagcctcccgagcagctgagattacaggtctctgccaccatgcccgactaatttttgtatttttagtagagatgaggtttcaccatgttggccagtctggccttgaactcctgacaggcgatctgcctgcctcggcctcccaaagtgctgggattacaggtgtgagccaccgtgcccggccattttttttgtttttgtttgttgtttgtttttgagatggggtctcactctgtcacccaggctggagtgcagtggtgtgctctcggctcactgcaacctctgcctctcaggttcaagtgattctcctgcctcagcctcctgagtagctgggagtacaggtgcctgacagtgcactcagcaaatttttgtattttttgtggagatggggttttgccatgttggccagggtggtctcgaactcctgacctcaggtaatctgcccgcctcagcctcccaaagtgctgggattacaggcatgagccactgtacctggccaaaatctcctaatgttttaagaaagtttacaaatttgtgttgaactgcattcaaaactgtcctgggccacatgcagcccgtcactcatgggtaagacaagctaagtataaagtaattatcttatcttttatttttgttttgagacaaagtcttgctctgtcacccaggctagattgcagtggcatgatctcagctcactgcaacctccgcctcccgggttcaagcgattctcctgcctcagctactgagtaactgggattacaggcgcctgccaccacgctcggctaatttttgtctttttagtagaaacagggtttcaccatcttggccaggctggtctccaactcctgacctcatgatccacctgcctcggcctcccaaagtgctggcaatacaggtgtgagccactgcacctggccagtagttatcttttctttagttatttacttgttttttaaattgatgtataatattggatgcatttattatatatcacatggtaaaagaatccctctaaataatacttctctcttggattatatgaatctttgtcatttaaagctcagcataagtaaaaaaaaaaaaaatacaatgaagagattacttcattcacaaataagtatcgaattttagttcttaaaaagtaacaaggtgggctgggcgtggtggctcacgcctgcaatcccagcactttgggaagccgaggtgggtggaccgcgagatcaggagattgagaccatcctagctaacacggtgaaacccatctctactaaaaatacaaaaaattagcagggcatggtggcacgcgcctatagttccagctacttgggaggctgaggcagaagaatcacttgaacctgggaggtagaggttgcagtgagccaagatcgcaccactgcacttcagcctgggtgacagagcgagactctgtctcaaaaaaaaaaaaaaaaaaattaccaaggtggagatcatgaaaatggcatgaatagcgtgggatttctctaagattgttgatattaattccattagactcttatgtgagtgaagacgaagacttcccctgagtaagttcagacagcttctgataacatttctacatcgattcctcaggatttaactatatattcttgaaaacatctcaattttaaatgtttctttcaagatggtgaattaaacagagatagcccttcaacaggttgaactcagcatatgctgagtctgaaatggaaatgatggagttagagaaccgtacaacaatggtaatgatttcagaaacatggtgttgagcagaataaagcagacacaaaagagtacctatggcatggcatgcatctgtatacgcgaaattccagaataagcaagctaacctatgataagaaagagactggctgggaagagtgagagttcactttctggggtgacataatagtgtagatcttggctgggcacggtggttcatgcctgtaatcccaacactttgggaggccgaggcaggcggatcacctgaggtcgggagttcaaaaccagcctgaccaacatggagaaaccctatctctactaaaaatacaaaattagctgggagtggtggcacatgtctgtaatcccagccactcgggaggctgaggcaggagaatcgctcgaacctgggaagcagaggttgcggtgagctgatattgccccattgcactccagcctcagcaacaagggagaaactgtctcaaaaaaataaataaataaataaaataatgtagatcttgaaagggggttggtttatgctggtgtatgtactttccaaagttagtaaacttacacttaaggttatatattttggccaggcgcggtggctcacgcctgtaatcccagcactgggaggccgaggcaggcagatcacgaggtcaagacatggagactatcctggcgaacatggtgaaacccagtctctactaaaaatacaaaaagtagccaggcgtggtggtctactaaaaatacaaacattagccaggcgtggtaatctgagctactcaggaggctgaggcaggacaattgcttgaaccccggaagcggaggttgcagtgagccgagatcttgccactgcactccagcctgggcaacagagtgagactctgtctaaaaaacaaacaaacaaaaaaaagtcatcaaaccagatgacacaaatcaaatgacatttcactttgttttggtccgttttgtctgttggagacaagagtgcaacagcgccatctcggctcactgcaacgtccagctcctgggcccaagcgatcctcccacctcagcctctccagtaactgggataacaggtacgcaccaccaggcccgactaatcttttttggaattttttgtagagatggggtttcgctatgatgccctggctagtcttcaactcctggactcaagtgatctgcccacctcagccccctaaagtgctgggattacaggcctgagctgtgtaatttcatgccgcgtgacacagcccagtaaaaaggaagaaaccccgcgggtccagcgtctactcacacaggtggactgatggctgataaatcccagcaggagccaaaagagcagccacagcacccatctactcacacaggtggactgatggctgataaatcccagcaggagccaaaagaggagccaaaagagcagccaccgcacccgcatgtcctggtcctttcagggcgccctgaggcagccaggacagaggtggaggtggcttagggcaggggggagggaaggggacggggaccgggccggatctgagttggggagggggaggggagggggaggggagggggaggggaaggggggaagtaagggaagggaaaggaggagaagggggctgttggggaggaggaggaggagaagaagaaaggggtctgggaaaggatccggttcaaattaagttctcaagcgctggtggaaggtttagctacaggtcacggagaagatcagggaagcaacaggacaggcggggcaagggagcgtgaggcttaggagcaattagagggagacaaaggttctgctttccaccaaaccttcttcggtctgggccctcccttagcaaccctggggctttagactctctctccaccaatccctgatgaccccggtggtgcctcacaatggacattccaagtagcgcccgcatcatcccaatgacccctcccccatctcagtcccccacgctcctcccaaggccaggtcctctctggaaccttcacaaacctgacttctggtcctccccaaccagctccctgtccctgcttctgggcgctccttccttcctgagctcccagggttcctcaaggtcacttttggcgacaaaacataaaaaacaaatgatggcaggatggcaggaagaacctcatacccaagcagagtgccaggttgtacagcctccgctcagccattcatatcctaagcaacaaaacatcagcaggatgcggaaggtcccgatagtaaaccatctccatcacatccatgtagccatccgtccatcaacctgtatctcaggaacaaatgtacatacattcattttaagcatgcatggtacatttacaaaaattaacctgacttattttgttccagcaaatctcaatatatttgagagcaatcaaatcacacagcatgtttctgatcataaaactgtgctagaagtcaatgattaaaagctaattcaaaattattatttgcttggaaattcaaagtgcccttataagacataaacataagaaagaatccaaaatgaaacaagattgcctttcaactcaatgatgagatcataacatggcaataaaatgtctccctctggcctgggaattcctctttgtggcacaaggttgtgtgatctcaaatcacccctaacccacctagacattttaacatccgaaactgagtgatgatgtccttatctatgtcatcttactgcccgtgtgtgtggactttaaattctgaacccaaatgagggggagaaaaccaagctgactttcatgactgagctctcagggacgtccaaggaatctgtgcatttcaagaaacaaagttcatcagcttctctcctaaggtatttgcccacaatacccagagggcttggccgcatcatgtgtgatgggtggggagctccaagcaggcgggcaggacccaggggcctggtgaccaggacagacccccactgtccatcacctttcctggccctgtcctcagctaaacttcccacaggccttctgcccgatcacacagagtgtgcccaaactctctcaggcctctggcagctgaaaaccactgctttaaatccctttaccatttactatgacataaggttattgtaaacaggaaatattctattgatgctacaaatggaaagccaatgcctttaccataaatagaaaaacaaccctaagaaacaagcaaaacaaaaacaaaacaggggctgggggtggtggctcacgcctgtaatcccagcactttgggaggccgaggtgggcagatcacaaggtcaggagttccagaccagcctggccaatatggtgaaaccctgtctctaataaaatacaaaaattagccgggtgtggtggtgggcacctgtagtcccacctacttgggaggctgaggcaggagaacagtttgaacccgggaggcagagtctgcagtgagccgagattacaccactgcactccagcctagacgacagagcgagactctgtctcaaaaacagcaacaactacaaacaaacaaaaaacaggattaacaaaactatggaattcaattctatttatatgctgcagccatgttccagccctagatttggctgggcatggtggctcacgcctgtaatcccagcactttgggaggctgaggcaggcggatcacgaggttaggagttcgagaccagcctcaccaacatgctgaaaccccgtctctaccaaaaatacaaaaattagccaggcatggtggcacacgcctgtaatcccagctactcaggaggctgaggcaggacaatcccttgaacccgggaggcggaggttgcagtgagccgagatcgtaccattgcactccagcctgggtgacagaatggaatgagactctgtctcaaaaaaaaaaaaaaaaaaaaagaagccctagatttcggttgtgttggttgtaaaaggagagacccagtaagtgggggttgtgccgcagattgctacccacaatggacgggtcactgagcaggtccggccaactgggcgttccctcgctggagggccagcacaccagactgcaggtggcgcgggtcagcaaggtaccaggggatgtgtcacacacacagcccacccccgtccagtcacgcacggacaccctgggcttccgagcaaacctgctcccacgtggtgtgaccacatggagccacagacacccagcaaggacacgcagcccgcacacccccggtactccagacacagtgacctgcaccagggctcgaggtttctctagggaacccacctcttagaatcatccagaaacaagtcactcttcacctgtccagcaaaggcctgctgagaggtgcacagtgtctggagtccaagctgcgccaaggcggcaggacccccagcccagcccaggacccccagtagagccctcacctcagcgtggaggcctgagaacgtgaggaaggagctgtccagcacggacgagtccaggcagctgtcgatgtccagcacctactgcccggcaggtgtggggctcaggctcccagccacctgcaggacgacggcagtggtcagcgggcggcagctcagacctgctcaggacagggatgagaagccacctcctcagcagacaggacagagcccggtgccatctaacagaatgtcctagaatgctggatatatgggacatctgcaccgtccgtgatggcagcccctcgcgacatgtgccactgaacacttgacagcagactggtgcagctaaggaacagagttttgaatttcattttttttttttttttaagatggagtctcgctctgtcacccaggcaggagtgcactggcgcaatctcagctcactgcaacctccacctcccgcgttcaggcgattgtcctggctcagcctcctgagtagctgggattacaggtgcctgccacgatgcccagctaattttttgtatttttagtagagacggggtttcactgtgttggccaggctggtcttggaactcctgacctcaagtgatctgcccgcctccgcctcccaaagtgctgggattacaggtgtgagccaccacgcccggccatcgttccattttaattaactttaatacgagcagccacatgtggcctctggttcctgccacggactcgggagcaacccctcctggtcgcggcttatgcgccttctctgtgtgctgctggggttagtttgcatgtaacctcttgaggaccccacgtgtgcattcctaaggggtgcggcctcccgtttccgtatgaatgggaagagttcccacctgctgtattcttggaaagagtctgtgaaggattggtgttaattcttccttaactgcttagaaaaattctatcgtgaaggctctgagcccaagcttttctttgtgggattttttttttcttttttttggagatggagtcttgctccattgcccaggatggagtgcagtggcgcaatctcggctcactgcaagctccgcctcctgggttcatgccattctcctgcctcagcctctcgagtagctgggactacaggcgcccgccaccatgcccagctaagtttttgtatttgtagtagagacagggtttcattgtgttggccaggctggtctcgaactcctgacctcaactgatctgcccgcctcggcctcccaaagtgttgggattacaggcgtgagccaccgtgcctggccctttttaatgttttatatagatggggtcttgctatgttgcccaggctggtctcaaactcctggactcagatccgcccacctcggcctcctgaagtgttgggattacaggcgtgagccaccacacccggcccggccactgggaggtttctaagggactaactcggcctcttcacttgctatagatgtactgagattttcttctggagtgcatttcggaagcgtgcacagccgcgtgcttgcttcttctgagttatctggcgtgctgctgtgcagttgtccgtggcgtctgcttagcgaagtgccctcgttctttcacgattctggcttctgagtcttctctctttctccctggtcagtctagctaaggctgctcaagtgtgttgacccttcccgagcagcctttggtggacgcctttccctctggctgcagcactggaaagtggcggccctgggcatggtgccgaggcccaggctccattcccagtactcccgggtccccagccccagcccaccttgctccgggacatccggaagagaaagaggatggccaggtagacgggatagacaaccacgctggacaccaggccaacagcgactgtgtcgacgctcagcgggctcagcctggacacatgccccgtgctgtgtggaggagaggaggccacacaggtgaggctgaggggcaggaagggctgggcaggaagaggctgtcccgacccctacggcacccacctgtaggcagagtcaccaacagccccgtaccacacggcgttggcgcccaggaagaggcagatgaggagaacgcagcaggtggccctctggatgcgagtgaaacagctacgaggtggccggtcccatatggagagccagatgtgcttgtcaaagaagccacgctgcagctcagccaccagcaggcgccggaagcgcaacagggctgcgtgacctagaaggcagggagggccgcactgcaggaggccacggggcaggaccaccctgcccaacctcccacggagtgggaacatggaacgaggccttactcgcagccagcacctccttctccaccaggcccccgttggcctccgtctccaccgaaagccagtcattgaccaggaagaaggtgctgcgtgccgtctgcaggtccctgacgatgatgtgctgcaggaaccaggcagggctgagccctgcagaggcgcgggagggaggtcaggctcgcagggcgccccaatgcgggggcagaggggcagagcttggcagggtccgcacagacctttgttgtcgtgccacactcggatcttccacacgctacccaggctgtgcggggtggcgatccggaagatgtccagactgttgcggtggaaggctctgtcgccgtccaggtgccggtggccgctccggctgtccaccccatacagcatgatgcccacgtgggccgtggtacctggagggcaagagggaggggtgggaggctcggtctgctgcccaacacgtgtggcatcccaggcaagtcatctcagctttggcctccgcgcactcaaggagccacacaggcagtcccggctttgcacggctctgccatacacgaggagctgcggttactgcaatttgtccaataaacagcaggacctcaaggacatgattaagttacacggaaagaactgtaacttgtgacatgcaaacatggctgcacacgcctcagtccacaccacaaccagtgacccgcgctgcacacctgtccacgcctcagtcacgccacaaccagtgacccgcaccacacacccgtccctcagttcatgcacagactgcgaagcgtgaagctgtgtcacctcctctcccagtgacagacccaggtgacagtattttttttctttttttttttgagatggagtcttgctgtgtcacccaggctggagtgcagtggcgcaatctcagctcactgcaagctccgcctcccgggctcacgccattctcctgcctcagtctcccgaggagctgggactacaggtgcctgccaccacgccgggctaatttttttgtattttttagtagagacagggtttcaccgttagccaggatggtctcggtctcctgaccccgtgatttgcctgcctcggcctcccaaagtgctcggattacaggtgtgagccaccacgcccggccgacagtttttaaaagtaggtaatcaaaagaactgggaaatgaagatgaaagcaacacggaaataaaaaatgggaacacagccaggtgtggtggctcacacctgtcatcccagcactctggcaggccgaggcaggcggatcacctgaggtcaggagttcgcctggctgacatggtgaaaaattaactgggtgtggtggcgtgcacctgtactcccagctactcaggagaatcgcttaaggggaatcgcttaaacccaggagctggaagttgctgtgagccaagatcacgccattgcactccagcctgggcaacagagtgagactccgtctccaaaaaaagaaaaacgaaaacaaaaagggaatgccagaagggcaattccaataaaggaaaatggaggtattgaagaaacagccacggggagggtgctggcacctccgtctgagagacgagctatgcagtcaggatcgcgggtggatgcatggtctcccacagtggtagcgatgctcatgtcacttgtggggccacgctactgtgcagaacgtgggctgcccaccctgactgactggcacctacttccagctaggagctgtcctagtcctcagggacagtgagtgctcacgaggtcattcccaggatgaacacacgagcccttcacacagcactgcaaaaactgccttgttctgacgcctgcgacgagactcactcccagagggtgcaaccagcacagccagtgagagcaggggaggccctgccaccccgccgcgcccctcacctgagccccggccccagcctgtcttgacgaggatctcgtacttgaagcggccccgctgcccacagaaggggatggcgcagccccggctggcatccaactggtccagcttgtgcaggatggcggccatgaccatgtaggtcaccaggcacacagcacatgtcagcatgacgatgtagtttacatccgctgtcggctcctgtgaagacacagccgccgggcccaggaggtcacgtgcaagctgtgccttctcaggatagagccgagcccacccaggccctcctcgactctgcagaggctcccaggagcacagggtcactcacaggaaacacaaagcgtacatggcttgggggcatgaagaggctggcgccgaaggcggtgaggtggcgggtgaggcagacggcctggcggggcgaggtctcctccaggggcagcagcccctctgtccgccacaccacatcctcctcgctgaagtactggcacagggacgtgtacaagcccacggacacctccagcgccgaccagcggaagtggctggagaggttcagacggtaactccccactgggtctctggtcctgggaagggaaggggcagtggacgtgagcccaggctccgccaggttggatgtcggagtcccagagcccatacccggtccagtcccctcgctgcctgccgtccccacggggcccgtaacccgggcaatgctgacccatgatgccctgccctgccctgccaggccggcccgcagagctcaccccggggaaatgaagaaggtgtagggccggtggtcggcaccctggagggactctgggcggatcctcctgctagccgagcagttgcgctcattgggccggggctccgagtgcaggtagactgccaggtagggctcgggttcctcagacaggtagcggcctggggcagaacgcgcaggtcacacgcctgccgggaagctcaaccacccgggggacacccacgatggccctcctgagcccaccctctgccacgggcctgaaaggccataggagcctctgcaccagagctggcacctgcttctccgtggcccccagctcctctccggccaggcccccaacagcccatgaaacagcaaatttcaccagagacacccatggaagccctacgagaaacgccttccccccaagaacaaggccagggggccgcgtgtgccccacccgctgcacacaccgtccagcagcgtatagttgagctgcagatgcagcacggccacagggctgctgctgtccagggtgaccacagcaccgacggaggcctggggctggaccacaacggagttggcggagctgcggtggccccgggcagcccagtccgagttgttgggcaccttcacggtgatggcgcgctctgaggccagccgctcgatggggatctgggcgccggcctgtgtctggaacgccatcgaggccaccttggtggagacggtgtagttgctgatatagccaaagagaaagggattggagtccaccagaaagacgagctgcaccacgtcactgaggttggcgggggccctgctgaaagcctaggggatggagaggtggcagccaggccctggggcgccgccatagcacagcaggctccgcgggtccgagcgcttgccctgggccatgatctcctcgcccgccagcgtcacgggctcctcgttgagcacgcgggagcgcgtgaggatgcgcatgagggcagaggtcaggttgtaggcctgggacgccaccatccgcaatggtgactcggctcccagctctgagcgctgcggtgcccgcacgtctgagctggccaggtggatgaggtctcctgcagacaggcgtgaggtcagtgcagagacagggaggcagagggagggtgggggcaggcaaaaagggggagccggagggtgggggctgggagaaagggggaacctgagggggcagagagcgaggtgcaggcagaaggaagagggaagctggagagagagtggtggagggggagggggaaggggatggggatgaggacgaagatgagggggatgatggggagagggaggaaaaaggaaggaaaagggtagagaaaagagaaaggggagaagaagaggagcagggtgaaagggaggggaaggggataagggggataagggaggggaagggggataagggaggggaaggaggataagggggataagaaagatgaggggaatggacaaaaggacggggaggatcgggggggaaatggagaaaaggggagagagatggagaaaagggatggtaatagggaagggggagggggaggagaatgggaattgggggagggggataaggatgggaattgggggagggggatgaggatgggaattgggggagcgggatgaggatgggaattgggggagcgggatgaggatgggaattgggggagggggatgaggatgggaattggggggaggggagggggacgaagatgggatggggcaaaggcgaggcggttgtggggaggagggaggcagaggaaagggcggcatggggcggacgggccacgtggggcgggcgggtggcgtggggcacgggccgcggcacctgtgatgttgaggatgctgtctccgatggcggtgggcgtcacggtgcccgcggtggtctctgcctgcaggatgcgcatcatggcctccagcttgtgcagcgtctgcttcaggcacgagcggcatacgagctccctgctgggcccctgtgtggagccagcagtgtccagccccgctcctggccccactccttgcacacgccctcctctctacacgggtcctcacctggctcccacccccagccctgcagctggagagcccacttgactggacccccacagcctcctcactaagcattttttgtggctctgcatgacccagggcctccacctggggaacacgtgatgcagcccaccgaccacacaaggcacctcttcacatgagagaaggaggagggcagaagggagagaggagagggaagtggagaaaaggggggagaggagagggaaggagagagaagggggagaggagaggggaggggagagaaggggggagaggagggagggggaggaggggaggaaggaggaggggaggggtgaggggatggaggggctgggggaggagtggaggggctcagcgggatgaggtgaggggaaggtctaggggaggggaggaggggaagggctaggggaggggaggggctgggggaggaggcaggggctaggggaggggggagggactaggggagggaagggggaggggaggggttaggggagggaaggggaggggaggggctaggggagggaagggggaggggaggggagagtggagggcacagagcagcatcttcttagtccctccccacatctgggcccctctttacaccctgggtcccccgagaggcaccctgcgttcacacaggacagcagaatggctgaggctactgaagcaggtcagagaccgaggaacgccatggcaggaaggagcccaggctggaggctcagctcctcggccaagctgcccgtctgccctggggggctgaacccagtaccctggcaggcatgcggggcggggagagcatgtggggccatcctaccatgcactgggccagcgcagcagcgatctgctggatgtcatccacagtgtggaccctcagggacaccagagtctccgtgatgttcttgcgtatctgggctcggcgctgccgctcgtgcttgggctctgccgccacgtccagggcccgctcgtactggggcaggcagggggcacagcaagctgtcagcagggcaggaggccggcaggaggccagcagatgcccacgactcccggggtgcagttacgtgctagatgctgtgtgatgtgggcactgacccgcaacactgagctgtttcttcatgggcaaaacagggtaagcacatgggccctcctgggcgggggctgcattgtggaaagcagacgccggagagggcccggtgggtgtggctgctgggagcggaacgtcggggtgctgcttcagggtcactgggatttatctctggggcccgggatgagccctccgcaaagctccaggcaggggaacaggtcttggtccccagcacgcatgcagcagatgtgaggtcccctcccaggctgcactcacctcgttcagcacagtgaccagggccagcgagtactcgatgacgtgctggggatcggcctgccgcagcagccccgggagcacactagcggtgagcccgtgcagccagactgtgagccccattgcgctgccgttgggctctgggagggtgatggccagagacctacgagcagaggggggtggtgagtaggtggcagtctcgggggcgccctcccacggcctggctcacctgttgagggcgaccacagcggctcccagctggtcctgcaccaccacggccaggcccacctcgaagtgtggcctgaaacccgggggcagcacggctccgtagccggagaggctgcccttgtagacacagaactcctcgcagtggccctggcgacagcgctgcagcagcagggcgtacaccagcggggcgccagcatcctccgcgtcatgccagcctgagggacggtccccacggcatcacgggagggctccgtgacctcacagagtcgggggatcccgctgctccccctacgcaggcctgcactcacccatgcattcgaagtgcaccttggtggtgagagcgtgcacagcgcccagtgggaagaggcggcaagagccccccagcggcgggcggttgggggacagggggatggaggcgcagccctcctccttgccagagcggcccagcaccgtcagcgtgaaggtgtatccctcgccgtcccgcagcacgccccgccgcagcaccagtcacatgcctgcgctgcccgtggatgtggtggtctcatccagcaccagcgtcttgttgctgaacgtacgtgcagcccaccgctgcaggcagaagggatggtgagggggcgcaaccctctgccctgtcagccccacttctgcctgcaggccccgtcccctcggccatgggacccatccccaacccgcccacaccccgctcaacactcacccctcgcttggagccgctgctgcaattgaggcagcggccctccaggtacacgtaggagctgcggctcacttcgtacacggcctgtgccttgcaggacacacactccaaggacacaatgggcacccggccactgcggatcagcacctggcgtgggagtggggttacctccaacacaggtctatttggcctgctggaaggtctgggggacccgtggaggatgctgctcccaaactccaggtttcccaggggcctggccactgccggtgagctcaccccctcccaggatactcatccggtttgccaccttccaacctgggcggcggaagggcatacacagggcagaggacactggggtgtgcgttctggtgtactggagccagctggaccctggcaggaggcaggcaatgctcactgagggcccctggggggatgcgtgtgggaacagacgtatgtgtgggtgtgaggaccgcagttgccacgtaggcctgactcacagactcctgcagcccttagccagggcctgggtcaggaggctgagccgggatggaacctgctcccacaccctcccctcagacgacccctctgggcagacccccaatcaggccagctgaggaaagcagggactggggaacagacacccactctggggtaccagcaggccccagtcagggaggcgcacacgctcacagagggcagggaggcgcacacgctcacaggcacctgctgcgtccggttctcgaaggcattagatgccagcaaggtcaggacgtactcacctgtggggacaggcccaagtggggcagccgcggcacccccacctgctccccacccgctcggcagaagccccccgcctgaggagcccggggtgaacggctgcacctgcggcccagccttaagggtcccaggctcccaagccacgtgcgggacggagcacaggtgcagcagcactgagggctgcctggtgaggacggcaccgcctccaagtgcagctgcactcggggcagcagagcagcaagagccaggccgcggtggggggcagttcagggggcccagcttccctgtccactcctcccacgcctggcccctccctcaccccagtaggggcctaagccatcagcccaggtgaggtcacagtgagggctgttggggaggaagcggggcagcttgactgggggactgggggggccccgtgctcagagcctgaaaggcagtggccccctcaccccctcatccctcacctggggcagcgtaggtgtgggtgacattgtgctccaccagcacctgggccaccgaggggtctggaaccgggaaggactcgttgtacggaggctggaactggtggagggcctgctccccatccccaaaggtccacctgccggggcggtgggaggcagtgagtgaaccgggacaggggtgcgcagtggcggggcacaggtgcgcggtggcggggcagggggtgcttgggacccagccgaggctccactctgcagtcacgccccgggcctccattcagggcccacccggctgtgctgaggcctctcccggctcccgtgcagcctcagggctcctgtgcacccagtacctcccaacagacagggaaaccgaggctcagaaaagcaaccccctgatgtggggtccctcggctgaggctggagccgggacaagagcctggtgcccggacaagagcctggtgcccaccccaaaccggcccctgagtcactcacaggaaggccacctccacggccgagtccaccagcacgcccgccgtcagtgccagcgtggcattgggggacagcacggctggcactgtagagacccgcaggccctgcatcctgttcatccgctccacggtgatgttgtagttcacggtgacgttgctcacgtggttggaggccgtcagctgcagggacaggcatcagtgggcccaggtggcaggtgagaggcctgccctgcttggcgtccctccctccactcaccacagccatggcagcgtcctcgggcagcatgaagcagagcagaaggcagaggtgaaggtggagcccgcccccgccccgccccatcccctcccctccccactcccgcccacctactgagagcttgaagaccgccgcgctctgataaatgacattgaagaccacgttctggaaggtcagggactgcttgtcgttgatggtccaccggaagaccatgtccgagccggcctccaccacggggctgtacctctgcggggggactggtgtcagcctgggctctgtggaggactctgcccttagcctgtcgcctcctggacacacctcccgtcgggctggagagtcccacgcggggcacagaggagaggaggtgcccggggctctgcatgccatgagagccaagcccgggctgggacactgactgtccggctctccagccagccatgtagtactactaatgcctcaacctctctgtgcctcagtttccccatctgtaaagcaaacctagtaccagctacaaagagtccacctctctctgagtcttctcagaccctcccggggctcctgccccagctcctcagccagagagctcggagcagtgaggggaggcacacgggcctcacagggacagcacctacactggcttacagaacccaggacaggctgcacaggtcacgccatttctgatggcccctcccaaggcccctggtgaaggggcaggtacccgcaagatggaacagccctgtcccccatgtacccagcatggtggcactgcgggcagcccgcagtttcccatcaggggttcggactccacctcaaaagccacttgctttagccaggcgagaacacagcagagggcgtgagagactcacggggactcgtgtgaggtcagggagcggagttttaaattcatttcgtgaaatgagacggtggaatgagttagcggagccgctgtcagagccgtgactttccaggaatttaaagcccaccaggtagcctgaggagccagccagcaggacctgcccggggccgacgtccccagtaactgggctgctgccctcactgggaagccaggcctcaagccctgtgtgagcaccctgtctgcaggcacctgcctgggggctggtggtggagcctcggccatactcaccactgggactccctgcagtacacgggcctcggggctgggcgtggcgcggaggccacagatgggctcctccgccgtcacccgcaggctgaggttggcccggctggcgctgttttccaccacaacgtccatcacgtgctccccctcaccgagccacggcagtgctaccactgagaacagggtatcattggtctcccaggggcagccgggcacgaaggtggccaccagggcagggcaggcattctcaaagcgggcgctgacactgcccccaggccagcgagccgtggccgtggcgctggcaccagagtccacctggagcaccgaggctgagccgttggtgggcacgtagaggcggccgtcgcggggggcagggtagatgacccgcagcccagccactggggagaccacgtcaaagctgcaggacaggttgtgcctggacacgccattgcccacctctgcccggacctcatagcgcccaggcagccgcagcccagggttgggcctcaggcccagcagcacggtgagctgttccgtggctgcaagcagccgcagggcacaggcagggcaggcccaagtgccctccagctgggctggcaagtggggcagccatgacgaggcgttggcggagaggtacggggcctggggaccagggtggccgggagccggcgagcagtgcaggagggcgccagggccagcgtcgtgctgcaagccaacgaggtcaccagggagcatgaggacatcctggctgtggagggtgacctgtggagagggaggcagggctgcatcacgtcctcacggtcatggcccgtggacccctgcacgacggatgagggtggacacgcagggctccccgcttcgtcagccacacctcagggagcctccccacagtgctcgtgacaaggacaggcaggacagttgcagacagggggacacacggggagaggacacaggccaagacctggcagacaggaaggagcggctgtgctgggagagaggaagaggaggcacagctcgtgccaagggcccaggcgagagcttctcccactgggagaggggcaagggcactgcagaggtcggaggttggaggtcggaggtcggaggtcagaggtggcaaggacgtgggaggggcctgcaggctgggtgtgcctgctgcgcagacccagaccctgggcagcagacaggaaggtggcctgaggagatgcagggaacagacccaggtcagggccacacaccgagtactgcgcggggggccccgcgggaacggagaagaggaactctctccatagcgcatagggggccccgagtagccctggccctgacgtgcagccattggcgcaggcctgggggtggcaggaggcgtccagcggcaagcagatgttggctccagggcaccagcgtccccctggcatgcacgcggggaccagctgggtcctgttgtccggggacctgctctcaggctcgctgccgttctccggggtccctgcgaggaggggagggtgttggggccctcattcgcccacgggccaccgtcagagatgcccaactgcctgcaccagcgagcctggccttgctgtgaggacaggtctccccgcccgggcagcactcccagcccagtgctgcgtccctgtctccggccagctgactgacccaggccggtccccaggcaggccccacccgatccacccccaggacacctggaatgagctggtgtctctggaacccctgctctgtccacctaagactgggaaccactctgatggccacaggaccagcagacgtgagagctcagagaggccaccccgagtcctgcggcgcccaccaccccagagtcccacctgctgtgctgaggagccggtacacctgcagccgcagctgggcgggccgccggagctcctgggtcccaaattcggccgtggtgaggaaggcttcacggctcagacgcaggcccgggaataccatgacctggtgggcagggggccgcctcagctccacagaccccatcccagcctgaagcccagactccccccacccgaacttcgcaggaagaggggagggaaggagagcgagccatcggacccccacaggcctggctcctgtcgctcgagaggaagactccgatggaaactgtccatggggggcaggacccctgacctgcctttcaggaataactcacccacactcagagaaaaggcctgggggtaatgtgagtaaacgctttcctctctgcactctggattttcccaaccatcttcactgggcacaagcaacattaaggcccccaagttttttggcgagacccacagtgggcagggcaggcgaggcctccaggggcaggcaggagggcaggttatagaacgtggggggccgactacctccacgggctcgtgcggggctgagaggccgtcctgccgtgccagaggcatcaggggtccctacaggtccccactgggcgctcccacgaggaggttctcggcatcctgcactgggcctggggtggcaagtgcacagtgaggcgccgggccagggcccaggacaccaggacgaacagactggggaccgagccgcccgagaacccccccaccagcccctcctcctcagcccaggctccaccgcgggcgctcggcaggcccctaaccacagccagcgtctcaggcccctgcctggcccctcgcacacctccaggccgcagctcgcagacgtagctgtgcggcgctgagcacaggtcggtgttacaccacccggtgggcccgagccggacgcagtgctcggctgtggctgggtgtggctccccgggcagccagttctggcagctctccaggctgaaggcctcgccctgcggcgctgggcccacctccaccccctgcacagtcgagaagccgatccacatgtctaggctcctgggggcgggtgtgggatggcagggggctcagggcactcctccatcctcccaccctcacagcagcccgctgggagccccgtcactgtccccctttccagatggggaaactgaggctcagagcccggagagcagggcccaccagcccaggctcacagcagcacccacccacggggcctgtgggcaccggcagggatccccgtgcaggccacctcccgtatggcgtgcccaggagtgtccggaggctgcccccagctcgcgtccacctctgcatctgcagagctgacaggaacggccccaccggccggcgccacctgctcaccagggccggcccagctcccacctccctcctcctgagactccccagccgcaggctctgccccactgcttcagagatctcccaacctatggcccctcggggggtggggcaggcacctggtgacccgggagaccaggaagcgctgcacggcgggactgtccaccattgccagggtggccccggcccaggcccgacactgctcctgcgcctgcagccaggccgccttctccaccaccaggcggtagcagtgcccattgccagagaagatctccgtgtccgaggggcagagcgggtgcaccgctggagaccagtgggaacgagggtgtcaacggtcagtgtgggcccaagacgggggtaccaggctctgccccatctggatggccctggggaggaaggggagtgggcagcagacactcacctcgggccggctcctcgcccagggccacgatgctgtaggcggcctccaggcctgaaccaccgcggttctggatgctgaggtcgaggctctcgtcactctgcaccgaggacgggcacacgagctccagggcggcaggtgccgcttccacctgcacgtctgtccccagcagggctgagccggtccccagggccagcacggccgtcacgtgatagcgcccaggcagcacatagcgatgcgaggcagccggcccagcggcatccacctcgggggagccgtctccgaagtcccagcgtgtggcagtgacagggagcggggcagcgatgtggaaggctgctagctggccggaggccaggggtccgtggggccccaccagggtggcccctggggaggcagggaagacgtgctggaggagggtggggcccctacaggtgggggcaggaggcggcggggggccggagcagagggacaggcaggcgaaggaggcactggagggctgggctgacccacacaggcaccagccctgctcggagagggctgcgaggccctggccggtggagaagcagaaggcgctgcaggcctctggctgaagcaggccttcgtgggcagctgaaaaggacactgctgccacggtgcctgagctgttgtcagggaggcaggcgacatactcctcacctagaagaggcagccactggaccccgggttctgctcctcctggctccaccccacacccccccatccgcccgccgcactcacaggctcccatgctgttcccttggcccggaggccccccccagagaggccttcctgagccctgcccagtgtctgcagggcccaggtcccacctggctgggaaggacagagctgccccacccaccggcactcaccacagccactgtccagcaaggggatgccaagcagaggctggccagccagggagccaggcccagcacacgtggctgcctcgggctgcaccacccgcacctgctgctcctccgcccatcgcggcagccacgccaggccacagtcacactcaaacgggttcccactcaggtttctgcggggcaggggcaggtgttggggaccaggtctggtgggaagggtctatgccagccccccactggcaaccaggccctggagccaccctgacagcaccgcctcccctgccccaaccaagccggcactggggggctccaagcaggtagtgaactgcccccaggatctggtctcaagcctggaaggggacacggaccaactgggagggcagaagggatactgggggcctggggtccagccaggaccccacccaaagaaccacaacttacatttcacttaaattaaataaattagcaaatattccttcttctaacgtagaaatcttgttgttgcttatatccctggaagagaggggggattcggcaaagctgacggaagcccccacagctgagcagcaagaggcggtgccgccagcccacccggagtgagccccgcatgctggcacgactgggggacactcacagctctgccagcgccgagaggttcgccaggagcccaacgtccagcgcccggagcaggttgtgggagacgtctctgaggagtgagtggccgtgggtcagggccagagcccttagtaggccagaggccatccctgggcccatcccacacattgccagcatccccaagctatggcctcccacccttgagctccccactcccagaggtcaggaggggcctttctgatggaagacccaaatgaacactcatctggggaaaccaagccgggagaggcctgggggcctcagccctctgcacccatctcagccctatgccgagtgccacctggacctgtccacccagggccaggaagggcacggacccccaacccatcccacgcagggccaaggccccccatcccctgtccacagtcccccacagagccaaggtctcccaaccctgtctacagcccccacacagactcgaggggcccccatctcctgttctgaacccaacagggtggtcccactgtgggaccacaaccaggtatgactgtgtgagaagcaggctcactaccaggctaccagggagcacagcggagcaggcgccaccttgaggcataaacccagagaaacaagacctccaagacggccaggcactggggcacacgccggtaacacagcaccgtgggagctgagacggaaggatcgcctgagcccaggattttgaaaccaccctgggcaacacagtgagaccccgtatctacaaaaaaatacacattagccaggcatggcggcatgcgcctggggtcccaagtactcgggaggtagaggagagaaaaatcacttgagcccagagaggtcaaggctacagggagctgagatcgcatcactgtactccagctggggtgaaacggcgagactctacctcaaaaataaataaatacatacataattaataaataaaacatcaaagaccagccgacctaactccatctaaaatacacaacttctacgcaaaatataaataaaattagaaaacaaactacaatctcagaaaagcactagcaacttagacgacatactaaaggccaaaaataccctcctgacacacagctaataaagaaaaagtcaactattccagttaaaaagaagaaaaggaaactggctgtggtggcttatgcctgtaatcccagtgctttgggaaggccaggagtttgagaccaggatggacagcatagcaagaccccatctctacaaggaaaaaaagaatcagccaggcatggtggtgtggagctgtagttccaactactcggggggctgaggaggaaggatcgcttgagccagggaggtcgaggctgcagtgagctatgattgtgccactgcagtccagcctgggcgacagagcaagacccggtctcgaaagaaaagaaagagaaagcaagaaaagaaagatggctgggcacggtggctcactcctgtaatcccagcactttgggaggccgaggccggcagatcacttgaggtcaggagttcaagaccagcctggccaatatggtgaaaccccatctctactaaaaatgcaaaaattagctgtgtgtggtggcaggcgtctgtaatctcagctactcgggagactgaggcaggagaattgcttgaacccgggaggcggagtttgcagtgagttgagattgcaccgctgtattccaacctggacaacagtgccaaaccctgtctcaaaagaaaaaaataataataatataaagtgaccaggtgtgttgactcatgcctgtaatcccaccactttgggtcgaggcaggagaatcactggagcccaggagtttgaaacgagcctaggcaacagagtgagaccctgtctctatattaaacacacacacacacgcgcgtgcacacacacacacacacacatacaaaggcagccagactatgcactaggaactgccctgggaatccctttgtgttctcacaacaatcccatttcacatgaagaaacctaggcacagaaatattcagtaacgtgtccaggtgtggtggctcacgcctgtaatcccagtactttgggaggctgaggcaggcagatcacgaggtcaggagttcgagaccatcctggccaacatggtgaaaccccgtctctactaaaaatacaaaaattagctgtgtgtggtggcaggtgcctgtaattccagctactcaggaagctgaggcaggagaattgcttgaacccgggaggcagaggttgcaatgagccgagatcacaccactgcactccaacctgggtgacagagcaaaactccgtctgaaaaaaaaaaaagaaatattaagtaacttgtctgaggccacatagttaccaagacgtgggagctgggacttgaacccaggcagtctggctggattcatgcctgcagcctctgcactcctgctacttactgtgtgagaagcgtctgttctgtggaaggttgtgggctgagatctttccatgacttccactcatttacccccaaggctgttcttaaagacgggcatgacagttatgcccattttacagatggggccctgaggctcacaagggcacaccattcacccatttccacaaagctatagttagttagcagagggcagaattcggccgcctctcccctagcttgaaggctgtgattgacacagaggtttttttgttgtcgttgctgttgtttgttcctttttcttttttttgagacagggtcttgttctgtcatcccggctggagcgcagtggtgcgatgtcagctcactgcaaactctgcctccaagatgcaaatgattctcgtgcctcagcctcccaagtagctagaattacaggtgtgcactaccacgcccagctgatttttgtagagatggggttagtagagatttgtttaatagagacggggtttcaccatggtctctactaaaccctgtctctactaaaaatacaaaaattacccaggcgtggtggcacatgcctgtagtcgcagctactcaagaggctgaggcaggagaatcacttgaacctgggaggtggaggttgcagtgacccaaaatcatgcactctagcctggggtctcgcttttgcccaggttagagtgcagtggcacaatcatagtggctcactgcagcctcaaactcctgggctgaagggaatcctcccacctcagcctcccaagtagctaggactataggcatgtgccatcatggcgagttaatcttttgtgtgtttttattgtctcgagacagagtcttgctctgttgctcaggctggactgcaatggcgtgatcctggctcaccgcaacctccacctcctgggttcaagcaattctcctacctcagcctcccgagtagctgggattacaggtgcgtgccaccatgcctggctaatcttgtatttttagtagagacagggtttcgccatgttggtcaggctgctctcgaactcctgacctcgtgatccacctgcctcggcctctcaaagtgttgggattacaggcatgagccactgagcctggcctggtgaggtaatttttaaatttgttatagagacaagagtctctcttatgttgcccaggctggtctcgaccccctggcctcaagtgatcctcccacctcagcctcccaaagtgctgggattacagatgggtgtcaccgcacctggcctctgaggaggatttcattataaacctgccctgaagggagggaatccaattttacgagagggtgtagcctggtgaggcctggatgacctccggaggcaggggcttgtgcctgggctgaggcctaagggacaatgggcagacatgaagttgccccaggcagagggtacagtgtgggcaaagtcaggaagtggcagggcttggatcactccaggaagagagaggagtcatgtgtcacaggagctcaagacccagagagggaggcaggcaggcaggcagggaccaagcttgggcacagccaggaaggcagagggcatggtggggccaatggaatcattacccaagacggggattttcagggaaacagcttagataaggccaggtgtacagtagctcccacctgtaatcccagcatttggggaggctgaggtaggaggactgcttgagcctgggagttcgagaccagcctaggcaacatagtaagaccccatatccataaaaaatttaaaaaaggagtttgtgttcctgtagtagcagacttgggaggttgaggtggcagtatcacttgagcccaggagttcaaggctaaagtgagctgattgagccactgcactccagcctgagcaacagagagatacgctgtctcaaaggaaatacaaattaaaaaaccagccgggcatgctggcgtgtgcctgtagtctcagctacttgggacactgaagtgggaggatcgcttgagcccaggagttcaaggctgccgtgagctatgattgtgcctctgcagtccagcctgggcgacagagaaagaccctgtctcttaaaaaaaaaaaaaaaaaaaaatcttagataagaggatgctgtgcctccctgggggtcttcagtcacccatagtcctggcaagagaggagggccaggagagagcttcacccacctgctgtcctgcccatgtgacatccgcaggtgctgccatggccacgactgttgttacactcgagctgaggaggccggctgcagccccaagacagagcgctactcctggcagtgcgtcaatcagagcgtcctgtgcggtgagtccccagcagcaccatgccacccaccccgagtatcccctgggcaccctggcatagccagatgacttccgtgcccctgttgcaataaccactgcttccaagtctctatagaccaccccttgggtatatctaatgtaagtgatatttattttatttattttttgagtcagtctcgctctgtcacccaggctagagtgtgctgatgtgatctcggctcactacaacctctgcctcctgggttcaagcgattctcatgcctcagcctcccaagtggctgggactacaggcatgcaccatcacgcccagctaatttttgtattttttcagtagaggtggggtttcaccaagttggccaggctggtctcaaactccccacctcaagtgctctgcccgcctcggcctcccaaagtgctgggattacaggcatgagccgtggtgtctggccctaatgtgagtgatctttaacactgagcacttgaaaaagaaaaccctgaagaaacctaattctttgatgtctggatgacaaggaagaagatagaaatggcatcagataataaacagtgtaaatgtttatcagaaagaggctggtggtcgggacaagtaggaggattgcttgagtccaggagtgcatctctacaaaaaagttaaaggattttttaacattggccaggcgtggtggcacacatctgtgatcccagctacttgggaggctggggcaggaggattgcttgaagcccaggaggttgaggctgcagtgagctgtgatcgagccactgcactccagcctgggtgacagagcaaactccagtctcaaaaaaaaaacaaataataatattttacataaccaaccacttctaaagattaaaaaaacccctacgattaaaaacctcaggtccctcaggcaatcataccagatattgaaacaaagcaataacataaggactgcagtattcattttatttttatattatttatttattcttccttagtttcttgagattatcatccgctgagggtggaaggggagtgagcagacacactcaggaggtgtcttgagattatcatccgctgagggtggagctgagggtggaaggggagtgagcagacactcgggaggtgtcttgagattatcatccgctgagggtggaaggggatagagcaggcactcggcaggtgtcttgagattatcatccgctgagggtagagctgagggtggaaggggagtgagcagacactcgggaggtgtcttgagattatcatccgctgagggtggaaggggatagagcacacactcggaaggtgtcttgaggctcagggagttatcaattatagaatgttgttgagttggaggaggtggctggtggcccatcctgttttttaaagtttcagctgtgaggtagggccagtagggcaatcctgaagaatgacgatgctccactgccgccattctgacctgtagggccaaaggagggaatgttttcacacatattcatttgatggacaaaattaccgccaccaacacagtctgcaccttctgttgctggtgatagatttttgcacctttccatcctccaggtttcaaaatagcagtgtcagtgtcataatatcacccttccactgagtactgccgacagctagggggtaaagaaaagtcattgggacacactgttgtctccacatgccactgtgtctgtctgcaaatgtaggcaggctggggtcctgccccagggaagacagagtcataacagagtaataaagaagcatgtttgagacacaggagtgtctatgtctatcctcattcctccctcacagccatcaccagagcatgtttcttgcaccaggtcaatagacagtaagagacagtaagagaggcatgaaaagcccattgtccacacatgttgcagcttctttttggagaatgttttccaggccttttatgttctgtctctgattctcagaactctgcaaggtcagtgtgaccaccctgctccaaatctaagaaaacagaggtttccagaggaaggagaaattgtgcccagggtcacacagcttgcaagaggcagagtggaagttgattccagctctgcctgcaggaccctctcatttcccctctgtttcccttcttgacaaaggatcttcttcactctggaggtgccacccatgagaacaaagagctctggagagatgtggattcctgaagagctgcaggggaactgggagagggttttctgacagaacaatcttacctcaagaagtcagttaggcatggctgtaatatttcttttcactcccaggtaataccaaattgtaagtgcactaggacataaagaatacttttgtccatggaaaaatgaggtgggaattctaaacaaagcaagttttaaaactgtgtttcacttcaagtgtacaagtcccatcgcgtgtaatcataggactcggcagcttttgaaggtacagaggccacacaagaaccagcttagctgagcatcatttaaggccctcatttggaattgtccctgtgggtaataagttacattcactcttcactaatttacagtcagggcccatttgctattacaaatacggaacctctgacacttagaatattagatgggggccccactgggtggggatgaaggtgtttttgcgcaacacagttaccaacagggatgggactgtgatgcttgtaggcagccttcctctctgccatctccctctgcagggcttgagcacagagccgtagggagaaaaatgtatccatgtcctgacctggcagactatgtccaaaagcaaggaaaacaagcaaacttacccggttgcaaagaggctttcttgcagaaggggtgatctgaaaaagccaacacatgagaaattgaatgttgagagagtctaagggccgtggcatcatctgcatcagcactgaactatcctgcaactgcggggaggaagctccttactttgcatctgtagtagtcctctgcccgccgccgcaacgcttgcgcacgttgaaacatttccctatggattacaatcactttcatcagataaagcaccactttcaggatgattttaaataatctgccatgtttctgttatcctcacaactgtacccttacacaatctatctctacctagaaaacgtatttcagatggctagaagagtacagtctgagccggtcacggtggctgacgcctgtaatcccagcactctgggagggcgaggcggatggatcacgaggtcaggagattgagaccatcctggctaatacggtgaaaccccgtctctactaaaaatacaaaaaattaggcgggggtggtggcaggcgcctgtaatcccagctactcgggaggctgaggcaggggaatcacttgaacctgggaggcggaggttgcagtgagccaagatcacgtcattgcactccagcctgggtgacacagcgagactccatctcagaaaaacaaaaacaaaaacaaaaacaaaaaaaactgtacagtctgatccaaactgttgctatattgattcctcctcttgcttactgcctgctgacttctgagatgatagtttccttccccattctcagtatatccctaattcatccttcattgagcatcttttatcataaagctgtattctctttgtattaatatctttaccgtgtttcacagggcagaaacagctgggcttataaacaggcatagtccttttgaaggatgtggttgatcctacaacaacacactttcctaaggatgacaacaactcaccccacccctagaatggctggtatgaaccgagtttccacacagtctagctggcaatggggtcaggagccgttttgctacttcacatcttttggtcactggtaaatattaaggtactttgttttctgttttgtgaactctctctctctcacgatatgtcttctgaccatttgtttctatttctgcatttactgggtctaaacattgtacaaaggttaaaaacaacactccaatgggcgtttcccaagagggtggggttcagtttctgaactcacatgtaggtgtgtatttctttcatatccaatttcccattttcctctgcctctgacacctgcctctccttttctccgtgctcacgttctttcatgcttagtttcctcagactagaagggagagaaatgcacacacatgatccaccagcacgtgtgggattccctctgcccttctggcatctgaaggctgattcaaagatcccccctgcaaccttcccacaaatgaaccaactgattctcacaaccgaaggaagaatggacacctcccattgagggacaaaaaaaaatcacactctggcctgctggcaagtcacctgtcatttccagctcatcttcatagttccatagttagtcctattctttagtaaatataaagactattaaaagcttctatgaggtgcactatgtgcgtctctggggtcagtcttgtgcttgacacagcgaaagctcattttagttcagtgtgaaaaaccagacctcaccaattcatcacaactaactccatcggaagcagaggattgctcctcatctgactcctcctgtgtgagacctgattctcagtcagaggctgatgccggaactgagaccatcagccatagagagatccttccagaatatggtgtcattaaccccgcagttcactactgcactttgccatgattcaggactggaactcttgtcatcgactttaaagatcctgaaaaggcaatctgaatgctgggcgcatctattgaattagaaatgatcggaatggctcctaagtcaggatgttatgtcctgaaaataggtgacaacggcaaaccatccaccctggtgttgactgactttaacaaggttcagttcacagagattgagggcagaaaaaggaaacggcctcaaaagggtaagtttgctgtgttgccctcacaccacttgattcatggtcctgatcctaaggatctcacctgatacttggttttataggaaggatgtgtaaaattcccagaacgctaggaaacagggacgaaatcacttcaaagagaaagttaatgaacttgtttctgaccacagggcatccttcagcacatgctgtctggagtggcctcaaacaaggtgtgtgtggtgaggtgctgacaatgcaatgggagcagggtcctgtccccacgctaaagaagctcacagtttaatgcaaatgagaagccagtgaggacagcactactcctgctgtgcacttgggaactagaaacacaaaacctgactctggagggaagctaaggaagcattctactcttgagttgacataagtgcatctgaagcttctgatctccgatgagaacaatgggggacaccaaacagaatataaaacccatgattgaatacatcaaattgctaacatggcagtaaacagacatgaggtgaagatggagaagaaggaaacccaggacgaaagtcagcctcgcatttggaacccatttccctgagtttcattgctgaattccagaaggaactactgagatgcaaagaagcacagcagcttttgcacacatgcgtggggttagatggaaaacaagtggattgagggtctgccaatgaaagcgatccatactgaagtccactggctctggttgagacccagaagagtcatgcatcagaatagaggtggacaggaaataccctggcctttgtagggactgagcctgcagagacgacctcaattgcagcctgtacggaggacccctgaccatcccccagaagtagactcccatctcttctgcagcaagataacatgctactaggcctcaatgcattgttaaatattttttaaaaagtatctcacatttaacaaaaaaagatcagtcatatggcagcaaaatacaatgtagtatgaccaaaacatgaaagactgtgaaaatgaatttggaggtgacccaagcattgaattcaacaatccaggctgggtgcggtggctcacactgggaggctgaggtaggcagatcacctgaggtcaggagttcaagactagcctggccaacatggtgaacccgtctctactaaaaatacaaaaattgggctgggcacggtggctcacgcctgtaatcccagcacattgggaggccgagttgtgcggatcatgatgtcaggagttctagaccagcttggccaatatggtgaaaccctgcctctactaaaaatacaaaaattatctgggcatggtggcatatgcctgtagtcccagctactcaagaggctgagggataagaatcgtttgaacctgggaggcggaggttgcagtgagccaagatcatgccactgcactctagcctgggtgacagagtgagactctgtctcaaaaaaaaaaaaaaaaaaaaaaattggccgaatgtggtggcacacacctgtaatccaagctactcgggaagccaaggcagaattgcttcaaactgggaggcagaggttgcagtgagccaagattgcaccatagcactccagcctgggcgacagagcgagactctatctcaaaattaaaaaaaaaaaaaaaaagcctgggtgtggtggctcacacctctaatcccagcactttgggaggctgaggcgggtggattacctgaggtcagaagttcgagaccagtctggacaacatggtgaaaccccatctctagtaaaaatacaaaaattagctgggcgtggtggtgggcacctgtaatcccagctacttgggaggctgaggcaggagaattgcttgaacccaaaaggcagtgagctgagattgtgccattgcactacggcctgggcaacaagagcaaagctccatttcaggaaaaaaaaaaaaaaagagagagagaaaggaaaaccaatgccagtactagcaactcctcttcccctgaaaaaatgacaaacaagaatgtaggaagggaaaggaattatacagcttaaactaatgaagcagaaaggacaagctcaattttgaacccactgaatttgccacaaatattgtagaaaatattctcaaggactttacagttgtctactttgattggcacatggttcatacaacagtatttgtgtcaaggcacatcttactgttctttggcggtcttcctctttccattgattttgtcatgacggttgacttttgttgtcaccttcatcttacggattttagctcgaactttggtttccacctgtctccataaagtaaagatgtcttccaggacaattttaattcctggaaaggaagaaactcttttctttgtgtgcatacaaacggacctcagcccttggtgagagtgaggagaggagaaggtgagaaacctgagggcaagaagctgttctttccctttccagggcaaactcatttccacactatggggactccaacagagccataccttcctgtctacggcagttggacctcctggctctctgctgtacatccgtggatccatcatgtccattttgagacgggaagatagtcttcaggaaagacacctaggaaataataatataagaatgacggctgggcacggtggctcatgcgtataatcccagtactttgggaggccgaggcagggtggatcacggggtcaggagttcaagaccagcctggccaagatggtgaaaccccatctctactaaaaatacaaaaattagccgggcatggcagtgggcgcctgtaatccgagctactcgggaggctgaggcagagaaccgtttgaagctgggaggtggaggttgcagtgagccgagatcacaccactgcactccagcctgagtgacagaatgagactctgtcacacacacacacacacacacacacacacacaacacaacacacaagaatgacatgaggctggcatggtggctcactcctgtaatcccagcactttgggaggccgaggcaggcggataacctgaggtcgggagtttgagaccagcctcaccaacatggagaaacgctgtctctgctaaaaatacaaaattagccaggcatggtggtgcatgcctgtaatcccagctagtcgggaggctgaggcaggagaatcacttgaacccagcaggaaaaggttgtgttgagctgagattgtgccattgcactccaacatgggcaacaaaattcaaactctgtctcaaaaaaaaaaaaaaaaaaaatataggccaggtgcggtagctcacgcctgtaatcccagcactttgggaggccgaggcgggtgaatcacaaggtcaagagatggagatcatcctgggcaacatggtgaaaccccgtctctactaaaaatacaaaaattagctgagcatggtggcccacgcctgtagtcccagctactcgggaggctgaggcaggagaactgcttgaacccaggaggcagagggtgcagtgagccaagatcccaccactgcactccagcctggtgacagagtgagactctgtctcaaaaaaaaaaaaaaaaaaaaatgacatgaatatacttcacacaactgaactgtacacttcaacacggttagatggtaattatcatcttgtaagtattttaccacaggttaacatgtttcacaacttgaaaaggaagtaattaattaccttcagctctctgagttctagaatttgtaacatttcaccccctgctccttcctgatctgcactggagcatctttcttctgtccctgctctactcagagttcactttcccttccctcacatcagcttcgttgaggctggtttgaacttaacgcaaaacattctcactaatgactgaattcccaccaagatttccatattatcacagtatgcttttaatcttcgaagatattaaatatttgttctcatcatagctaaaatgcaatgcaaatcccatctcagatgtgggtcagatacctatgaatctcctgaggtagtcattgaaatgacttttttcttgagacggagtgtcactcaaccatgctgaagtgcagtggcactaccttggctcacggcaacctccacctcccagattcaagcgattcttgtgcctcggcctcccaagtagctgggattacaggtgcctgctaccatgcctggctaatttttgtctttttagtagagatggggtttcactatgttggcccatctggtcttgaactcctgacctcaagtgatccacctgcctcagcctcccaaagtgctgggattacaggcatgagccaccacacctggcctgaaataatatctttcaaattctttgtagaacttgttttttcctgatttctgcacataggattaaaaaaaaatcatgtactaggatttcaagagaagcaatgggtaatctaaaaagatgaaaagagcaaccacgtctatcccacagctactgctagatttcataggaaaggtagctggcccagtttggagctaggagaaatgtcaaacacatgaagaaatgagaagcaaagaaatgccatcacacatgaatgcttcatggcacccatgatgtccctgcttaggaggtaatggtatagatgactagatgacaaggacaaagatgagaggtgcaaagttgtccaagtccaacagctcaactgaactttcctaaatggaattgttaaaaagtggtaaatttaaaaacttcccctggctcacgtggtgactcacgcttgtaatcccagcactttgggaggctgaggcgggtggatcatttgaggtcgggttttgagactagcctggccaacatggtaaaaccccgactctactaaaaatacacaaattagctgggcatggtggtgggcacctgtaatcccagctacttgagaggctgaggcaggggaatcacttgaagccaggaggtggaggttgcagtgagccgagatcacaccattatactccagcctgggcaacagagggagactcctcttgggggtgagaaaagaaaaaaaaaaaagcttcctccaatttataccgaaaattctctgttcaggactaagtggcatagagaatgttaaatgtgcctagatatcttcataactcatatattttctgttttctacatatcttgaaaggcagtgccaaatgacgtgtaattatctaggcggtaaaactgaaacatacttcctcttcccttgaatataaaaaagcattgtggtttagtacttttatcttggatcattgttcagaaggaggttcagcccccacacaaccacatttttattgtcatgaatggcaagacaaaatgtagagctcaacttacgcaaaggataaaaggctcaaaagacaaattatgccacaacttagcagccaaattcttaccaagtatagacttttgacatactgatctcattccagttgcaagtgggaacatgcactttgaatgatgtcattcaaaattaccctgcccagacacacttttcattgattctcttggagggcagttctaagagattctctggggctttctctgcatcatgagacgcagtgcagttctgcccttcaccttccggcagtttgtcacctcgtccctatgacctcagaggaactttgtctcaggccaactgtttgttccttgggctctttcatttcccctaaaaatcatttgctgcccctctaaatggcctacatctccatctatctccctctaccctcagaagagggtgctctttaagcatcaaccatccagcccttctagcagtctcatttttcagctggttcccatgtttatgcctgttctatgtttttcttttcctgttaagctgtctgttgtcagctcatttctgcagtgaatcttcagagaggagattggaagctttccttccacccatacgatagaactataaagcagaagagtttagaaagactttcccatttaagtgacgaaatctcatactccatttgtgacaaatagcacaaaggttaaaaaaacttatttttgaccaaaagctctgttgacattctattaaacaccgacctatttaattttcataatgtaaatggcagatattttcataattcttatgctaataaatcatttccctgattttttgggtaaaaccacatattcataatgaagtccagaaacgtgaattgtttcatataatttattcttatttgtgattacaagtatacctctacagaaagttagtatactcacacaaaggtaacttgtgcagagggagatggcaaatttataacttctcagaaacacagtaatgataagtaaccaaggacttccaccaaagtcagtcccacgatgacgatggtcagccagagtattgataacctggaataataatagttgaaataatgaaaaggtcaatgacactgacaatatttcactcagaaagaatcatccttagaaaccgtcaacctcctccaaaaggtaaccacatccctcagatatcaccgtgggattccactgctacaaaaaagaacagaagttagagaagtctcatgtttttcagatggctggtagtgtttttaggcattgcaaatgtggggtgttgtctttcttggtataaagcagggatatccaatcttttgacttccctgcctatattaaaagaagcaaagttgtcttgagccacacataacatacactaacactaacaatagctgatgatctaaaaaaaaaaatttttttttttttttttgagacagagttccgctccactcagtcgcccaggctggagtgcagtggtgcaatctcggctcactgcaacctccagctcctgggctcaagccattctcctgcctcagcctcccgagcagctgagattacaggtctctgccaccatgcccgactaatttttgtatttttagtagagatgaggtttcaccatgttggccagtctggccttgaactcctgacaggcgatctgcctgcctcggcctcccaaagtgctgggattacaggtgtgagccaccgtgcccggccattttttttgtttttgtttgttgtttgtttttgagatggggtctcactctgtcacccaggctggagtgcagtggtgtgctctcggctcactgcaacctctgcctctcaggttcaagtgattctcctgcctcagcctcctgagtagctgggagtacaggtgcctgacagtgcactcagcaaatttttgtattttttgtggagatggggttttgccatgttggccagggtggtctcgaactcctgacctcaggtaatctgcccgcctcagcctcccaaagtgctgggattacaggcatgagccactgtacctggccaaaatctcctaatgttttaagaaagtttacaaatttgtgttgaactgcattcaaaactgtcctgggccacatgcagcccgtcactcatgggtaagacaagctaagtataaagtaattatcttatcttttatttttgttttgagacaaagtcttgctctgtcacccaggctagattgcagtggcatgatctcagctcactgcaacctccgcctcccgggttcaagcgattctcctgcctcagctactgagtaactgggattacaggcgcctgccaccacgctcggctaatttttgtctttttagtagaaacagggtttcaccatcttggccaggctggtctccaactcctgacctcatgatccacctgcctcggcctcccaaagtgctggcaatacatgtgtgagccactgcacctggccagtagttatcttttctttagttatttacttgttttttaaattgatgtataacattggatgcatttattatatatcacatggtaaaagaatccctctaaataatacttctctcttggattatatgaatctttgtcatttaaagctcagcataagtaaaaaaaaaaaaaaatacaatgaagagattacttcattcacaaataagtatcgaattttagttcttaaaaagtaacaaggtgggctgggcgtggtggctcacgcctgcaatcccagcactttgggaagccgaggtgggtggaccgcgagatcaggagattgagaccatcctagctaacacggtgaaacccatctctactaaaaatacaaaaaattagcagggcatggtggcacgcgcctatagttccagctacttgggaggctgaggcagaagaatcacttgaacctgggaggtagaggttgcagtgagccaagatcgcaccactgcacttcagcctgggtgacagagcgagactctgtctcaaaaaaaaaaaaaaaaaaaaattaccaaggtggagatcatgaaaatggcatgaatagcgtgggatttctctaagattgttgatattaattccattagactcttatgtgagtgaagacgaagacttcccctgagtaagttcagacagcttctgataacatttctacatcgattcctcaggatttaactatatattcttgaaaacatctcaattttaaatgtttctttcaagatggtgaattaaacagagatagcccttcaacaggttgaactcagcatatgctgagtctgaaatggaaatgatggagttagagaaccgtacaacaatggtaatgatttcagaaacatggtgttgagcagaataaagcagacacaaaagagtacctatggcatggcatgcatctgtatacgcgaaattccagaataagcaagctaagctatgataagaaagagactggctgggaagagtgagagttcactttctggggtgacataatagtgtagatcttggctgggcacggtggttcatgcctgtaatcccaacactttgggaggccgaggcaggcggatcacctgaggtcgggagttcaaaaccagcctgaccaacatggagaaaccctatctctactaaaaatacaaaattagctgggagtggtggcacatgtctgtaatcccagccactcgggaggctgaggcaggagaatcgctcgaacctgggaagcagaggttgcggtgagctgatattgccccattgcactccagcctcagcaacaagggagaaactgtctcaaaaaaataaataaataaataaaataatgtagatcttgaaagggggttggtttatgctggtgtatgtactttccaaagttagtaaacttacacttaaggttatatattttggccaggcgcggtggctcacgcctgtaatcccagcactgggaggccgaggcaggcagatcacgaggtcaagacatggagactatcctggcgaacacggtgaaacccagtctctactaaaaatacaaaaattagccaggcgttgtaatctgagctgctcaggaggctgaggcaggaccattgcttgaaccccggaagcggaggttgcagtgagccgagatcttgccactgcactccagcctgggcgacagaatgagactctgtcttaaaaaaaaaaaaaaaaaaaaaaaaaagtcatcaaaccagatgacacaaatgaaatgacatttcactttgttttggtccgttttgtttgttagagacaagagtgcagcggggccatctcggctcactgcaacgtccagctcctgggcccaagcgatcctcccacctcagcctctccagtaactgggataacaggtacgcaccaccaggcccgactaatcttttttggaattttttgtagagatggggtttcgctatgatgccctggctagtcttcaactcctggactcaagtgatctgcccacctcagccccctaaagtgctgggattacaggcctgagctgtgtaatttcatgccgcgtgacacagcccagtaaaaaggaagaaaccccgcgggtccagcgtctactcacacaggtggactgatggctgataaatcccagcaggagccaaaagagcagccacagcacccatctactcacacaggtggactgatggctgataaatcccagcaggagccaaaagaggagccaaaagagcagccaccgcacccgcatgtcctggtcctttcagggcgccctgaggcagccaggacagaggtggaggtggcttagggcaggggggagggaaggggacggggaccgggcccgatctgagttggggagggggaggggagggggaggggagggggaggggaaggggaggggaaggggggaagtaagggaagggaaaggaggagaagggggctgttggggaggaggaggaggagaagaagaaaggggtctgggaaaggatccggttcaaattaagttctcaagcgctggtggaaggtttagctacaggtcacggagaagatcagggaagcaacaggacaggcggggcaagggagcgtgaggcttaggagcaattaggagacaaaggttctgctttccaccaaaccttcttcggtctgggccctcccttagcaaccctggggctttagactctctctccaccaatccctgatgaccccggtggtgcctcacaatggacattccaagtagcgcccgcatcatcccaatgacccctcccccttctcagtcccccacgctcctcccaaggccaggtcctctctggaaccttcacaaacctgatttctggtcctccccaaccagctccctgtccctgcttctgggtgctccttccttcctgagctcccagggttcctcaaggtcacttttggcgacaaaacataaaaaacaaatgatggcaggatggcaggaagaacctcatacccaagcagagtgccaggttttacagcctccgctcagccattcatatcctaagcaacaaaacatcagcaggatgcggaaggtcccgatagtaaaccatctccatcacatccatgtagccatccgtccatcaacctgtatctcaggaacaaatgtacatacattcattttaagcatgcatggtacatttacaaaaattaacctgacttattttgttccagcaaatctcaatatatttgagagcaatcaaatcacacagcatgtttctgatcataaaactgtgctagaagtcaatgattaaaagctaattcaaaattattatttgcttggaaattcaaagtgcccttataagacataaacataagaaagaatccaaaatgaaacaagattgcctttcaactcaatgatgagatcataacatggcaataaaatgtctccctctggcctgggaattcctctttgtggcacaaggttgtgtgatctcaaatcacccctaacccacctagacattttaacatccgaaaccgagtgatgatgtccttatctatatcatcttactgcccgtgtgtgtggactttaaattctgaacccaaatgagggggagaaaaccaagctgactttcatgactgagctctcagggacgtccaaggaatctgtgcatttcaagaaacaaagttcatcagcttctctcctaaggtatttgcccacaatacccagagggcttggcagcatcatgtgtgatgggtggggagctccaagcaggtgggcaggacccaggggcctggtgaccaggacagacccccactgtccatcacctttcctggccctgtcctcagctaaacttcccacaggccttctgcccgatcacacagagtgtgcccaaactcaggcctctggcagctgaaaaccactgctttaaatccctttaccatttactatgacataaggttattgtaaacaggaaatattctattgatgctacaaatggaaagccaatgcctttaccataaatagaaaaacaaccctaagaagcaagcaaaacaaaaacaaaacaggggctgggggtggtggctcacgcctgtaatcccagcactttgggaggccgaggtgggcggatcacaaggtcaggagttccagaccagcctggccaatatggtgaaaccctgtctctaataaaatacaaaaattagccgggtgtggtggtgggcgcctgtagtcccacctacttgggaggctgaggcaggagaacagtttgaacccgggaggcagagtctgcagtgagccgagattgcaccactgcactccagcctaggcgacagagcgagactctgtctcaaaaacagcaacaactacaaacaaacaaaaaacagggttaacaaaactatggaattcaattctatttatatgctgcagccatgttccagccctagatttggctgggcatggtggctcacgtctgtaatcccagcactttgggaggctgaggcaggcggatcacgaggttaggagttcgagaccagcctcaccaacatgctgaaaccccgtctctaccaaaaatacaaaaattagccaggcatggtggcacacgcctgtaatcccagctactcaggaggctgaggcaggacaatcccttgaacctgggaggcggaggttgcagtgagccgagatcgtaccattgcactccagcctgggtgacagaatggaatgagactctgtctcaaaaaaaaaaaaaaaaaaaagaagaagccctagatttcggttgtgttggttgtaaaaggagagacccagtaagtgggggtcatgccgcagattgctacccacaatggacgggtcactgagcaggtccggccaactgggcgttccctcgctggagggccagcacaccagactgcaggtggcgcgggtcagcaaggtaccaggggatgtgtcacacacacagcccacccccgtccagtcacgcacggacaccctgggcttccgagcaaacctgctcccaggtggtgtgaccacatggagccacagacacccagcaaggacacgcagcccgcacacccccggtactccagacacagtgacctgcaccagggctcgaggtttctctagggaacccacctcttagaatcatccagaaacaagtcactcttcatctgtccagcaaaggcctgctgagaggtgcacagggtcttgagtccaagctgcgccaaggcggcaggacccccagtagagccctcacctcagcgtggaggcctgagaacgtgaggaaggagctgtccagcacggatgagtccaggcagctgtcgacgtccagcacctgctgcccggcaggtgtggggctcgggctcccagccacctgcaggacaagggcagtggtcagcgggcggcagctcagacctgctcaggacagggatgagaagccacctcctcagcagacaggacagagcccggtgccatctgacagaatgtcctagaatgctagatatatgggacatctgcaccgtccgtgatggcagcccctcgcgacatgtgccactgaacacttgacagcagactggtgcagctaaggaacagagttttaaatttcattttttttttttttagatggagtctcgctctgtcacccaggctggagtgcactggcgcaatctcagctcactgcaacctccacctcccgcgttcaggcgattgtccgtcctggctcagcctctttagtagctgggattacaggtgcctgccacgatgcccagctaattttttgtatttttagtagagacggggtttcactgtgttggccaggctggtcttggaactcctgacctcaagtgatctgcccgcctccgcctcccaaagtgctgggattacaggtgtgagccaccacacccggccatcgttccattttaattaacttaaatacgagcagccacatgtggcctctggttcctgccacggactcgggagcaacccctcctggtcgcggcttatgcgccttctctgtgtgctgctggggttagtttgcatgtaacctcttgaggaccccacgtgtgcattcctaaggggtgcggcctcccgtttccgtatgaatgggaagagttcccacctgctgtattcttggaaagagtctgtgaaggattggtgttaattcttccttaactgcttagaaaaattctatcgtgaaggctctgagcctgggcttttctttgtgggattttttttttttttttttttggagacggagtcttgctccgttgcccaggatggagtgcagtggcgcaatctcggctcactgcaagctccgcctcctgggttcatgccattctcctgcctcagcctctcgagtagctgggactacaggcgcccgccaccatgcccagctgtttttgtatttgtagtagagatggggtttcattgtgttggccaggctggtctcgaactcctgacctcaactgatctgcccgcctcggcctcccaaagtgttgggattacaggcatgagccaccgtgcctggccctttttaatgttttatatagatggggtcttgctatgttgcccaggctggtctcaaactcctggactcagatccgcccacctcggcctcctgaagtgttgggattacaggcgtgagccaccacacccggcccggccactgggaggtttctaagggactaactcggcctcttcacttgctatagatgtactgagattttcttctggagtgcatttcggaagcgtgcacagccgcgtgcttgcttcttctgagttatctggcgtgctgctgtgcagttgtccgtggcgtctgcttagcgaagtgccctcgttctttcacgattctggcttctgagtcttctctctttctccctggtcagtctagctaaggctgctcaagtgtgttgacccttcccgagcagcctttggtggacgcctttccctctggctgcagcactggaaagtggcggccctgggcatggtgccgaggcccaggctccattcccagtactcccgggtccccagccccagcccaccttgctccgggacatccggaagagaaagaggatggccaggtagacgggatagacaaccacgctggacaccaggccaacagcgactgtgtcgacgctcagcgggttcagcctggacacacgccccgtgctgtgtggaggagaggaggccacacaggtgaggctgaggggcaggaagggctgggcaggaagaggctgtcccgacccctacggcacccacctgtaggcagagtctccaacagccccgtaccacacggcgttggcgcccaggaagagacagatgaggagatcgcagcaggtggccctctggatgcgagtgaaacagctacgaggcggccggtcccatatggagagccagatgtgcttgtcaaagaagccacgctgcagctcagccaccagcaggcgccggaagcgcaacagggctgcgtgacctagaaggcagggagggccgcactgcaggaggccacggggcaggaccaccctgcccaacctcccacggagtgggaacacggaacgaggccttactcgcggccagcacctccttctccaccaggcccccgttggcctccgtctccaccgaaagccagtcattgaccaggaagaaggtgctgcgtgccgtctgcaggtccctgacgatgatgtgctgcaggaaccaggcagggctgagccctgcagaggcgcgggagggaggtcaggttcgcagggcgccccaatgcaggggcagaggggcagagcttggcagggtccatacagacctttgttgtcgtgccacactcggatcttccacatgctacccaggctgtgcggggtggcgatctggaagatgtccagactgttgcggtggaaggctctgtcgccgtccaggtgccggtggccgctccggctgtccaccccatacagcatgatgcccacgtgggccgtggtacctggagggcaagagggaggggtgggaggctcggtctgctgcccaacacgtgtggcatcccaggcaagtcatctcagctttggcctccgcgcactcaaggagccacacaggcagtcccggctttgcacagctctgctatacacgaggagctgcggttactgcaatttgtccaataaacagcaggacctcaaggacatgattaagttacatggaaagaactgtaacttgtaacatgcaaacatggctgcacacgcctcagtccacaccacaaccagtgacccgcactgcacacctgtccacacctcagtcacgccacaaccggtgacctgcaccacacacccgtccctcagttcatgcacagactgcgaagcgtgaagctgtgtcacctcctctcccagtgacagacccaggtgacagtattttttttttttttttttttgagatggagtcttgctgtgtcacccaggctggagtgcagtggcgcaatctcagctcactgcaagctccgcctcccgggttcacgccattctcctgcctcagtctcccgaggagctgggactacaggcgcctgccaccacgccggcctaatttttttgtattttttagtagagacagggtttcaccgttagccaggatggtctcgatctcctgaccccgtgattagcctgcctcagcctcccaaagtgctcggattacaggtgtgagccaccgcacccggccgacagtttttaaaagtaggtaatcaaaagaaagaactgggaaatgaagatgaaagcagcatggaaataaaaaatgggaacacggccaggtgtggtggctcacacctgtcatcccagcactctggcaggccgaggcaggcggatcacctgaggtcaggagttcgcctggctgacatggtgaaaaattaactgggtgtggtggtgtgcacctgtactcccagctactcaggagaatcgcttaaggggaatcgcttaaacccaggagctggaagttgctgtgagccaagatcacgccattgcactccagcctgggcaacagagcgagactccgtctccaaaaaaagaaaaacgaaaacaaaaagggaatgccagaagggcaattccaaagaaaggaaaatggaggtattgaagaaacagccacggggagggtgctggcgcctccgtctgagagacgagctatgcagtcaggatcgcgggtggatgcatggtctcccacagtggtagcgatgctcacgtaacttgtggggctacgctactgtgtagaacgtgggctgcccaccctgactgactggcacctacttccagctaggagctgtcctagtcctcagggacagtgagtgctcacgaggtcattcccaggatgaacacacgagcccttcacacagcactgcaaaaactgccttgttctgacgcctgcgacgagactcactcccagagggtgcaaccagcacagccagtgagagcaggggaggccctgccaccccgccgcgcccctcacctgagccccggccccagcctgtcttgacgaggatctcgtacttgaagcggccccgctgcccacagaaggggatggcgcagccccggctggcatccaactggtccagcttgtgcaggatggcggccatgaccatgtaggtcaccaggcacacagcacatgtcagcatgacgatgtagtttacatccgctgttggctcctgtgaagacacagccgccaggcccaggaggtcacgtgcaagctgtgccttctcaggatagagccgagcccacccaggccctcctcgactctgcagaggctcccaggagcacagggtcactcacaggaaacacaaagcggatatggcttgggggcacgaagaggctggtgccgaaggcggtgaggtggcgggtgaggcagacggcctggcggggcgaggtctcctccaggggcagcagcccctctgtccgccacaccacgtcctcctcgctgaagtactggcacagggacgtgtacaagcccacggacacctccagcgccgaccagcggaagtggctggagaggttcagacggtaactccccactgggtctctggtcctgggaagggaaggggcagtggacgtgagcccaggctccgccaggttggatgtcggagtcccagagcccatacccggtccagtcccctcgctgcctgccgtccccacggggcccgtaacccgggcaatgctgacccatgatgccctgccctgccctgccaggccggcccgcagagctcaccccggggaaatgaagaaggtgtagggccggtggtcggcaccctggagggactctgggcggatcctcctgctagccgagcagttgcgctcattgggccggggctccgagtgcaggtagactgccaggtagggctcgggttcctcagacaggtagcggcctggggcagaacgcgcaggtcacacgcctgccgggaagctcaaccacccgggggacacccacgatggccctcctgagcccaccctctgccatgggcctgaaaggccataggagcctctgcaccagagctggcacctgcttctccgtggcccccagctcctctccggccaggcccccagcagcccatgaaacagaaagcaaatttcaccagagacacccatggaagccctacgagaaacgccttccccccaagaacaaggccagggggccgcgtgtgccccaaccgctgcatgcaccgtccagcagcgtatagttgagctgcagatgcagcacggccgcagggttgctgctgtccagggtgaccacagcaccgacggaggcctggggctggaccacaacggagttggcggagctgcggtggccccgggcagcccagtccgagttgttgggcaccttcacggtgaggcgcgctctgaggccagccgctcgatggggatctgggcgccggcctgtgtctggaacgccatcgaggccaccttggtggagacggtgtagttgctgatatagccaaagggaaagggattggagtccaccagaaagatgagctgcaccacgtcactgaggttggccggggccctgctgaaagcctaggggatggagaagtggcagccaggccctggggcgccgccatagcacagcaggctccgcgggtccgagcgcttgccctgggccacgatctcctcacccgccagcgtcaggggctcctcgttgagcacgcgggagcgcgtgacgatgggcgtgagggcagaggtcaggttgtaggcctgggacgccaccatccgcgatggtgactcggctcccagctctgagcgctgtggtgcccgcacgtctgagctggccaggtggatgaggtctcctgcagacaggcgtgaggtcagtgcagagacagggaggcagagggagggtgggggcaggcaaaaagggggagccggagggtggggactgggagaaagggggaacctgagggggcagagagcgaggtgcaggcagaaggaagagggaagctggagagagagtggtggagggggagggggaaggggatggggatgaggacgaagatgagggggatgatggggagagggaggaaaaaggaaggaaaagggtagagaaaagagaaaggggagaagaagaggagcagggggaaagggaggggaaggggataagggggataagggaggggaagggggataagggaggggaaggaggataagggggataagaaagatgaggggaatggacaaaaggacggggaggatcgggggggaaatggagaaaaggggagagagatggagaaaagggagggatgaggtgaggggaagctctaggggaggggaggaggggaagggctaggggaggggaggggctaggggaggaggcaggggctaggtgaggggggaggggctaggggagggaagggggaggggaggggttaggggagggaaaggggaggggaggggctaggggagggaagggggaggggaggggagagtggagggcacagagcagcatcttcttagtccctccccacatctgggcccctctttacaccctgggtcccccgagaggcaccctgcgttcacacaggacagcagaaaggctgaggctactgaagcaggtcagagaccgaggaacgccacggcaggaaggagcccaggctggaggctcagctcctcggccaagctgcccgtctgccctggggggctgaacccagtaccctggcaggcatgcggggcggggtgagcatgtggggccatcctaccatgcactgggccagcgcagcagcgatctgctggatgtcatccacagtgtggaccctcagggacaccagagtctccgtgatgttcttgcgtatctgggctcggcgctgccgctcgtgcttgggctctgccgccacgtccagggcccgctcgtactggggcaggcagggggcacagcaagctgtcagcagggcaggaggccggcaggaggccagcagatgcccacgactcccggggtgcagttacgtgctagatgctgtgtgatgtgggcactgacccgcaacactgagctgtttcttcatgggcaaaacagggtaagcacatgggccctcctgggcgggggctgcattgtggaaagcagacaccggagagggcccggtgggtgtggctgctgggagcggaacgtcggggtgctgcttcagggtcactgggatttatctctggggcccgggatgagccctccgcaaagctccaggcaggggaacaggtcttggtccccagcacgcatgcagcagatgtgaggtcccctcccaggctgcactcacctcgttcagcacagtgaccagggccagcgagtactcgatgacgtgctggggatcggcctgccgcagcagccccgggagcacactagcggtgagcccgtgcagccagactgtgagccccattgcgctgccgttgggctctgggagggtgatggccagagacctatgagcagagggggttggtgagcaggtggcagtctcgggggcgccctcccacggcctggctcacctgttgagggcgaccacagcggctcccagctggtcctgcaccaccacggccaggcccacctcgaagtgtggcctgaaacccgggggcagcacggctccgtagccggagaggctgctcttgtagacacagaactctttgcagtggccctggcaacagcgctgcagcagcagggcgtacaccagcggggcgccagcatcctccgcgtcatgccagcctgagggatggtccccacagcatcacgggagggctccgtgacgtcacagagtcgggggatcccgctgctccccctacgcaggcctgcactcacccgtgcattcgaagtgcaccttggtggtgagggcgtgcacagcgcccagtgggaagaggcggcaagagccctccagcggcgggcggttgggggacagggggatggaggcacagccctcctcctcgccagagcggcccagcaccgtcagcgtgaaggtgtatccctcgccgtcccgcagcacgccccgccgcagcaccagtcacatgcctgcgctgcccgtggatgtggtggtctcatccagcaccagtgtcttgttgctgaacgtacgtgcagcccaccgctgcaggcagaagggatggtgaggggtcgcaaccctctgccctgtcagccccacttctgcctgcaggccccgtcccctcggccatgggacccatccccaacccgcccacaccccgctcaacactcacccctcgcttggagccgctgctgcaattgaggcagcggccctccaggtacacgtaggagctgcggctcacttcgtacacggcctgtgccttgcaggacacacactccaaggacacaatgggcacccggccactccggatcagcacctggcgtgggagtggggttacctccaacacaggtctatttggcctgctggaaggtctgggggacccgtggaggatgctgctcccaaactccaggtttcccaggggcctggccactgccggtgagctcaccccctcccaggatactcatccggtttgccaccttccaacctgggcggcggaagggcatacacagggcagaggacactggggtgtgtgttctggtgtactggacccagctggaccctggcaggaggcaggcaatgctcactgagggcccctggggggatgcgtgtgggaacagacgtatgtgtgggtgtgaggaccgcagttgccacgtaggcctgactcacagactcctgcagcccttagccagggcctgggtcaggaggctgagccgggatggaacctgctcccacaccctcccctcagacgacccctctgggcagacccccaatcaggcccgttgaggaaagcagggactggggaacagacacccactctggggcaccagcaggccccgcctgacagcagcaggagcagccaccatgggctcagggtcaccaagcctcctggccggtccagagtggggagcatgagggtgagaaccggcccaccacatccagcaacagggacatgggctggggacagtggctgcctctggggtgggaaggggctcttcctcactgttggtattgctgggggactgtgtagcttttgtcactagagcatatgtggcttgaagactgtatgtggaactgtggcaggtttggaaggaagcaaagctgaagcaggctgtcgtgttacatagaatttgcatcagaaacagagaggggagagcgcgcggcctccaccagcactaaaacacggaaaacagtagatgagcagggaggctgggctgtccaaggcaagtggccgaggggcgggcggcacccaccgtctggttggtggcctcctccttgcggccggccttccacacggtgaggctgaaggtgtactccacgccagctgccagccgttcccgtggaatggtgaccgtgctgctcccgcggggcccaaagttcagcgcacacccgccagcctccctctgcaggccgagaacaaggggcgacgtggcccgagaaccccatccagttttaaagcagagcccggcccaggagacagtgcgggagaccccctccccatgctgggacggggcccaccaggcactgaggacgggccagccctggtggcaagctgggtgttctctgggctcatgggtgtggacgggtgaggggcagggaggacggccctgccacgcactgacctgtgtcgaagccacacaggcccactggaaactgagcggcgtctggtcgccgtcctccaggttggggtcgtaggactcgctcccatccagcaccaggtcctgtgtgtctgaccacacgcggtaggagccaccctcagtgatgggcaccaggcgctcgggggccaccgtcacattggcctggatgctccgtgccagtggcgtgtccccaaatgacacgacaaacacaaagcagtagtgccccacaggcagcgccagccacggcagcaccagctgaggccggctcacgtccacgccgggcagggccacacgcgccgggcgccccggccgctggcagctggcggtgcggtacacctcccagcggtactcagtctggtaggtgacacagtcgcgcaggtcaacgtaggcatccaggcagttgcgctgtgatcgtcgcatcagcacctgcaggggcaggaccacgtccacctccggctcccggcaggccagcacctggacggtcaccgtggcctgcgccacgaaaaagctcaccaggttggaggcgttcacctgcacgcggtagtccccaggcctcaggtaggagtgctcggccctgggctcatctgtgtcctgccctggggacccatccccaaagtcccagtggtaggccacgcgccgggggctggggctggtggcggcctcaaactgcgccgagcggttggtgaagcaggggccgctgcgcagggccacatactggacggcgtcctgaacctccagcaccagcgtgcggttctcactgcccagggcgttgaaggcacgcacctggatctccaacagccccgcggccacggcgtgtaggtgacgtcgcggcccgacaggatgaacagagagtcgccccggaccttctgcagcgagaagtaccaggcgtaggcgacccgagagccgcgctgcacgcgggctgtgaagttcctctcagtgcccatggcgatgccaggctcacagcagttgggcacctgcagcccgctcacggcctccagcaccacgatgcgcacctgcgcctgggcccagctcacgtggtttttgccctgcacgctcaccacgtggtctccgatgcgggggaagctgtgggagaaacggggcccagggagcacttcggggctggccccgccgacctgcaggcggaaggtgacagctgagccggcagccagcaggatctgaaaatggacaagctgcccgggcgccaccaccttgctgctggcccacagcaccaggcccacgatgggctcctccaccgtgaggttgtacgtggctgagacccagctgactgcgttggaggcattgagccagatgttgaaggtgccagcatccgggaagaccatggtgacatgagggccacgcttgctgctgccgccgggcacagcccagcaccagctcacattggtgcccgtggccagctgcccccaaaagggcacagaggacccggccgccacgaagctgcctcccggctcgctggccctgatgctgaggccactcacaggcacctgcacatccacttccacggtggcgttggctgagcccagcgggttccctgccgtcatggtgaccaagtgcaggccgggtgtggggaagctgtgggtggtaaatggctcgggggtctcccagctcagcccctcctccaaggaccaagtgtatacgacaccactgccaccagccagctcggcactgagggtgacgcttgtgttgacggcagctgggttcggggaggcggccaccatcagccaccccacaggctccacgaagtccacggtgcagtcagcccaggcgctgcccagcatgttggtggcccgcagctgcacatggtaggagccggcctcgagcgcggtgagcgagaagcctttgccgctgccggccagggccgggcccctgtccctccaggcagtccagctgtaggagatggtgccgtccctgaccacggcctgcagctgtaccatgtggttggtggggaagtagcggccaccgcccaccacctgcagcccctctatgagctgcaggacatagacgaagatgctgtcctgggcggagcccacctcgttctcagctgtgacgatgatattgaaggtgcccacggagcggaaggtgtaaagagatggcaggacccccagagatgggcgtgcagcggtcacagagcacccaggaatagcgcacatcactgccggcctccagcgaggtgctgaagctcatgctcccattcaggggcaccaccgtgcagctggcattgacgatgagcccccgcacgcgccgcttcaccgtcacattgagccaggcctcgctgcggctcacctcattgcagccggccaccctaacggtgaagtcacctgtgctgttgtaagcgtgggtgacctccggaccctcgagccgcccaccgtcccccagatcccacaggtagctggcggggcgcccacggcccacagcagagaacaggtacggctgctgcagctccagcccaagggagccattgaccttgatgctggtgaccagcacgggctcctgcacctccaccagggctgagtcattggcagcggagatgttgttggacgcggtgactgtcacaagataggagcctgggtctcggtagatgaacgtcacctcagggcccccgacacgggcggggacggcttcttcggtgccaaagtcccaggtgtagcggtaggggaacgggggccaggcacatgccaccagccgggcctcgtccccgagctgcacaaactgcctctctggctgcagggtgacgttgcccacctctggctccacgcagatgctggtgaagtaacgcgccctgttcacgcggctggacagcaccagcgccagggggaacgtgccgctacgcgtgaagttgtgtgtcaccgtcgggcacccccgcatggtcgtgttggaggagccatccccaaaggtccagtcgaagaggtagcgggccgggttcccggtgacgtaggccgtgagccgcgcgtcaggctgagtggggatgcaggcggcgggctcgacgcgcagcacctccaggacgaagaccagcacgtgcaggctccgggccaggtggccggcggggctggccgcacccacggtcactgtgcagttctgtgcccgcaggtacacatgctccactgtggcctctgggcccgacagcacggtgccgtcccccatgtcgaaggtccacgtgatgttgtcgcccgtctgcaccgcggcactgaccaccacgggggcgccctgctccacggccaggctcatgtccacgctgagcccgcggagctcctcaaagacgcgcacatccgcctgggccgccgcaccgctcaccgtgttgttgacctccaggcgcacgtggtagatgcccctcgagggataggtgtggttggcagccggctggctctgggtcaggacaggggagccgtccccgaagtcccacgtgtaaagaacacccccaggcgagggcagcagatgcgggtagaaggtgacgggccggccggccaccaggacgccgtcactcacacccacagcctcggagggcagggaggcgcgcacgctcacaggcacctgctgcatccggttctcgaaggcattagatgccagcacggtcaggacgtactcacctgtggggacaggcccaagtggggcagccgcggcacccccacctgctccccacccgctcggcagaagccccccgcctgaggagcccggggtgaacggctgcacctgcggcccagccttaagggtcccaggctcccaagccacgtgcgggacggagcacaggtgcagcagcactgagggctgcctggtgaggacggcaccgcctccaagtgcagctgcactcggggcagcagagcagcaagagccaggccgcggcggggggcagttcagggggcccagcttccctgtccactccccccacgcctggcccctccctcaccccagtagggacctaagccatcagcccaggtgaggtcacagtgagggctgttggggaggaaggggggcagcttgactgggggactgggggtgccccgtgctcagagcctgaaaggcagtggccccctcaccccctcatccctcacctggggcagcgtaggtgtgcgtgacattgtgctccaccagcacctgggccaccgaggggtctggaactgggaaggactcgttgtacggaggctggaactggtggagggcctgctccccatccccaaaggtccacctgccggggcggtgggaggcagtgagtgaaccgggacaggggtgcgcagtggcggggcacaggtgcgcggtgggggggcagggggtgcttgggacccagctgaggctccactctgcagtcacgccccgggcctccattcagggcccacccggctgtgctgaggcctctcccggctcccgtgcagcctcagggctcctgtgcacccagtacctcccaacagatagggaaaccgaggctcagaaaagcaaccccctgatgtggggtccctcggctgaggctggggccgggacaagagcctggtgcccaccccaaaccggcccccgagtcactcacaggaaggccacctccacagccgagtccaccagcacgcccgccgtcagtgccagcgtggcattgggggacagcacggccggcactgtggagacccgcaggccctgcatcctgttcatccgctccacggtgatgttgtagttcacggtgacgttgctcacgtggttggaggccgtcagctgcagggataggcatcagtgggcccaggtggcaggtgagaggcctggccctgcttagcgtccctccctccactcacccacagccatggcagcgtcctcgggcagcatgaagcagaggtgaaggtggagcccgccccgccccaccccatcccctcccctccccacccccgcccacctactgagagcttgaagaccgccgcgctctgataaatgacattgaagaccacgttctggaaggtcagggactgcttgtcgttgatggtccaccggaagaccatgtccgagccggcctccaccacggggctgtacctctgcggggggactggtgtcagcctgggctctgtggaggactctgcccttagcctgtcgcctcctggacacacctcccgtcaggctggagagtcccacgcggggcacagaggagaggaggtggccggggctctgcatgccatgggagccaagcccgggctgggacactgactgtccggctctccagccagccatgtagtactactaatgcctcaacctctctgtgcctcagtttccccatctgtaaagcaaacctagtaccagctacaaagagtccacctctctctgagtcttctcagaccctcccggggctcctgccccagctcctcagccagagagctcggagcagtgaggggaggcacacgggcctcacagggacagcacctacactggcttacagaacccaggacaggctgcacaggtcacgccatttctgatggcccctcccaaggcccctggtgaaggggcaggtacccgcaagacggagacagccctgtcccccatgtacccagcatggtggcaccgcgggcagcccgcagtttcccatcaggggttcagactccacctcaaaagccactcgctttagccaggtgagaacacagcagagggcgtgagagactcacgggggctcgtgtgaggtcagggagcggagttttaaattcatttcatgaaatgagacggtggaatgagttagcggagccgctgtcagagccgtgactttccaggaatttaaagcccaccaggtagcctgaggagccagccagcaggacctgcccggggccgacgtccccagtaactgggctgctgccctcactgggaagccaggcctcacgccctgtgtgagcaccctgtctgcaggcacctgcctgggggctggtggtggagcctcggccatactcaccactgggactccctgcagtacacgggcctcggggctgggcgtggcgcggaggccacagatgggctcctccgccgtcacccgcaggctgaggttggcccggctggcgctgttttccaccacaacgtccatcacgtgctccccctcaccgagccacggcagtgctaccactgagaacagggtatcattggtctcccaggggcagccgggcacgaaggtggccaccagggcagggcaggcattctcaaagcgagcgctgacactgcccccaggccagcgagccgtggccgtggcgctggcaccagagtccacctggagcaccgaggctgagccgttggtgggcacgtagaggcggccgtcgcggggggcagggtagatgacccgcagcccagccactggggagaccacgtcaaagctgcaggacaggttgtgcctggacacgccattgcccacctctgcccggacctcatagcgcccaggcagccgcagcccagggttgggcctcaggcccagcagcacggtgagctgttccgtggctgcaagcagccgcagggcacaggcagggcaggcccaagtgccctccagctgggctggcaagtggggcagccatgacgaggcgttggcggagaggtacggggcctggggaccagggtggccgggagccggcgagcagtgcgggagggcgccagggccagcgtcgtgctgcaagccaacgaggtcaccagggagcatgaggacatcctggccgtggagggtgacctgtggagagggaggcagggctgcatcacgtcctcacggtcatggcccgtggacccctgcacgacggatgagggtggacacgcagggctccccgcttcgtcagccacacctcagggagcctccccacagtgctcgtgacaaggacaggcaggacagttgcagacagggggacacacggggagaggacacaggccaagacctggcagacaggaaggagcggctgtgctgggagagaggaagaggaggcacagctcgtgccaagggcccaggcgagagcttctcccactgggagaggggcaagggcactgcagaggtcggaggttggaggtcggaggtcggaggtcagaggtggcaaggacgtgggaggggcctgcaggctgggtgtgtctgctgcgcagacccagaccctgggcagcagacaggaaggtggcctgaggagatgcagggaacagacccaggtcagggccacacaccgagtactgcgcggggggccccgcgggaacggagaagaggaactctctccatagcgcatagggggccccgagtagccctggcccctgacgtgcagccattggcgcaggcctggggtggcaggaggcgtccagcggcaagcagatgttggctccagggcaccagcgtccccctggcatgcacgcgggggccagctgggtcctgttgtccggggacctgctctcaggctcgctgccgttctccggggtccctgcgaggaggggagggtgttggggccctcattcgcccacgggccaccgtcagagatgcccaactgcctgcaccagcgagcctggccttgctgtgaggacaggtctccccgcccgggcagcactcccagcccagtgctgcgtccctgtctccggccagctgactgacccaggccggtccccaggcaggccccacccgatccacccccaggacacctggaatgagctggtgtctctggaacccctgctctgtccacctaagactgggaaccactctgatggccacaggaccagcagacgtgagagctcagagaggccaccccgagtcctgcggcgcccaccaccccagagtcccacctgctgtgctgaggagccggtacacctgcagccgcagctgggcgggccgccggagctcctgggtcccaaattcggccgtggtgaggaaggcttcacggctcagacgcaggcccgggaataccatgacctggtgggcagggggccgcctcagctccacagaccccatcccagcctgaagcccagactccccccacccgaacttcccaggaagaggggagggaaggagagcgagccatcggacccccacaggcctggctcctgtcgctcgagaggaagactccgatggaaactgtccatggggggcaggacccctgacctgcctttcaggaataactcacccacactcagagaaaagggggtaatgtgagtaaacgctttcctctctgcactctggattttcccaaccatcttcactgggcacaagcaacattaaggcccccaagttttttggggagacccacagtgggcagggcaggcgaggcctccaggggcaggcaggagggcaggttttagaacgtggggggccgactacctccacgggctcatgcggggctgagaggccgtcctgccgtgccagaggcatcaggggtccctgcaggtccccactgggcgctcccacgaggaggttctcggcatcctgcactgggcctggggtggcaagtgcacagtgaggcgccgggccagggcccaggacaccaggacgaacagactggggaccgagccgcccgagaacccccccaccagcccctcctcctcagcccaggctccaccgcgggcgctcggcaggcccctaaccacagccagcgtctcaggcccctgcctggcccctcgcacacctccaggccgcagctcgcagacgtagctgtgcggcgctgagcacaggtcggtgttacaccacccggtgggcccgagccggacgcagtgctcggctgtggctgggtgtggctccccgggcagccagttctggcagctctccaggctgaaggcctcgccctgcggggctgggcccacctccaccccctgcacagtcgagaagccgatccacatgtctaggctcctgggggcgggtgtgggatggcagggggctcagggcactcctccatcctcccaccctcacagcagcccactgggagccccgtcactgtccccctttccagatggggaaactgaggctcagagcccggagagcagggcccaccagcccaggctcacagcagcacccacccacgaggcctgtgggcactggcagggatccccgtgcaggccacctcccgtatggcgtgcccaggagtgtccggaggctgcccccagctcgtgtccacctctgcatctgcagagctgacaggaacggccccaccggccggcgccacctgctcaccagggccggcccagctcccacctccctcctcctgagactccccagccgcaggctctgccccactgcttcagagatctcccaacctatggcccctcggggggtgggggcaggcacctggtgacccgggagaccaggaagcgctgcatggcgggactgtccaccattgccagggcggccccggcccaggcccgacactgctcctgcgcctgcagccaggccgccttctccaccaccaggcggtagcagtgcccgttgccagagaagatctccgtgtccgaggggcagagcgggtgcaccgctggagaccggtgggaacgagggtgtcaacggtcagtgtgggcccaaaacgggggtaccaggctctgccccatctggatggccctggggaggaaggggagtgggcagcagacactcacctcgggccggctcctcgcccagggccacgatgctgtaggcggcctccaggcctgaaccaccgcggttctggatgctgaggtcgaggctctcgtcactctgcaccgaggacgggcacacgagctccagggcggcaggtgccgcttccacctgcacgtctgtccccagcagggctgagccggcccccagggccagcacggccatcacgtgatagcgcccaggcagcacatagcgatgcgaggcagccggcccagcggcatccacctcgggggagccgtctccgaagtcccagcgtgtggcagtgacagggagcggggcagcgatgtggaaggctgctagctggccggaggccaggggtccgtggggccccaccagggtggcccctggggaggcagggaagacgtgctggaggagggtggggcccctacaggtgggggcaggaggcggcggggggccggagcagagggacaggcaggcgaaggaggcactggagggctgggctgacccacacaggcaccagccctgctcggagagggctgcgaggccctggccggtggagaagcagaaggcgctgcaggcctctggctgaagcaggccttcgtgggcagctgaaaaggacactgctgccacggtgcctgagctgttgtcagggaggcaggcgacatactcctcacctagaagaggcagccactggaccccgggttctgctcctcctggctccaccccacacccccccatccgcccgccgcactcacaggctcccatgctgttcccttggcccggaggccccccccagagaggccttcctgagccctgcccagtgtctgcagggcccaggtcccacctggctgggaaggacagagctgccccacccaccggcactcaccacagccactgtccagcaaggggatgccaagcagaggctggccagccagggagccaggcccagcacacgtggctgcctcgggctgcaccacccgcacctgctgctcctccgcccatcgcggcagccacgccaggccacagtcacactcaaacgggttcccactcaggtttctgcggggcaggggcaggtgttggggaccaggtctggtgggaagggtctatgccagccccccactggcaaccaggccctggagccaccctgacagcaccgcctcccctgccccaaccaagccggcactggggggctccaagcaggtagtgaactgcccccaggatctggtctcaagcctggaaggggacacggaccaactgggagggcagaagggatactgggggcctggggtccagccaggaccccacccaaagaaccacaacttacatttcacttaaattaaataaattagcaaatattccttcttctaacgtagaaatcttgttgttgcttatatccctggaagagaggggggattcggcaaagctgacggaagcccccacagctgagcagcaagaggcggtgccgccagcccacccggagtgagccccgcatgctggcacgactgggggacactcacagctctgccagcgccgagaggttcgccaggagcccaacgtccagcgcccggagcaggttgtgggagacgtctctgaggagtgagtggccgtgggtcagggccagagcccttagtaggccagaggccatccctgggcccatcccacacatttccagcatccccaagctaaggcctcccacccttgagctccccactcccagaggtcaggaggggcctttctgatggaagacccaaatgaacactcatctggggaaaccaagccaggagaggcctgggggcctcagccctctgcacccatctcagccctatgccgagtgccacctggacctgtccacccagggccaggaagggcacggacccccaacccatcccacgcagggccaaggccccccatcccctgtccacagtcccccacagagccaaggtctcccaaccctgtccacagcccccacacagactcgaggggcccccatctcctgttctgaacccaacagggtggtcccactgtgggaccacaaccaggtatgactgtgtgagaagcaggctcactaccaggctaccagggagcacaggggagcaggcgccaccttgaggcataaacccagagaaacaagacctccaagacggccaggcactggggcacacgccggtaacacagcaccgtgggagctgagacggaaggatcgcctgagcccaggattttgaaaccaccctgggcaacacagtgagaccccgtatctacaaaaaaatacacattagccaggcatggcggcatgcgcctggggtcccaagtactcgggaggtagaggagagaaaaatcacttgagcccagagaggtcaaggctacagggagctgagatcgcatcactgtactccagctggggtgaaacggcgagactctacctcaaaaataaataaatacatacataattaataaataaaacatcaaagaccagccgacctaactccatctaaaatacacaacttctacgcaaaatataaataaaattagaaaacaaactacaatctcagaaaagcactagcaacttagacgacatactaaaggccaaaaataccctcctgacacacagctaataaagaaaaagtcaactattccagttaaaaagaagaaaaggaaactggctgtggtggcttatgcctgtaatcccagtgctttgggaaggccaggagtttgagaccaggatggacagcatagcaagaccccatctctacaaggaaaaaaagaatcagccaggcatggtggtgtggagctgtagttccaactactcggggggctgaggaggaaggatcgcttgagccagggaggtcgaggctgcagtgagctatgattgtgccactgcagtccagcctgggcgacagagcaagacccagtctcgaaagaaaagaaagagaaagcaagaaaagaaagatggctgggcacggtggctcactcctgtaatcccagcactttgggaggccaaggtgggtggatcatgagatcaagagatcaagaccatcctggccaacagggtgaaaccccgtctctactaaaaatgcaaaaattagctgggcgtggtggcgggcaccagtccaggctactcgggaggctgaggcaggagaatggtgtgaacccaggaggcggagcttgcagtgagccgagatggcactgctgcactccagcctgggcaacagagtgagactccatctcaaataataataaaaaataaataaataaataaataaaagacatcactcacacctgtaatcccagcacttcgggaggccgaggcaagcagatcacctaaggccaagagttcaagaccagcctgaccaacatggtgaaaccccatctctactaaaaatatttttaaaaattagctgggcgtggtggcgcgcgcctgtaatcccagctactcaggaggctgaggcaggagaatcgcttgaacccgggaggtggaggctgcagtgagccgagatcacaccattgtcctccagcctgggtgacagagccagactccgtctcaaacaaaacaaaacaaaagacatcagctagctggtccaagcacagtggtgttcacaacgaattgatcacagccaggtagaattcttcattctttctccagttccactgctttgcttgaccagccttaaagacacacatatacatttttgtctgggcgcgctggctcacacctgtaatcccaacactttgggaggccaaggcaggtggatcacttgaggtcaggagtttgagaccagcctgaccaacgtggagaaaccccgtctctcctaaaaatacaaaattagccaggcatggtggcacacgcctgtaatcccagctactggagaggctgaggcaggagaatcgcttgaacccgggaggcggaggttgccgtgagctgagatcgcgccactgcactccagcctgggcaacaagagcgaaactctgtctcaaaaaaaaaaaaaaaaaagtatatatttttaaaagacattggccgggtgcggtggctcacgcctgtaatcccagcactttgggaggccgaggtgggcagatcacgaggtcaggagatcgagaccatcctggccaacacggtaaaaccccgtctctactaaaaatacaaaaattagctgggcacggtggtgcatgcctgtaaacccagctaccaggtactcgggaggctgaggcaggagaatcacttgaaccagggagtcggaggttgcggcgagctgagatcatgccactgcactgcggcctggagacaagagcaagactccgtctcaaaaaaaaaaaaaaaaaaaaaaaaaaagacatcaactaattgcagtgtgtggaccttatttggctcttaattcaaactattaaaccaaaaatgtgaacacaccaggccttcggtggcatgaaggaattgtctgttgtgttaggtgggtctgcggtattgcgatgccctccaaaatgcttgcagataaaagggtggctggaatttggttcaaaacatgggtcagggctgggcgtggtggctcatgcctgtaatcccagcactttgggaggccgaggcgggcggatcatctgaggtcaggagttcaagaccagcctgaccaatatggagaaaccctgtctctactaaaaatacaaaattagccaggcatggtggtgcacgcctgtaatcccagctactcgggaggctgaggcaggaaaagcgcttgaacccaggaggcggaggttgccatgagccgagatcgtgccattgcactccagccttggcaacaagagtgaactctgtctcaaaaaaaaaaacaaaaaacacatgggtcaggaggggaagggtcggggcagggagggcagggcaggctctggggtggggggtctgtgagtcagccacggctctgcccacgtctccccacgaagcttcgagccatgcagagcagcacgttttgcagtacgccatcttttccaaaagccaccacctctcggcagcatccttaacccaaggcaggctgtggcctcagaagccccggctgtcctccacctggaactggacacagctgtccctgctgagcttcagcagccagggagccacaagtggagaggcacctgcgtgagccccccaggaaggctactggtgacacccagacagcaacgctcctggacccttgaacacctgccagcagctgtgatctgtgtccttcacctctcccagcttgacccctcttccctggggaaaacccagccgtctccccgaggaggagtttgcagggtagacagcaaaatggctgggctgccccacagcacagagggtggcctggggggccagccagggccttcacatccttcctagggccctagtttcccatgggtcccctcaccccaccttccagaactctcccagcggcggccccaggtgtgtacagaacagcacccacctgcccacgaggtcaccctgtgccctgttgcacacttgaggggcctggcattcggaatcttgccagctcaggctgggacaggccaccaacccccagggtccccctcctccaaaccccaggaccagagcctaagaggacaacacaaggcaggggcgggggttccactgctgtgccaagggcctggagaacacgggccttgctctccgctcagcagccaccagcgcccttctctcccggacagctcccgaggggctgctctcatggacaccatcaggtgctgggaagcaggaaccaccaggacctggacagagtccccagtgaccggcctggcagacagaggagccctcagctacagcatcacaaacaacgggtggggtaggtctgatgcaattctgtgggtgctgttgccaggcaggaggaggccatctccacagagacagccgcgagacacacgcgtccgcagtcagggagcgcaggagcaatgtggccccgaggggcacgggctccattggtccaggagaacccattcttctcccaccctcgagaccacccagcaaagccccaaggacacacggctcccctaaggaagggtggccacaggcgggagtgacccagaaacgttacaaaaccaaatgccagaacccatccaatgtttagaaagcctggggatgtgccacgtcccccagggatccagcacgcacccaaagagacactgtcccggcgaggagcctggagcctgggaaatacaaggcatcagactggtaccaagactctccccagcgctggggacaactgtctgcttatcttagtcccctgcgcccttttcaatccaaccctgggtcctgggcacctcatagttccaaacccctgctatgcacatcccggctgtgatgcctgggacaggtcctgtcctggctgtgatgcctgggacaggtcgtgtcacctctccaaacctgtttcctcatctgtgaaatgcaaatctccacggtccctatgcctcggatggtcagagtcaggattccgcatgacgacccccaacaggagcctggcacagacctggctctgggcagcgtctccataaaggccacctgttgtttttatctcccgaaagcgaacatgacaaggctttaaccccccacggcaatccgccctcacccctgttctcaggatagccttggaacccaatagcagagcgcctgaggcccttcatgaccccagcccacccgcgagcccacctcccaccctgcccctacccctcacacctcccgtggccagcctccagcctcacggtctttgctcacaccgttcaccccccttcttctggacccacctcatcgccccttcctaagcatcagcccaattcttgcacatccatcaaatccttgtccagacacctcctggaactcttccctgcagccccctacagccatccccatctctccgggtaccccgcagccccaggccgaatcccaattcctctccaattagcgactgtttgtcctcccagctgagcgcggcctccgcgccccgcccccgctggcgtccgcagagcccccgggtgggacgtctgtctccagacccggggtttttcggctccccggggccgtgccaaccgcggctccaggcgttccttatttagcagggccgctgtgccgcgccggagcctcgccctgggagcgtcctggcccgcgtcctgcttcccgtcccgggccagggaacgcgcccacgcccgcccgtcccgcggcctctcccgggtgccgctgggcccgctactcacagcgctgtggcgtccgcggggatgcgcagcgcgggaccgagcgtccgcagcccgcggcccgcggcccgagcagttgacgcggcaggcggcgccgggcgctaggccgcagaggcaggggggctcgcaaggcccgcagccgcgcccggggccccccgccagcgccccgagccacaggcccaggcccagggccagcgccaggcgggcgggcgcggcgggcggcatcgttagggcagcgcgcgcatggccccgccgtccccaggcccgcccgcgcgcggaggccgcggctcaggcggggccggcggacggcatggcgggcgcggggctggatggggctgcggccgcgacctgctgctgagcgacgcccgctcggggctcggggccaggccgctccgggagctcggccgcccgctcggacgttggcgctgcagtgcgggccccgccgcggctcctcctcctcctccccgcgcggcgcagggcggacggggcgagggggggcggggcgggtgcaggctccgcccccttcgccacagcgcgaccgggccagcgatgagggactggcatccggaggcttcaccctccgctccacagggtcggcagcagggcggggcctccggaagctccgccccacgctttcccggggcgcatgcgacgtggggcggagcgtctggaagctccgcccgtcgcactgtagagtcggccgaggcgcacgaggtatttttcacgctccgcccctctgcaggctaaagtgcgtgggcgggaagcggtgggcagggtgccatctggctccgcccttctcctgtggtgtgggccaggcggcggcttcctcctcctgcagcagccacaggctccactctgatccttctcccgcggcatggatccttctcccgcggcgtggatccttctcccgcaatctccgtgcgcgtccccagtcagtacccgcagcctcccgacgcacccgctggctccaagcctccctaccccaggtttcctggctaagagagagacagagggagagagggggaagagagagaacaggcaatgggaggttgatggtgagagcttattgaaagacaagagggaggaaacccacatccttcattccccatccattcatttattgccttatttattccattgaatcttcacagctctagaaaaagtgtgctacaattattccctttattaaatgaggtcactgaggcacagtttaagaaatttgccagcagggcacagtgggtcactccggtaatcccagaactttgagagggggaggaaggtggatcccttgagcccaggagttggagaccagcctggccaacatggcgagaccccgtttctacaaaaattagccaaaattagccaaactggctcacacttgtagtcccaggtactcgagaggctgaggccggaggagcgtgtgagcccaggaggcagtggctgcgctgagccgtgattgtgccactgcactccagcctgggcaacagagtaagaccctgtctcgaaaaaaaaaaaatggaaaaaagaaaaaaagaactggctgggagtggtggctcatgcctgtaatcccagcactttgggaggccgaggtgggtggatcacctgaggtcaggagtttgagaccaacctgaccaacaaggtgaaatcccatttctactaaaaatacaaaaattagccaggcgtggtggcaggtgcctgtagtcccagctactagggaggctgagacaggagaatagcttgaacctgggaggcagaggttgcagtgagccgagattgcaccactgcactccagactgggcaatacagtgagactccgtctcaaaaaaacaaaaaaaatcctaccacatgtgctccaccaagctctgtctccaaggtggccttggaagccacatggggaaggtggcagagactctaggagcctgagcagaaatccagatgattatgaaaaatgcagacctacccatccttattcacctgggaccaccgtgaactatatcataagaaataaacccctattgtacatacatgcaccattcgagttgggtctatttgttacagcagtttagccaaccctaatccacatatacagtgtcaacagtggctgagatgacatgttgcacagacatgagagtcagaaagacctgagttcaagtcccagtgatgacatttactatctgtgtgaccttgaaaagctgcctaactactctcagaccgtttcctcatcagtttgttttgagagtcaaatgagaaaattactaaaaagcccttagcactgcatctaagatggggaagagacagtcaatgaattcaagtttcctgaagcccagttgcatccctgccctgccctgggctctgagagacagttgccgaagctagtgttaaagtgaactaaatatggcctgagtgggacttcgtacttctatagttgagtccttgtggacaaattgcaacctagcttaataggtagacaagattgaaaacctaacttaggagtatgcgcctgtaacaatagctgagtcttggccaatcccagaggccgtagttcaaccgctcatacgctgctgagtgttcaaactgtactcaaataaggcaaacgccaacttgtaacaatccagccattctgtacttcacttctgatttctgtacatcatttcccttcttttgtccataaatcttcttccaccacgtggctgcgctggagtctctatgaatctgctgtgattctggggtctgcccaattcgcgaatcattcattgctcaattaaactactttaaatttaattcagctgagattttcttttatcactaatttgagctggttttctaatgtttgcaaatgggagggctgactaatataacactgctccaaatattaacgtctttctcccaacccatcacccaggcagaagtggtccagcctgggcaaccctaggaggaggctagctctcctctaggaaggcttaggatgcagccagtgggcagtaactggctcactgtcccctgcaactgaaatcagaactggttccagaaaccaagttgacccccaaccagtctttcccaaaatatggctctatgcccatctctggtcaggctgggctgttttcctggacagagaagtctcagacaagcaggcagtggttagtgggctgtgcccaggctgagaacatttcccagagaagatggcatctctggcagtcccttaaagccagcagaggccaagtcatgtccaagaggccaaaaggcccaatatggtggagacagtatacagtccccatgaataagggatgctgatgccttccctatgtaccaggtagtcactgcctgaggggcccagagcagcaggagggcagagccagcctgggcaggggcactgggccggaagtggggctcacatcctcagcacacacacacacacacacacacacacacacacaagcgaatgcacacacacacacacaaatgcacgcacacacagataggtgcattcaaacatcacatacacgtgtacattccttgcaaaatcaacttctgctgatagcacaacaaacaatggggccacagtgtggcatggaggaaaccctggagtctgatctcatttttttttttttgcatctgtcaggggataaagatatttgataaaaatccttgagtcacatccccaccaggtccctgcctacctgtagaccccatcaagccagctccatggcccttcagataccgcctcactgggtccccagggattgacctcagtcctggaaatgcagaaatatctgtatctgtcacagctgagactggcggccttccgccggctttcctggaggcagagctggagacagggacttgggtggatgtggtttttgtttttgttttgaaaggggctttcaggagaagggaggtgaggactacaggatgcagaaggggacagagcagagtgagaatgtggtcccttaaagtcccgccttgacctatcccacgagcagcagagagcacgccacaggatcgtccccaccgtggggcagggaccagccattcacgttgctgtatcagttagtcactgggccattactgggcatggcatcccatcccaggcaatgtggctcccatctgagggtgattctctagagaaggacagctgtgagctctcagcaggtgaggctccaaaagcagctataccagtctagacctcaggggaagggggaattcatctctaggcagggatgattttcataacattgaactcttgacatgcaggagcaccgaccaatcagaacagacacggtgaccaaacaggcacagccacaccagtggataccagcggaatgtccacgctgcctctgcgaagggacagtcccatgagccaagccctagaccagctgttctgggagcactgcatcattgcactgaattctcacaaccgccccataatgctgggaccatccccattttcttgcccaacagcctccgtctcatagacactaggcggctctcccagggtcacacggtccagtcaataacgggcagaactcgcactccgatctgtctggctccaaagctgctaaaaattttctacttggcctcactggcttgacaaagataaaaaagaaggcaagtccttctttccaagagatgctgaggtccctcggtgacactaggtcatgattttatcatgttcagagggcaatgaaagggacagaaaacaagcgatgtgtgatctcctgtcatgtcaagagacgctgttttcaaagaaacgtacgtttcgcagaatcaatacgctgtggggcctcagaaagcagaggcagacacacggccccaacccgtgcacgtgggagccctgttacaagagacggcagaaattaaactgaatcacctggagcaagtacattgtaaatgttcaatattaatgacccacctcggccccaaagaagagagcgttgggctttgtccagctgtgtgctctgttgttaaaagaccaccttgtggccaggcacggtggctcacacctgtaatcccagcgctttgggaggccaaagcaggtggatcacctgcggtcaggagttcgagaccagcctggtcaacatagtgaaaccccgtcgctactaaaaatacaaaaatttgctggatgtggtggctggcgcctgtaatcctagctactcgggaggttgaggcaggagaatcgcttgaacctgggaggcggaggttgcagtgagccaagatcacgccattgcactccagcctgggcgacaagactgaaactccgtctcaaaaacaaacaaacaaacaaacaacaacagaaaacaatttgtgccttaatgggcattcctttcccttcttgctaagggatgagatgatggcagaacttgtggccactgtcctggaggttgacaagctttttctgtaaagtgctagataataaatattttgtgggccacacgatctctggtgcaactactcaacactgccattgtcatgcaaatgtagccatagatgataataaatgaatgggtgtgactgtgttccaataaaactttatttataaaacagacagctggccagagttgggcaatgggcagtagtttgccccccactccccgcccatccgtcctattccttggcttttttgggtacatcaaggagtgcagtctggatgctgggctattttatggccactgggcataaccttaacctgggccttttgtctgttaacctgggtcagtggctacggtgaaggtcgggcaaccaaggtttagatggctcagtacacattcacgcccacaaaccaaaccaggaaaaagatgtgctaagttgagcatatgacactgttggtactcaaatggtttgtttttttttttaaataaatgtttaagtaaattttttattttagaacagttttagaaaaatggtgaaagcagtacagagagtttccatgtaccccatagcttgatgcattatgaactaaagtccatactttttttaggggggtggggacagggtcttgctcgtcacctaggctggagtgtggtggtgtgatcatagttcatggcagcctcaaccctccacctcccctggctcaagcgatcctccatctcagcctcccaagtagctggaaatacaggtgcctgctaccatccccagagaatttgtttttgtttgtttgtttgttgtttgtttgttgagacagggtctcactctcattgcccatgctggtatacagtggcacaatcacgggtcacttgcagccttgacttcccggactcaagtgatcctcccatctcagcctcccgagtagctaggactacaggtgcacaccacaagcctggctaattttttgtattttttgtagagatggggtttcgccatgtcgcccaggctggtcttgaactcctgggctcaacccatccgccggcctcggcctcacaaagtgctagggttacaggcgcgagccaccgtgcctggccacctaaagtccatagttgattctgattgccttagtttttgcttaatgtcctttttctgttccaggataccacatggagcattttgaggagtgctggccaggtattttgtagaatgttcctcaactgggatttggcagatgcttctcatccttagtcttggcttgtgtgtgttttgaggaggaggaccacagagcttaagaatcattctcagcactctgtatcaggcacgcattctctcaagatgacttgccgctattgaagttgactttgatcacctggctgaggtagtctgtccgtgttctccactgtaaagttactctctcctctcttttcacactgtactctttggaagagagtcactatgcacagcccacacttaggatgtgggaagtccgctccacctccttgacgatggaatagctatataaattacctggggccgggcacggtggctcacacctgtcatcccagcacttgaatgggaggccgaggagggtgatcacttgaggtcaggagtttgagaccaacctggtcaacatggtgaaaccccgcctctactaaaaatacaaaaaattagccgagtgtggcagcgcatgcctgtgatcccagctactcgggaggctgaggcacaagaatcgcttgaacctgggaggtggaggttgcagtaagccaagattacatcactgcactccaacctgggcaacagagcaagaccctgtgtaaaaaaaaaaaattaaataaaaataaataaataatctggaattcttctgcctgggagatttgtctcttctctcttatctgatcatttatagcagtatggaatcatgggtatttattctttgaattctaatccaatagtacttttttggggctcaaattgttctggctttgacccctgggagcttttccactggctcctgtgtccctctgagatgccccatcactgcagcagtttcattttgtttcatttagcgcctcctcaccctgtgaccctacaagatgcttcaggttcttcttatctatttcctccctcggtcctaggatcgacatttgttcaagaagcctggttccttttactggagaatggtgtttattggagaacagagacctgggcaccagaggtttgttgctactggggtatccttgcttctaggctctcttcgctgacagccaggattagtaatgtgtgtcttactaatttgtgtatatgcacatatccataaatatttctctatgtagccatctgtatctatattgagctaaacatgtgttcatactgatgcctgccactctaatccactgccacatggatcactctagccttgcctcctttgccgacctgtaaacctcccgccccccaccccatctattacttaatgaatttcagtaagcatgtgaggtgggtggttatggaaaccatttttgacctatatataagatggcagtttcgtctgatttctcctaaatagaagacgagtgtgaaatggtaacatggtgtccgtaggagtcatatggatggaccatggccaaccatattattaaggaatattcatgcattcatccatccatccatccatccatccatccatccatccattcattcaccagtgaatgagtaaagcattaggtattcaccacactgtcctctcctggacttccccctacctcacgggccacttcctctctgtctcttgggcagggccctcctcgcccatcctctgaaggttgcactgtcccagggcttggcccccagccctctccttttctcagtcttcataaggatacctattattcaatcccgtggcctcatctgtcatccaaaaacactcccagctcaccacgtctcatctccagccgtgatttctcacccaggctgcagactcgggtgtctgataagcatctcaaactcacgatggccaaaacagaagtctcaatttacctacacatttcagtggttcagctagaaacaaacgattcacttatcgttgattcctcccttccctcacctcctgtattaaatacatcagcaagacctttctgctctatctctgaagcatagccccaagctcaccacttcctgccactgttacttccatcaccccaatccaagccattgctgtcttttgcctaaaccaacacaacgtcctctttgcttctctccctaaattcattcttgcttcccaataatccaatctcctcaaaatttaaagaagcaattgtttaaaaacatacatcagatcactcccctttccctacttaaaccctccaatgccttctgttgccattagaataaaatctaaactcctttccagggcacccacatgacccggtccctgccatcgttctcatctcttcctctcaatcacttgactctggccaccctggcctctttgctattcctgaaactcagggagctcatttcctcctgggggcctttgcaattatggtcccctctgcctgggcagctcttcccccagatctttgcataactggcccttcccctcctcaggtctcagctcagatgctgcctcctcagagagaccttccatgataccaatcatcctctgtcacattgccttgttctgcttcttttcttcgtaacgcctggcattatccaacaacttctaatgtgtgtgtttacctttcgtcctccatcagcactgtgctcctaagagctgaggctcggtctctctcacaccactaaacccccagtatgccaagcagcacccagcacaggggagatgctcagttaatacttgttgaatgaattaatgatgctccccctaaaactaaactttacaaagcacccactagacaacaggttagaaaacattttctaggccaggcgcagtggctcacacctgtaatcccagcactttgggaggctgaggcaggcagatcatctgaggtcggggtttgagaccagcctggccaacatggtaaagccctgtttctactaaaaatgcaaaaattagccaggcttggtggcaggcgcctataatcccagctactagggaggctgaggcacgataatcatttgaacccaagaggcggaggttgcagtgagctgagatcacaccactgcactccagcctgggtgacagagaaagaccccatctcaaaaacaacaacaacaacaacaaaatgtcttctgtaaagacccagatagcaagtattttaggctttttaggctacctggtctttgccacaactacttacatctggcactgtcaggcaaaagcagccataatctgcaaatgaatgggcatggctgtgtgctcataacactttatttataaaacaagaacagtgggccatagtttgctaacccctgcactagcccagtctaagtcttgaatatcatctgtgtaattaattcacagtgaggagttctccactgtaataattactcattccatgaatgcatgccactcaggtgaggcgttcttgaaactctgagaggcaagaagcaaaatgttctttctccatacccaggcacactccagtctgtgaaaaggaagcaagagaggcaggctgcaagtttgatcactgggtggctgctagccacctctccccctcagctccaagagcagaaacaggatgaaaacgcagcagctgccggcttctgtcctcttgccagctgcctctcttgcaagactagacagggaggggcagccgccagtctccggaggcacagactgcacagaattgaggatcacttgttccaatgcattcatcttatcttacaaaatcttcaaattccaaaaagcacacgtaagaagggctgctgtttcattcacacagtgaaatattgtgcatctgaaagaatatgtagatgggtggcatcttcaacaaccccaggatcacagacgtttaaatttcaccccttctactgctgtaaggcacagcagaaggagtgtaatttaaacgtctgtgatcctggctgggcgtggtgactcttgcctgtaatcccaacacttagggagcccaaggtgggaggattgcttgagctcaggagttcaagaccagcctgggcaacctagtgagagctcatctctacaaagattttttttaaaaaaattagccaggtgtggtggtgcactcctgtagtcccagctactcagcaggctgaggcacgatgatcccttgaccctgggagatcaaggctgcagtgagctgtgatggtgccattgtactccagcctggggaacagaacaagaacccatctaaaaaaaaaaaaagaaagaaaagttcatattccaaccaagatctcaccattgcatcatcaagcataaacacctgcccccactgaaaaagtacagaggaaggcagtcatataatatcttccctcctgacctcaccaagttccagggcaggaagagtctcgccaccccagcacacagtaggcccactggaaaatgagtgctcccttctctaggcatttcattgtcatggtcataaagtcaggttcatttttctaatgaaagagaaagccaaaaatggaggctgatttttttcttttttctttttttttttttttagtctcactctgtcgccaggctagagtgcaatggtgcgatctcggctcactgcaacctccgactccctggatcaagtgattctcctgtcagcctatcgagtggctgggactacaggcgcccaccaccacacctagctaatttttgtagttttagtagagacggggtttcaccatattggccaggatggtctcgatctcttgacctcatgatctgcccatctcaacctcccaaagtgctgggattacaggcatgagccaccacaccgggcctggagggtgattttgaccaggccttctcaagttttggaaggaagtggagctgacttctcttctgttgcttttgcccacccaggatcacttattcctctgggtaatacagcaccccaggcacaggggccgcctgtcacatgagcgtgggcatggctcatgtgcggccaggccccagtgattctgcaaaggttgcccataagtccttcccccgccccaggactggcatattgatgtggtgggatggaagctgtccttctgctgggtctgcagatgggggcaatgtaaagcctgacattgccggatgatgtcagaagcggaacccataggcaaaagccagctttccagcactccactctcagtttcctgccatctccacttctgtggatgtgtgcccggcatctgcctctgcccctgcctctgagagcagtgactgagcaaacagtcctggacctggttgaaaggatgggcctgtctgtttctagcagagtggtctttcagaaagctgattcctgaaagttggcatcaagggaagcagagccaggaggtggaaattgagactgggtcccgctatgcatgaagccagagactcttggatttctccgttacttgaccagaggaatgccccattttgctcaagctagttggagttggatttctgttacttgaaaccaagagagccttaactaatacacaactagaaatgcatccatggtcactgcccattcatgtgacagacatttattgagcactattccagttacctaatgttgcatgagttaccccaaaacttagaggcttaattcagtcgtataagatattcacagatcccgtgggtcaagaatttgggaagacactgtaggttgaactttgttctctgctttgtctttcttggaaagagaggacacagcttgaagtcattactgatttgggactgtatgtaatgcatatctgtgcttcattgtcactgtgtttttaagttttctaaacttaaaacagctcattttcgggggacataaagaacctgggaagagctcagctgggcagcactgacctggggtctcttgagtggtggaagtcagatgtcatctgcagttgcactcaccagaaggcttgaccggggcggggaaattcgcttccaagctggctcactcacgtggtggcaagctgtacatgctgggggccaggggcctcacccctccccacgaggctgcctgagcaccctcacgcaaggcagttggcttcccgagagccaaagtgcaatgcctgttacgacctagcccgagaagtcacacatcatcactcacttccaccacttcccactggtcgcacagagccagcctgattcagtgtgggaggggaccacacacaaaggcagtgtgcatccctgggggccatcctgaggctggctgtgtaccacaaacacccgccacatgccagggactggacacacagcctttgacccccactgaacatcagcctaaacagaaggcaaccaagcaaaccttatcccccaaactctttccaactcctcccttaggacggcccctgcttttaagtaaagggaatcgtgccgaataattgttcctattaaggaactagatctcagggtttggtcatgcagctctttggttacagaaacaacgctgatgaaataatcgaaggtcctccaccattctcacccccagccatgaccccgtccactgcacacagtgctccacgtcactgtgcctttcctaactttactacagcttatacctgcctctcctgtacaacatccacgtgacatccatctctaaacctctgagtcatccctagacaagctggcatgtgactacatcatctcatttcatacatcaagggcaggaaaacatggtggttaagaactcttggacctgggttcaaacccctgctctgccacttgacagctgcaagattgttcagcctcagtttctttctctgaaaaatggggctggaagcatacctacttcatgaactcatgaagcatccacatgcatgcaagggcacggcacagcgcccggcacacagtagctcaagaaaggctggttgtgcctgctggtgtgcttgatccagagaggcaatcactcatttgctttttccttatttcctgaatctttgtttctcacatttaggccattagagttaagcagaaggactgcctcttcctccagccatctcaccagtccttccacatacacatgcacaaacacacacacacacacacaaacacacacacacacacgttctcatgctaccttcggcccttcccatctcctgtaaccccagaaaagaagaccgagttgaagccgttgccttagaatggcactgccctggccaggtgtggtgactcatgcctataatctcagcactttgggaggttgaggcagaaggatcacttaaggccaagagttcaagaccagcctggtcaacatagccgagaccctgtctctacagaaaaatcaaatcaaataaaaagcttttaattaaaaaagaatggcaccgtcctaaagctcctgaggtgtcctcatcaaggatttatggttgtttttacggccactttaataggcagaaatgtgcacagagcagagttccccaagaatctgccatcttagaccattttgttttttaaatacctcagcaaacaagtctgtctcatatgacttttgtcccattccaagtctaataacagcccgggtgcggtggctcacgcctgtaatcccagcactttgggaggccaaggttgatgaatcacctgaggtagggagttcaagaccagcctggacaacatggtgaaaccccgtatctactaaaaatacaaaaaattaggcgagcgtggtggtgggcacctgtaatcccagctactcgggaggctgaggcaggaaatcgcttgaaaccgggaggcagaggttgcagtgagccgagatcacgccactgcactccagcctgggccacaagagcgaaactcaaaaaaaaaaaaaaagaatctaataacattaatgtttacttctcacaggaggatcagaggacttctgtcctgagattgccagaaaaatgatgaacagaaaattatacacaaccgaacaggcccaactttcaaatggactgagaatgacccacacaagttccaccgaggccaagggtgacctgcagccagcgacagggaaagactgccacttactggcggcctccggaactggaaggagtgtactgacaattgtatctttcgcaagctcttaacctttataccgtcaataaaaaccccattaacatttaaaagggatgtttctgggtgtccacttggaataagagttggaaaacactccaagaaatggatcctgtattaatatcacatctgtcccagatctccaacactgttcactttccttccacggtgccaacaccaagctagctgataggtgggaacagggcagctctgcggttggcccccaagagccagggagtcccccaagctgaccccctggggtggcagtggcacctaacaagaacttccaccttgttttccctctctccgttttgtccttttggactctgctcacgcatcacatccagaaagttccctaagctctccagtgggatgagaactctgctctgtgctcctgtggtcctccatgttcctccacctggaggccctcggctccctgcattacccctgtctacttactgacttgccttctacccagtgatgggccatgtgctgtgagggcacacactgtgtgcccatctattcattcctctgtgcgtgcgttcattcattccttactgaatgcccaccaagtgccaagcattggggtacgaagaacaaggcagacggggcctccctggcctcttccagctcgctgtagagtgttgtctaccctactcatcctcacatacccatgcctgtcctatgtggcactcaataaatgtcggatggatggatgtgtcccctccttcaatatcacttaattcacttgatgacttcctgtgaggattaagtttagctgttaaaatgctgtgacttcctctggatctctgatgcaagccggcaacctttaagcctcacccggccgacgtaggcattttgtttggccaaagtgtgtggttttcttaaaaaaacactgcatttgtggctaacatttaaaattgggaaaatttcacgtaaatctttgtttttctggcttctctagaaaaatgaacgcacatttctgcacagcaggggtgagccagagctgagtccctaagcttcccttagacgtggtgggcacacttcaacttgccacaacctccactatctccgatttctctatcactgacgccaaaagctgctggggaccatgttggctgagctcgtgtttttcctgccccagccagcttcactcaggactctgacttgctctacatttggctcaactgaagactcccgggggttacgtgcatgtcatccaagaaatacatctatgatgagctacaacacaaatgaatgggccattttattgatttttacctcctaatagtggatacaggttgccgtggtttccagcaggatctcagatgcaaagggaagtgaagaaaacagatgaatccctagggtaccccgccatggaaccaaacaccacatcaactggaactcttcttgcaaacgaaggctgaagatcaagaatgacattctcacaccacagcacagcttaaatacttctttgacaaaaataataataaattatatttgactcagaaaataaattctgttcagcagagtgacaggagggtccattcattgcattgcacgaggggctctacggaggggtgaggatgggtgcaggatgccacagtgacaagggacatggggtgcgggcccagcagcacaggctgaagttagctgacgcatgcttttggcttttatcccacgggcgggtagtggccggacccctggctgtggcctgtcccaagtgagactgcaactgtccccttcctcctcacgtccgccttgtcttctgtttcttggcttgtctctttgcatcttctgggccgctattgtcagaggctgcctggccgagcgcgccgactccctgtagccggcttgtcaactgcagcagcaaaggaatgagctagaaaagagagaaagtgtgagagagaggggtacaaagaggaggcttttgccagatgaacagcggagcctcacttctcaacacaccttcttcagacatgatcagcagctgccacgtgctaatgggtgggtttcagttcaaacgaggcaggcctcttactaatgagtccccagggatgggctggcctctctccgggcctaatatgtccctagaggtgttccaggtttaaggattaggagatgttacagaagtttacagccttgaaaggagacctaagtctggacttgaggccttcacgggccctcccgacccggaaatgtgatttctgtgaccctggacatccctctgctatcactcctgcagctgtgaggactcgctctccctgacatgcccgccatctcctgaggcctctggatttcctaccttgtcatggttgtaaccggccagcagaaccagcagcgtcaatggcagggcaatgtaggatccttgtgcgatgtcctgttcaggcagcttcctctgcaaacaccgagagccccatcactcctcaccaaggccacaagcttgtccatcatccacaatgccacagccaccacccacccagccttccaaagtggccacttgaggacacccaggggccctcatgatccaaattccttctatccaaaggaaggaaccaaagtgatttggatgtattttcccatgaatcctcttctgcccaaagcttcactatttgcttctgaaactcagggacaaagagattccaatgacaaggcattcctcagcctctggaccctcctcccaactgaggaaatgaagagatgcagctatcagagagtcttggtggttgaaaagcaactgggtctcagtttgttgagtcccagcaacatgcagggacttagtcctacaaggatgtatcaagaacctacagttctagacccagggcacacagtgatgggcagctattcccagccagtacggtctagtgaggaagcaaagcaggcactgctactagcatccctgtggccattctccctttctcccaatagaacccccaacttttatctgggccaccgacaatatagatcaccttttccagccttccctgcagcaggcgcagccctggaactaaattttggccaatggtacaggaacagaagcggtaagtgccacaccctggctggaccctagggaagtggtgtgccctcccttttgctgggtagacagcatttggccaattgccccattttggagaaaagcaatgcactggaacagcacaatgagacagaaggggcctgggtcccctgacgccttggagctaccagactatctctgcactggtcactcctggacacttgacatgagacagacatttccatcttgctaaagcccctgaaatgctgggttctaaagcatcaagtgaacctatatcccattggcccactctactctcataaaggaagcaaataaatggaaggagaacttcccaataatgataaaaacaagttaatgagccagagcagtgttctcagtgtaggataccgggactcctctcgcagaggttcccgaggccacagctattttcagccaatagtaagatgtgatgtgccttttccgccctctttcattcgcaagcacacagtggacttttccagagactacgcaccctgatgtcatcacgcccacagctaacggaatgtgtagcttgtgagttcttgcgttttcaacatctcggttttaattactaatatgataaatatacacagagataatccatgcaaactcaaactctttaaaatcctcaataatttttaacagtataaaggggtcctgcaaccaacccatccgagaactgctgggctagagagtgactgtgggggccgctgtacctgggatgccctttcataaatgaaagaataagggcaggaacagatttccatcaacaactgcctactcctgtatctctggacatctcttagaacccaacccatttttccactgaagtaaacacttacttaaaagtttaattcaggccaggtgcagtggctcacgcctgtaatcccagcactttgggaggctgaggtgggcagatcacctgaggtcaggagtttgagaacagcctggccagcatggtgaaaccccgtctctataaaaatacaaaattagccagaagtggtggtgcatgcctgtaattccagctactcaggaggtgagaatcacttgaacccgggaggcagaggttgcagtgggccaagatcgtgccactgcactccagcaggggcaacaaagcaagactctgtctcagaaaaaaataataatgaataaataaataaaagtttaattcagcaggaattaagagtgattcagtctaggctcaggtcccaggcctcactgggtaaactcaggcaaccacgttgagactcagtttactcaactatgacatggagatcatatgaacaacacccactgggggtggatgctgtgaaacttgatgaaaggagtatgtgaaatgctcagcagggcatggaatactgagtaaaatccagtcgcgaggctgtgggcagtcacatcaacaaagaaggaaaccaatgtgcttacaaagcccccgtgaacatgcaatgctgagccactcatcacgcggagggcagaacgaggtggaaaccatgtggcttgagacaaactgcctcacttgagtcctggttctgctaacactcagtaagtgactcaatctttctgggcttctgtgaaaatgggaggaatggcacacctgcttgaaggcttgttgtgaggatcaacctgtgagggccctgtacggggtggcacagagtgggcgctctcttcattcaacacttggccctgctcgggaatccaagccccagcaggcacagcttttttttttttttttaattatactttaagttttaggatatatgtgcacaatgtgcaggttagttacataggtatacaggaaggggaacatcacacaccagggcacagtttcttacattctcagaagtgacaggcagcagctacgaggctgggctgctcggccaccaccaagcagtgtctccacattcctgccactggctcccaggtgtgtccctgagcccggatgagttgtctgctaggggcccctgagaatgtcactgcctgcagctatcaacggccttcacagaagcctctcccagcaactgggccacaatgcagccccaagcaaaggtaagtggttcttgtatatgcttatctttctggcactttcttttttttttttttttttgagacagtcttgctctgtcgcccaggctggagtgcactggggctatcttagctcactacaaactctgcatcccaggttcacaattctcctgccacagcctctcgagtagctgggattacaggtgcgtgctaccacgcctggctaatgtttgtattgttagcagagatggggtttcactttcaccacattgcccaggctggtctcgaactcctgacctcaaatgatctgcccacctcagcctcctaaaatgctgggattacaggcgtgagccaccacacctagccctctccagcactttctaaccaggtctctactgtgagtaacaaggaagtgtttcctcgtgggtcatgagaaaaactctcttgttcaggtaagatcatatttacaggctcactgagcatgaatcactcttcacagaagcccagaatcagcagcagagctctgctcaagccctagcactgctccacgtgagctggtgaccttgggctgctcacatctccttctaggttcccatcttctcatctctaaatgaaaggtaattcctgtccaccttccatgcaggatggcgtttgaaaagcatgaaatggtaactggatagcatgtggaaaaagacaatctggagccatacttcacatctataccaggaaaaactccaaatggatagagagatttaaatgtaaaaacagaaactataaaagtctgcctgaaaaaaacacgataaattcctgtaaaagctgggaatgaagaaaaccttcctatgactctaaaatccagaagcaataagaaaaaatcaacacatttaacacagaaataaagtaaatctttgcagaaaccaagtgaaaagataaatgacaaattgggaaaaatatgtacaacaaacattacaaagggttaatattcctagtatacaaagagctgaaaatggttgaaaaagaccaaaaattctatagaaaaataggttaaatagttcacagaaaatacaaatggctcttaaccacatgaaaagagagaaatgcaattagaagtacagtgagataatatcacttctcatctataagcctgcaaaaattgaaaaatttgacaaaatactctgttggggaaaaaagggtactcattcactgctggcgggaatataaaacagtaaaacccccatggatgggaagtggccgtatcaatcaaaattccgtatgcatttaccctttgactcagcaattccacttctgggagtctattccaaagagagactgacgaacactcaaaaacatgcatgcgtaaggcaattcattaaagggttatgtgtaatagcagaaaaccagtaacaacacaaacgcccctcaaccaggggctaactgaatatcctacatgtagtgccaggatctgaatgtgtctgtgcctacgtaattcataggttgaaccctaatccataatgtgatagtgtcaagaggacaccctttttaggaggtgattaagtcagggattaatgccccgtaagagtggcctgagggaacttgtttgcccctttccgccttgtggggacacagctaggtggcaccatctatgaagcagacagcaagtcctcgccagaccccaaatctgccaatgccttgatcttggacttcccagcctctagtactgtaagaaataaatgtttgttgtttataagttacccagtctaagatacaaaatagcagcccaaatggcctaagacacacggtatatccacacagaggaatgctgtgtcgttatcaaaaaaggaaaaaggaggatcggaggatattgttccacttacagttacatcttttgaaaacaataaagttcttattctgcccactgaaaaggcctagaagcaacaaccaacacagtagctatgaggccagatttttgtttttaatgcagactcctgtgctacactttcaccccgtcaagttcagaatcagcagtcctgaggctgagccctggactctgtttttgctattgctgatgtgtctgtttaatcatcaggtgacaatactgcatctgagctttaggaatcactaaacaattttatcaagaaggtaaaagatacgtgtatgttttgtttgttccactgttccagcctatcggatacaggacagaccgtatgcaacagatacacatattgcaaatagtaagggccacatattgcaatgaattaagcgataagttaagtttcttttaacccacaggtattctgtccatctgttgttggtttttttttccttgcaatttatttgtcaaacaaatcaggctccaggtggttgtcctgcatccctgtggagtcatttgcgtgctcctgggtcctccctatttcctgtaaagtagcagttggttctaggggtttgcgtggccatgtaccatgtgctccctcatggagaagcacacgccacaccagcgatagtggtgtccctcctcccccaaaatcattcctgagccaccgatctaaacaattacactgctcttattaccagtttcctcctcaaagggaatcgcaggcatcagtgctcagaaaagctaaaaacaatctggggaagcccagaatccagaaggcagaatgagaaagtgacccaatgccaggagccctttaaatatctgccctgcaacctgcgacctggagcacaggttgtatggacatgccttctttcgccaccccatggattgttttgttttgttttgttttgttttgttttgtttcttctggagaaagggtctcactctgttacccaagctggagtgcaggggcatgatcatggctcatcgaggcctcaacctcccaggctcaagtgatcctcccacctcagcctcctgagtagccgggactataggtgcgttccaccacgcccggttaatttttgtattttttgtagagttggggttttaccgtattgcctaggctggtctgaaactcccgggctcaagagatccaccagccttggcctcccaaagtgctgggattacaggcgtgagccaccaaacccagcccatggatttttttttaactccctcttttacttaccgtgggattaaaaatcaaggtgatgtgtttatggtagcccactgcggtgaaagaaacttgaggcaagatgtagtcatactgggatctggggagtgtggagtccagaagcacaacatagttctgtgcacacatgggaagaagttatttttataaggacagctctggcaaagcaaatgaaaactaaaacctaacgtatggctgtgatgtaaagaactttatgtttttaaagaaatccccaagactacacatccaaaccaaggttgctgccttcaaagtatcaacctcagcgggctattccatcagtggcgggcatgtgtccccagtgtctctgagactgtggcttctgataaggctgtcagagcctgcagcctttttatgagtacccaaccttgacaattacggtcctctgaggatctgactttatgaaacacaaaaaattattatgagccaattctgatgagggaggtacgtgatacaactgaggatccacaacggggctgacttctaagggacgatgcttgagaggctcgtaagctggcaaatcctaaaaatacagcatccctggaacggcaccaggggcagccacagctctgtgtgctgagcaccgaccagctgccaggcaccatgcacattgcatgaggcccgtcacagctctgtgtgctgagcaccgaccagctgccaggcaccatgcacattgcatgaggcccgcggctgctttgctttctaccactggcaaggtcgggatcatcaccccgtcttatagacgaggaaagtcaagcacgaagagactaagagtaacttgcccaaggtcactcagctaagaaggctgccacacatctatgaaggctctgaactcaggggaagtgtgaccccaaagcccaagatgtttccgcatcgctgtaggaagtgactatttcaacacccctggagaaagaggaggagaaaattccgtgacagcctgtttcattatttcgcagccattttccacagagaaaggccagagtagatcatcttcacggcaggtggtaaggagccaggagaggaaacgtcaccctctaggctcacacttgacatcctcaggctaagaccaccagaaaagaaccaaattctttgcaaagtttgcactccccacaccaactacaagttagctctgtccaaatagaattgataataagcactttataatcagtaaatgacggccagaataatggctgaaaacttcccagttccaaggagggagacatccagattcatggaacccaaaggacactgaaaaggtggagctgcaagtgttctacacgacacacgttataatcagattatcaaagacagagagaacgttcaaagcagcaagagaaaagcaactcatctcattcaagggatcccccatcatgaggaaactgtatttccctaaactcaatagcagaatgttaaaatagaggaatttttaaaaattacaaggcatttttaaaagtggacttcttagcaggaaagcatggggtgatatgttcaaagtgcaagagtcgatcatgcccaacagtaggccttggttaaataaatcatcgcgtttcctagtttatggactactgtccataaaaatcatagtatgaaagatttggccaggcacgggggctcacgcctgtaatctcagcactttgggaggccgaggcaggtggatcacgaggtcaggagatcaagaccatcctggctaacatggtgaaaccccgtctctactaaaaatacacaaaaaaaaaaattagccgggtgtggtggcgcacgcctgtagtcccagctacttcggaggctgaggcaggagaatggtgtgaacccaggaggcggagcttgcagtgagcccagattgcgccactgcactccagcctgggcgacaaggcgagactccgtctcaaaaaaaaaaaaaaaagaaagatttgatgatgaggaacagatttgtgataaattcttcattgaaaagcatggattacaaaacaatgtacaaaacagtgtcagttttgaattattaaaataaatgtctatttatatttatacatgcatgcgcacacgtgcctgaaaaaagacccaaaggataccaatcaccatgttagcagtggctatttctggatgatgggcttatgtcttctttttcccaaaatctcctgccatgaatatgtattctttttgtaaacagaaaaacaatgaagaaaaaataatccctacagaacccaacctcttttgattcagagagcgcatttctgcagagtggtatttagggagaaaaggagagaactgtgcttccttaaactaaacagcagaattattaaaacaaaggcagaaggtagaatccggccacaggcattacctcgccatctctgagcagtggggggaaatggaagaacagggactggccaagggaaactgtctggattggattgtcgaggttttcgcttttgtaaagcttgacctggagggagaaacaaagtcagacatgctttgaaactgaaacacaatcaatatttcatagcagacatcctcaggacagccgctctctgggtaggtgtctttggaaacatggatatttgaaaaagaaagctccctccatagacatcacacatccctctgtcatctgagactccatccagttatgtatcatgcacagaaattaagattcaaatcagattctgactacccatgttcttgctcaaaatagtaatataagttaatataatagtaatattaaaaatagcttctaacacgtgttgaacatctgtaatatgccaggcaggcgccagatattttatctacattatcgccaatcctgactacaaaacaggtattgttattatccctatggagacccagagagccaaagtcacctaaggtcacacaacttacacatggtagagcctgggactcaaccccctgacgactcctgagggtccttcccgccttgcactgcctcatcatatgatgtcaccttaactccaccaatctgttaaactcaaaacgcattccatcatgtacgtggctctccacgctgcttcaggaggcactggagtactttgtttctggctttatttctggggttgttgcctgttctcactcccacacgggatggggcatgagcagggttaaggtgcagccctggctgatggcaaaggctgtgaggatgccacagtgcacctgccgcaagagaatgccaggaccacctccctgggcccacactggcacctttctacataacacaccaggggaattttcctaaaatgaaagtcacagactgaaggttatgggtcgcattgaagatcccttatgtgttcttttttcttctataacatcttaagtaaatctgaattcaccgactatatttaaaaatcaggtgatttcaaataattctaatttccagcttctccggaaaactgggaagtgacaccaaccctgagcctcaattctagcacagcaacactcaggagcaagagagtggcgccctcccctcctctctgcctcttcccctcccttgtgcccctcatggatggggcaggagttccccagtttgccccccaccctacccaaccctctgcactctctgacattacctgcctggtccctacaagcacacgcctgcaagccctggacagagtggactaaagcgcacacacactttctcacccatgccaaatacttaactgcttataaaattacaagcgcatcttaacaatgtacccccagagcaaatcactaacatccgcagagggtctgcagggtattttataaacatttcttcattaatggtaacatggagattttgttagagctgaacaagattataagaggtctctgagtccaaaatctaggttttgcagaggacgaagtcgaggcatgtggaaatgaagtgactggcccaggcagcaaggtgagtcactactggagacaagagaaagcccagaccacctgctctccagcccaccgtccaccacctctgatactgtttggatatttgtccctgcccaaatctcatgttgaattgtaatcccccgtgccggaggtagggcctgctgtgagatgatcggatctttggggtggatccctcgtggcttggtgctgtcttcgttatgagtcttgtgagatctgatcatttaaaagtgtgtggcaccatgccccaactctctcttttgctccagcttctcccacatgacatgcctgctcccacttcaccttctgccatgattggaagcctcctgaggcctccccagaagcagacgccactatgcttcctgtacaacctacagaacgaggagccaatgaaacctcttttgttataaattatctagcctcaggcatttctttaaaccaatgcaagaacgtttaatacgacctccactccagagaaaattttaagttacaaggcgctttctttagaattggctttccacgttagattccatattgtattgatcattgatcaggcttctactataattctttggaagattaactgatggcagacagttatctgaaactggaccacattctctcccacaactggcaatcactctcccaaatacgtgttgtggtccaaggttcttaaatctcaacctcaaccctcagcaggcggcactctggagcacctccacctgtcacacctaaggcacgagacaggcacaaaaccaaaaacatcccattcgtacttgtctcaaagccaaagggaacacaatacttggagcttaaaagtctggacttacccataacgtaggaaggtattcagaggaagtgatcacatttccacttaaatcaaattgattaatctgccggaaaactatgatgtttacatcatcgatgtcattattcccaacctagagagagaaagagggaatgccagtaatgagaaagctggtggaggaacttctatgccagctgtccgatggcctgagagctgcttcatggcaaactttgcttcttacattaaggaagctaagtttgtcattgagtaccctacgtccaaggtcacaaaccgacagaagatggctatccctggcccatagacacatttcatttcgaaagcacagtattttttttctacgtttgaattacttgccaacatgttaaaaattaggaaatttcatatatgaagccagattttccagcttctcttaaaaaaaaaggagaaggatgctcttgcctgttagagcaggggcatatccctggcccatagacacatttcatttcgaaagcacagtattttttttctacgtttgaattacttgccaacatgttaaaaattaagaaatttcatatatgaagccagattttccagcttctcttaaaaaaaaagaggagaaggatgctcttgcctgttagagcaggggcagagtcacagcaccccctctgcgtgaggtctgtacatggagtttgcgagatcccagagggccggcccccttccctttcatacctgcccggccacagtccacattatgctagtgatcctggcctaagttactacaccgagaacatgcaaagcattttggtgtgagatgcagtcatcccagccatttaaaatgccaacaccgtaaagacgtcaaggaaatccacttccggcccggtgcggtggctcatgcctgtaatcccagcactttgggaggccgaagcgagcagatcacctgaggtcaggagttcaagaccaatctggccaacatggtgaaaccccgtctctactaaaaatacaaaaattagtcgggtgtgatggtgtatgcctgtagtcccagctacaggctgaggtgggaaaatcacttgaacccacaaggaggaggttgcagtgagccgagatcacggcactgcactccatcctgcgtgacagggtgagactccatctcaaaaaaaaaaaaaaagaaaaaaaaaagaaaatccacttcctaggtcaaaagttctatcctccctcacaatcttcatgcataatgaagccacctaaataaagccactaagaggcagcccctcttgccctacctaagccctctagtcttcccaatgagagttactcagtaagagaaaagccttacttcaaatgattcccaggccacattctgtgactcgaaggatgtcctctttagggattaatttagctaggtcatgatcttgagtatcaaaagactctgcccacaaaatgggagcaggaaaaaggtcatctgaacctaagataactgcgtggccctgccacccattaagcccatgtgctattattgtcccttgatttgaaatgctgcttaggccttaagttccttaacttgcagaataatgatcagagcttacagggcaagtcgcggggaggatacaacagttccaatttcctttctggatgcatgacagcaacgctgttcactaaaaacccacataagattctgcttgtgaagatgacactattctaagaggacccttaattaggatgaaagttccccccgccacagatgaaaggcagacagccagaggagacgggaggacttctgattagggaggcacccacacccaggtgcagcggcagcactgaatgccttacctcaatcaccctatggtgggggagcgcccgctcaatgtggtcgttgccttctgccttgagctgaacgtggtacacacatcccggctgcaaaaaaactcaggagtcagttctctagaaagggggcttgtcgtatcgtgcctggtccaagcctggtttggctgcacgagatcattaagacaggagcatttctctcccctcatttcctaatctgtggcctgttaaccttaagagtccagagttcctttaagaacacccctagtgttgaaacatctgaaattttgcgactccttccatcccaactcagtttcattttctcctaccccaaaataaatcaaatttggtttcttatttcaaaattccaagcatactatgtgctcttactcttctaagatgtttttcctctccatccacccctcccctctacccgtatatacacattgatggatatctggaatgtccaccataagcattcccaaatgcttgtgttgggtattatttctgggaagtgggaatttctgacttctctttttaaaatttcaaggatctggcaaccctgactctgtcttcccccatggctacaataagctggaaccaagtgacaggctgtccctttccacaggccgtgcccactccacagccctcaccactccctatcatttcgcacagcctcctctcccccgttcatactgctcttctggctccataggcgtttggcttgagccctggcgtaagccatggccacatactgctagggaaaagccctaccaaacccatggttttccaactccattgtgccacagatccttgatctgacctgttggctagaaaaaaggcaaactctaccaattaaaggtaagaactgggagggctccagagccccacccccagccctctcgcccaacccactcctagcagtcttggggccaccacaagatacttctggacacaggatgaaaaaaaagtccccaaagaaaacacattccaagtctcaccagcaatccacgtaatctgaacttgccctcttcgtctgtcacggtgtcttctccgtaaatgctgcagtcgttctggcccaccgcttccatggcaaccccttgttcgggctctccgtttaaggaagacactgtgccatagcaactagtatggcaagaacaggcacgaatgagatattctcatggttatctgaaggacccaagtgtttcccgtttaccaacaattatggggcaaaatagttcaggggagaactgtgcctcaatgacccaggcaactcggtgtggccggcccactttcaaaccacaccttcctgccggagggataagctgccatcaatttcttttctcatacattttgagggatgctctggaaaattgtaatttaagaaggctaaagctttattttattctttctaggctttatttgaaataatggagctttcaataacatggaaataactcacttcctctttcattccatatattcagtagaaaatggtccatttttctaaacccaatctttccaattactcttcctctaaagtgattctgtataagtctacaaaaaatacacatatgtgtgtatctgtgtgtatacatgtatatatgtatgcatctctctatctatagatgtgtatcttttttattttgtatttttatttttttgtagagacggggtcttgctatgttgcctaggctggtcttgaacttccagactcaagagaacttcccacttcagcctccaaaagtgctgggattataggtgtgagccactgtgccttgccagacactcatgtgtatctatctatctacagctgggagcattcagaaaaactggaagtactggttgtctcccagaagaggaacttgggtggctaggagacgagacagaggggaaattttacactatactcttttcagcattttgaagttttattcaactgagcacattttctccttttaatgatgtaattcaggtttgaaactcttttaaaaaataaaagtggccaggcgcagtggctcacgcctgtaatcccaacactttgggagaccgaggcaggcagatcatctgagatcaggagtccgagaccaacctggccaacaaagtgaaatcttgtctctactaaaaatagaaaaattagccatgcatggtggcagtcccagctacttgggaggccaggacaagagaattgctggaacccgggaggcagaggttgcagtgagccaaggctgcgccattgtactccagcctgggcaagaagaatgaaactccgtctcaaaaaataaaaaataaataaaagcttttagcaactcaataggctctctcaagccaattccaaaataggaaatttgagactgaaccaccaggttgagctcctaggagagaagggcagcagtcaaaactcctttgccctcatatctcatctcccttccctcccaagtaaaatcagtgtgaagcctgggatgcgtttccaggcaacagaggcctgaatgtgattcaccagcccagccctggaagagagtggggtggccagggcacttacctgtaagcggttcggtaccccgtgatggtgatcttcaggttctggccttcctgcacctcgatcatctgtgaggatggctcaaaccggaactccttcatcatgggtttgaagtaatactggccagggctctgccaagataatcacactgagcctcagcagccacatctaggcatggcttaaaagtgaggggcgaatgtcacgatggaccagaattacaccaggggagcgccatggcttccctggcagccaaaaatagtaaccctctctctataatcaccactcacagtcaggtagtggcaatcacaactctaacaacggcagctgatggtatcacctgcctgcaatgactcagagaggtagaagtcatatttaatttttcttttcttttttttttttttttctgagacagggcctgactctgtcccccaggatggagtgcacgatcacagcacaccgtagtctcaaccttctgggctcaagcaaatctcccacctcggcctcctgagtacctgggaccacaggcatgcaccaccatgcccagctaatttttttattttttgtagagatggggtcttcctatgttgctggtctcaaactcccaagctcaagcgatcctactgcctcaccctcccaaagcggtgggattacaggcgtgggccaccatacctggctcatatttgaatttaatgaataaagaaactgaggctcagagaggcaaagtaacttgcctgataggacacagcaagtaaggagcagtctgcatcactgcaaagtggtgtcttcagatgcccccactgcccggtctccagtagccccaccacagccactttgtcaccatgactgacaagatgaccaactaacacacacttcctgaatccccaccagtcagggcctccgactgcatcttgaaagaaaaactgctgctctcttcccaccaagtggaatgtcttttcagaagaaacgcaagctaaccaccaaacaagactcagcatcataaacatgattctgtggcaaaacgagaagacgcctaagagagcagccgttgtggccagggaaattaattacactgtcttagtgacaagcgggtgatcagaaaacaagaagcgcgtgtggaagggaacatgaatcagcagcattaagttcgagtaagagcaatactctaatgaccgtgggcccccaagaaactgaaaccactccacattggccttctcttctcacgttgtcaagcaacacataagtctcgcatgctgcatcctggctctctctcagggaagacaggcaggtggtaaattgcagaacacgttaccaggtttgagaatgtcagaatgccgttgtcctgggtcaagaggttggaacgaaacaggccaccactcagggataagaggactcccgggaggggctggtcatcctcagcttttatctggggatgagaaggtgagaccagagcaaggttaaactcctactaactatgaaaataacagttccacaagtcaagaggtcattttttcaaggtttttttcttttattgttactcaaaggaggacaggggacctaatcttcctccccacaggtaactactgttgtaagttttgtaagtttggtgtgtagccttctagaactttttttttttttttttttgagacagggtcttgctctgtcacccaggctggagtgcagtggcacaacctgggctcactacaaccttcgcctcccaagctcaagcaatccttcagctttaacctcctgaggagatgggactataggcgcacaccaccatgcccaactacatttctgtattttttatagagacgggtcttgccacgttgcccaggctgatctcaaactactgggctcaagcaatccacatgcctgggcctcccaaagtgctgggattagaggcatgagccaccgtgccccgcccagaactctttctatgcccacacaaattttataaacattacatattattgttcacagactggcaagttcattgagtgggtggaggaggtgaaataaaaatggcatgttatatgtacagttctgcaacttgctctcttcctcaacaatttatcctggttctcttctgccagccaatagaaatctgcctgtttcttaactactgcatagcattctaaggcagggtttgacaaaccacagcacctactcttgtggtacacaagagacaattggaatatccccaaatatgtatctctaggcacttagttttatttcctgaacaatccattcctagaagtagaattgttggatacatgcactttaaattcagaaagatactatctaattgcattccaaagtggctgtaaccacttacagtcccataaattatttatgcttgggaaaacccacacttaccaaaaaatagagattgtcttaattacagcaaatctaatccctgcaaaacagtgtttcgactgtaacttccttagcacatttcctcagtaactacagaggctttgtgtttctgtgtttattagtcacctgcgttacttccatgaatttccttttcataatctttgttcattttttttctagtgggttgtctttttcttaccaattttaggagctccttgtaaaatggggatattatttatgatacaaacatttcttccgagtttgaatatctttcagtttggttccaaatgtattcagcaatatagaattttaaatttttatgcgatgtaatctgtcactcttttcctttggcctatagtttataaatattcattctcaacgatctccagacccactctgtacaatcgcagcacgcttcttcccagaaaggaccggtggaagggagctaggcagcaaacgcctcagtaaaaacattctgtgtccttcaaaatggaacagttatggatgacagctttaactacttcccagaaggtacacaaacatgctaaagtcaacagctctccaaattatgctacgtgaaagaagtcagaccaaaaaaaaaaaaaaaacaacagtatatcctgtttgattccatttatatacaggttggtgcaaaagtgattgcggtttctgccattattctcaatggcaaaaaccacaatcacttttgcaccaacctataaaaactcgaaaatgcaaactaaccaatggtgatgaaaagcagatcatcagctcagcggaagggtggcagggagggattaccaaggggcaggaggaaaccttgagggccacagatgtgctattttaattgtggaggtgttttcatgggtgtattcctaggtcaagactaccacactgtaccctttttgtgcagtttattatatgttaattatacctcagtataactgccttttgaaaatacagtgttagttacctcaaagcttacgcctgccagggcataggccttgaagtctccgatggttccttccactgcagtcagaacatagccctccttctgtgaggtcaccgtgtactccaggtcactgtgcagggggccaacactgaagaggagagagcagaatgctagcaacggctttgttcacaccctgcaggaagccttaccaagcccaaggaaatgtgggccccagtttcttcagaggactcccacgctgatcccaggcaaatgtgtctctatcccgggctcacctgtaggcacctttgtcatcagtaaagactgtgatcagcggtgaacttgcccccttttcactgatgacaatctcgactccttccaactcggggtggatctggccttctaaaaacaggcctgccttcccgtggatctcgatcagcttccctgggcagctttctaagaggggaagaaataaacacaaggatggggcttggtagcagagacaggagcttcttggttgggggtttcccatgacaaaagtggctaaaacagatcttagaagctagttccaaatgcggttatttaacaccccggggagctcaataatcggatacagcccaagcctctttccatccctgaaaggcctttctcagtgtgaaggactttagcaagagaatcaaaaaacgctgaaggctgggtttttactactactcttcctaggttctcaggaggccacagatcaggagggaacactttacagcagacaggaggccgtgctgctcagcctctggaggacccactgagaaagaccgccccaaacagcctgcctgctagaagtcacgctcttcaacaccctctgcttccaaacgcgaaccacataacacccacaacttaacgaagccagagtgctgggaaaaaaataataagtggcaaaagacaaatactccacaagtgatcacttcagtcatccattccccaaaaaaagaccctcccatcatgctctgccaaacaacagaaagatcattaaagatcatcactggcagctttgtgcttcatctaccttctggtgtcgacctgataatgtcaaagaaaaccaagtccttttccaaaaagatcaactcaattctaacagcaaaagttacttttatttatctaaatcattcattcatccatccatccatccatccatccatccatccatccaacccaaccatccatccatccatccatccatccatccatccaaccaacagtaacatctgtgtgccagagaggatgtaaggtggcttacaaagatggcttcactataacatcacaaatctacttgtaaatgcaggcaagggaacaactgcaaaggtgtgtgtgacattcgctcgctgagttgacatttacctccactgacaacggcttccattgaagggggataaaagagcagctctttagatgacggtgtaacagtgattttctctccagacctaaaataattaatatacttcagtttggcgggtcctgtccccacaaaacagaggacactgtagggaaacgcacaagagagcttaccgcgcccagtaagagaaatcatacgagaaggggccttgtaactcatctaccatctcctgcacgggaggcttggtcattctttcttcaccttcctcattgccgtttttctccctctcctgcctgcgggcctcgatctcagccagctgctgctccctccgcagctcctgcacagacttcagagggcctaagaccaaggcgggttcactgtcgatggaagacctagaagaaagaaatggcggcccctaggacgtggttgcgtatccttgtggtcagtgggaatttgacctttctacgagtatggacttgcgagttacaaactggacatcttatcatgacaccacagtggcggagtcttctgttttaaataaactagtagtttcacaaaaaataacaactgagcttcgcagtgatggtggcagtatctggtagatctgggctggaatgaaatacggttgattttatggcgactggatataagcttgtagcttccatgtaggacacggagttttctccacaccaccatcctctgttctccattctaccttcgctgagaactgctctgatagagaactaggcaccaaggatacagcatcaacaaaacagaccacacttcctacccctgtggaatccacgtttcagtgggaaggggctgaaaataaagagaaaaataataccagaggaaaagtgcaataaagaaaaataaagcagtgtgggaagacggagagcccggagcactgttttacattaaagggacagtcaaggcctttctgataaggtgacattgagcaaaggtctgaaggaagggagagaatgcgccacgcagctctctgggtaaacagtagcttgggcaaagcgatgccaagtgcaaagtccttggagagaaagctcactcagatgttcaagcaatggcaacaccagtccagcctggggcacaggggcccacggaagagtcatatccaacagagaggtccaaggggcagcagatgtcagactgaggcttcacaggcttggtgccgacctggagccactggagttttcagtcgaggaatggtatgataaaagaaatcgttcgctccttcatggaaaatacacaaagcaatggcggaaacaggaaggccagctgagaagctgctgcagtgatcccagaggggggtcagaccagggctgagggccacgtggtgagaagggaaggccagctgggaagctgctgcaatgatcccagagggggtcagactagggctgagggccacgtggtaagaagcaaagcccagctgggaagctgctgcagtgatcccggagggggtcagaccagggctgagggccacgtggtaagaagggaaggccagctgggaagctgctacagtgaccccagaggggggtcagaccaaggctgagggccaagtggtaaaaagggactagatgatgggtgtattttgattgtaaagccaaggctttgttggggaattggctgggcctagggttcaagggaaataagaatcaagaaacaaggagaaagcgggagctgccatatctgaatcagaaaagaccacagaggggctcatggagggcaactgtcagcagtcgggttttgggtctgctgagtacacgattcccaggggaatccgagtggctctgtctagctggaagatgcattccatacaacctccggcacaagcaagcaacacaaacacccttgtgaagttacaaaaatgaatgtaatcaagctgaaaggaggtaacatgcagttactactggtaagaaggtagattgctagtcctatcagtaattcatactttccaagcagggagacagtaaatgatagtaaaagacagcaacagaccttcagcaaatccacccccagctaaaaacctggctccccatcaccagaaaccagggccagccctgacatttctcccgccctaacccagtggtcactttagtgccatgtctcatcaactcagtccctcaacgactctccgaccagtccgtcgctctccatctccgcagccactagtctggggcccccattgcctccccctgcctccaccacctcccactctcaggcctcttctgtctgttctccactcggccaatagggggaccttcaggaagaaaaatgtcattcctctatgtaaaacatgtcaattgcatcatgggacaaagactatggaccttaacatggcctggccccccgcagcctacctgtcctgcatgcccccaaggtcaagctcaaagcactcagaacagttgtcattttacggttctgcatgtgagtatctgaccactgttccccccatgagactgtcaatcccataagtgtaggggctgtggcctcataagcccagtgcctaaacactgaagactctcagtttttcagtcatcatgtactctgcagggatgacggatggataaacagatggtggacagaaagatggaaacatagctggaaaggtgacttcaaccaggggcaggagggagacagggactgcaatgcccattctacttgacagagacggtcatgttgccaaaactctttcatttctcaagaaaattggggcgtcacaggtacctcaccacactgcaaaaattccctgaaaggtgacattcacatgaacgtgaccttcggtgagggacttgcctttcaaatacttcctctctcacgacccttctcttataccaggtgccatctctatttcccaagccttcaagcaaaagtctaaagaaaaataggcaatttgaatttgctaaaacacttgaaatacaatgcacaaaccccagagattttttttttccttagcaaagatgagaagtacaaagagttcaaacagaaattgaagacactgaaacaagctgtcgcaacgctcttcctcacccacaggtaatttctgaatcagaaaaggaaaggatcaaggctgctgggaattgacggcaatgtcctataagagagggaaggccatttgtatatacatctagagataagaaatcaaaactaatttccagagagcctattagagactccccaggcctcatccacaccctctcccgccactctcggcccactgcagaacgctcatcttacttgatagtcacagtgacatccatcattttgtcggtggtgatagttccaaggacatggtggcgaatggctgtcaatgtcaagatactaggtgaagacctacaaatcaaagcagaggaaacgctagaacctactcattctcagaagatcatcagcaataccctttttgggcatccttcttcaccctaaatatactacagaaaattgcttttagtctggggtaaaataactctggagatccagagaagtattttaaagagtaaactaattctccactccacaactttatgcttccaattcccagtgaaacccacacacgtctgtaaaaatacaaaaatggcagacttgaacttgacagatgcccatcggtgagggctgggagatttgacaaagcttctatttaaggcacttcaaaaacacagccctctatcctggggttacagaattcttgggaaagggatcctgtctccggttcctcagtaactaatccaagtgtcttaaaatccttatctagaaatgctgttgaaggcctaaccttgcctctttcagaaaaaaaaacagaaaaactccttttgttctctgaagtaaatgaagaatcctccacggaatgtatacaaacaccacaaagcattcaattcccaggcttacgtgtcataggtgtagaacgcttgctcaaaccggtggcaggagcgaggggtcactttgtacacacctacagacaggaaatcaaaagtaattttcagagaatggcatctattacactgagcaattccgacatctgaaatcgagtggcagctctttgcatgtgaaaactcaaacgtatcgcagatctgcaataatgggatcagaaatactgggcaggcatcgttttcactgcctatgaaggcgtcttaccaatgacccgatccatgcaatggcccgatcacaggcgcatgattttcattttccataaggtaacaactcacagtagttaaatctgcacagaccaggtgaacggacccatgcacgagaaggaacagaaagtacgtttctactgcaaattggactgaggataatttcctacttaaaagattctattaaggatccaagagataaccacagcctcaatttcttcctataaatattcctaaaaaggaggtaaggagtaagggaagccccagaaaagtgtgagtctgtgtgggaggacactccgagtaggggtacatttcatcacttgccagaggaacacagtcaatttcaggaagatacaaggaataacaatgtatttcccccaaatcatcattaaccaatattttggccacacttcctacaaaaacctgaaattagctaaaaccaccctgctgttttcattgcactcaacaagccccagagtagttaccatcaaaaaaaaaaaaaaatcaggtttctctgtttgttttgtttggtctttcattcaacaaatatcgacagagcacctcttcctggccaggtattatgctaggtactggtacacagtggggaatgacagagcagtggtccctgtcttcatggagtttaccatccacagagagggggagcatttgacagccacaaacatatcaattgtggcacatgcaagaaggggatagaagtgagtgctgagagcaagagtgtaggaggcaggcctaagtggccctggaggccatccttccccagggaagcaatactgaactgatgggtaagaaggccccagctaggaggggcaggaggacatgtccacagagaacagcatctgcctcacaggctggctcattgtttcctcaacaggcatccttcctgccttgagaacaaaccctggttatgttgagggtggcaacgtgctcagcctcgggtagcacatccaactgtcccagcctcccttgcagctagaagtaaccatgtggcacggttctggccaataatacagacaagtagcttactggaggagggggcgcaaggaaatgtttgcctgccctctccttgactttctcctttaaacataagttttctaacaacagccatcttgaaaatacaaggcaaaaaatagaagggaaaggcctaaagaatcacaaagacaccacccctaacatctaccagctgctgaacccatgctggcagccacgcactgccacacttctttattgagccaaataaactaccacttgccgatggcactgctgtatggattttgttacatgtagccaaaggcagctgaactgacacccagaaggacagagtggctggagtagagacagtggcagacagggctgggttacacaggagctaagatcaggttaaggagtttgtattttatcttgggaaccaaacagaggagccactgaattattcattaggaaaatgcaaaacaaaaccaccatgagacacaacttcacatctaccaagatgactataataaaacagacaataacaaatgttggcgaaggaggtgaagaaaccggaaccctcgtgcattgctggtgggaatatcaaatgacacagcctctgtggaaaacaatttgacagtttcttaaaaggttaaacataaatttattacacaatgcagcaattccattcctaggtatcgaaacaagaaaaatgaaaacatacggacacaaagacttgtacaagaatgtccgtaacattagtcataacagcgtcaaactggaaaccactcaaatatccaccaactgataaatggatacacaaaatatgatataaccacacaccagaatactacacagcaatgtaacagaacaaactactgatatgtgccatgacacagataaacttcaaaaacatgttaaataaaagaagccaaacaaaataccagcatcgtatgataaacgtccaaaaaaagccaatccatggggacagaaaatagatcagtggctggccatggctagaaacagggattaactgtcaatgggcacagaggatcttacattgtgggtgatgaacaaatctaaaactggattctggccgtggttgtgcaacttgataaatttactacaaatcattttattgtacatcttaaataggtgagttttacgatatgcaaattctgcctccaaaaaaatccattataaaagagagagaaggttgggtgcagcagctcacacctgtaatcccagcactttgggaggctgaggcgggcggatcactttaggtcaggagtttgagaccagcctggacaatgtggtgaaacccatccctactaaaaatacaaaaattagccggatgtggtggtgggcacctgtaatcccagcttctcgagaggctgaggcaggggaatcgcttgaacccaggaggcggaggctgcagtgagccaagatcaagccactacactccagcctgggtgacagagcaagactccatctcaaaaaaaaaaaagagaaaaaaaaatgagaaagagcgagaagccactgaaagattttaagcaaagtgggaaatgattccaattttaaaacagctctataaagagaggccattggccaatggtatatttttggaggtgaaagggcccagtggtgtctacccaactcaaacccaagacagacagaaaaacaagagcaggttgaacacacagaaattgaaagcttgatgcaaacagaactaaggtagaaaaaaatgccttcaaaaccatcctctggtgcctttccatttttctaattcatggcacatcaatccttccaaacttaccaggcttggacaggcagaatcggttgactcctttggagaggttataaatccccacattctcacgcccatttccatcctgataaaattcctaagggagcaaagccaatacaatgacttactaagagagatggagacaccaagatgattaataatatttctctttccaaaccagtcatctgttttgcccattaatcattggagcagttgggtgccacaggaaaattaaaaacctcccaaaacttccaacaaaagtgtgctatttttcattcaatcaactaatatttattgagcacctgctatgtgacagacacaaggctgggccttgggagtcatgaccatggctcctgctctcacagggcttatgttctaatacaggaagacaaaatcaacgcatcaacaaataaattagtgatctcaactggtcagtaacgaagctgtgaaaataaacaggaaagcaagagaagaacaatccccacctaggggtctttagctcgctggtcccagggcacatctctcctgaacaatagggctgcgcctgaatgaggaggaaaaaccaacaacacgtgtttctggagaagacacagcactccaggcagaggggagagtatgtgcaaaggccccgaggagggagtgagcttggtgtgggactgcagaggaccactgtggctggggcccggcgagtgaggggacagtgggaggagataaagaaggggttaaggaagtgtcaaaaaaaaaaaaaaaaaggatcttattacaagagagctggaaatccactccactgctggaagggaaaggtttcctaaatatctatcacttattatgaaccggatattaatcgatctcctataacaaatcgacctgtcaagtttttgtaattaagcagttaggggagtaagttggcacatgaaacaccagttccaattcttctagtttctctacagagaaactaagacctgacgatgacatctgccgccactcaacatcaaaacattatagaaaattcacgaagggatctacagaggtgctcctgaaacccatttcacactgcctttcaggccacagagaccacaatcaacaagaagctaagatcctgtttacagcttcttcccctgcgctggaacaaatacaccagagaaggtggggcacaatggctcacgcctgtaatcctagcactctgcgaggccaacacaggtggatcccctgaggtcaggagttttaagaccagtctggccaacatggtggaactctgtctctaacaaaaatacaaaaaaaaaagaaaaaaaaagctgagcatggcggcacgcacctctagtcccagctactcggggggctgaagcaggagaatcgcttgaactcgggaggcggaggtttcagtgagccgagattgcgccactgcactccagcctgggcaacagagcaagactccatctcaaaaaaaaaaaaaaaaaaaaaatacatatatatatatatatatatatatatatatatatatatatatatatatatcagagaaactcacttggcagtacagagcggtgtacaccaaggacactttgatacctaagagggttcacttaagccctgccataaccctgagaagtaggtattaagatctcaattttcggtgaaaactgaggctgagaagcagtaaatgaatttacccgaagctattattactaataatataaagccagtgtgctctgcactgtaccaaaggtcaccccgaatcaccagtcagatttagtgtagggccaggacaaggaaacctcctaaatacaggggtccttccactgagagagtataaatgcttcctgattatgcgttgcgtaacaggtgggcgagtggagaggcagaaaaggaaatctgacttgcctacgtttacaatattcctgggatgttagtctttcttgacatccacaaggcgagcgcttttccaaataagagactccataagccgtacataccagagtgatggcgtgagacagggaacatctcagcatgtagcccgtctgcctgaactcaactgcagacacgtcatcctccagcacttccacctccaggctcttgttcttccagcaccaatcctcatgcatgatgcttactgcaaaagcaaacaccaaaaacggatacatgggcgtggagcacaccacctccctgcacgccaccagaaacaatgatcatgaattaactaattttaaaaagcaggtgtgtatgtagacataaagatagaaatatacacatacatatatttataactagcagtatttggaataaattactgctaaagaaaacctggagtcgagcgtggtggctcatgcctataatcccagcactctgggaggctgacggcagttggatggcttgaagccaggagttcaagaccagtctgaccaacatagcaaaaccccatctctactaaaaatacaaaagtgatccaggcatggtggtgcatgcctgtaatcccagctactcgggaagctgaggcaagagaatctcctgcacccagaaggcggagaggttgcagtgagccaaggtcgcgccaccacactccggcctgggtgacagagcgaggctaaatttcaaaaaaaaagaaagaaaaactggaaccaatttccattacatcaagaaagaaatctaatggggcctgtaagatcaggctgcaagtaaggtattcagggatccacaaactttttctgtaactcttttcagttttgcaggccacatgctttgtcagcctcaaccactcgacttggccactgttacacacgagcagccatagagaatccataaacaaatgggcaaggctgtattctaaggaaactacgcttataaaaggcagtttttgtagtctgccaagccctgccataacagaaaatattaatataattccagaaaaagcagtctgttttatgagctatccactgccagcagccccaagctgatttctgaaaaagcagaaatacaggcaagaagtggcttcttaagaagggcaaggaaaagggaagtaacatttgtgggcaccagctacttagctggctctctgcacaacgggctttataaactttacttcttttagtcttatattctgcagaaaggttccattacgtctattttacagatgggaaaactgagtttcagggaggtcaagtaccttgccatggccagtactcagcaccagtactgctaagttagtagaacacatcagtggaactatttcacactcctttctctgggctttagaaataaaatgccatacgtcggggcaccctcccttaacagaagccgccagtgggctgtgcagacaaggtggcggtcagctcagggcctggactcctccatgcttgtccaacgctaaataatgcagtcaaggtcacgaggcaaagacgacttaaaacaaggaaaggtacatggtcgtgatacaatttgagacctgagttttagaaagtttacaaagacaagaagtgtgtgagggccacaggatgttgcattccaattcttacttttgtattttccagggagcacgttgtcaaaggtgaaagtcatggcgttgaccttgccggagagctggaggctccgcttctcaccctggcggctcagggactgtagagtcaccagcaagtcaccacaggtgtctgcagggaaaagaagggagggctccatgtgaccccttataaggcttcagcacaggttcgaatcctaaccctatgtaatagcttcttgctactgctgagctcctaagaggcagtggccggaggcagacggagtgcttctttcaagctaacatgcacccacttgactccaagaagcctccctcgcacgcaggtgatcagtagcaaacaacaaaggcaaaaggaaaagtttcccaaatcccactcctactggctgacttctttgaaactatgtgttcttactttccagtgatatcttacccaaacaagagactttcccagaaactgatgccaagaactgtacaaaggccacatccatcacgggcctgtcggtcacagtaagaggaaatgtctggggtttcaacgtcagccctgctctggtttctgcctcaggaaccatcacctgcggaaacgtggatggaacgttagaggctgcattcggggagatcttccccctgacctacagggcgctagaacattcatctgggactaaggctaaagagattttgaaggccaaaggttcgtttccaggccaattttacaatcacaacaaatccacgaataacttgtgtgaagtaagcacagttctacccagatgaaaaattagcctcaacagaccgatgtgtatgaacaaaagtctatctggcctaattccccacaggcccgcaacgcggacacgcctcacttacatactagaaaccatactacatcccagtcacttttcccggcttcggatcacttgtagcataagctctgaacctgttaacactatgtggatgacactttggtggaattaagtcattttcttcctcctattgttctgcgtgcctttcatgggctaagaagaggaacaggtgaaggtagcagcggtcaactctttcatccctagtaaagacgacactgcccttccttggagaagtccatcatgcttccgaaagggcttccaaagacttgtcaatgtggacatcttcgcaagaagccagctaccatctaataaaggcagctgtcaacccacacaccacgctgttctgtggaagcagggagaacgcaatctcctaccctgtttcccacagagggagggaccccactttgccctagaggacagcagagtctaacagggaaccttctcggccctctccctttgtgttatttgctcttccacagggaggaagggcagctgctgatttgatgggtgacagcccacggaaacagtctctccccaagggcagggccactgcactgaaaggcatggtgggctgacctctgctctgtcctgtctcttgcttgcttgggccagctgtggcttgggccttcaccatggtgaggagaccacaggccagaccgtctccccgttctcggcctgcttgaatggataagtcgcgtggtccctgcctagccatcttgaagtcaaggcaaagcaggaaatgggaagctccattttggcctggggtcccagaagccacgcactatggccatttttgagcggccattagtagagttcatttttggtgtcctcttggactcatcgacattctacagcagccagaagcctgaaggtagaggagtgactggcagcctgatactaataaacatcaagactggaaaaaagagaggcagatggcattattttttagctggatgcctatctgactctcctctactggtgcaggattgtaaagacttaaaaacaagaagttggaaactggaatgctccttctctaaccccattcgacctaataacccttctaaaaatcactgctttttctcaaaacattttaaatttaaaacaatgcatcgcacctgcactttgtaagtccctggttttgctttaaaacaaaatgatccatgagcatctgtctccacggtgaccaaagacttgtccttgtcttgagatgacaggacaactttgtatttattcatctgcttgacggtgtccgggaagcgaatgattgatatccgaccacagacactgaacctgcaaagagaagaccattcattccagcacgaggactcaattataacaggaaaggctcttatcgaccaaaaaagatgcagccctctcccagcccttgttcctgagaatagtctaatcttaatgaagagacagaatgcagtccagatgattctggttttaaaaagcaaccttcattctggttttaaaaagcaaccttcagaagcaagactgggcatctttctacagaacaggggcccgtagtggggctgtttgtgtgttccgggtgacatgtggcaatcccccactgcagaggcaattttaagaaaatctgcagataataaaaacgtttcaggtaattggatcgttgacagcggagcggccttggactgagaatgtgggctagcccttaaaagcaagagctctaagctgcctaagaaactgtggcattatcaggccatcaaataagtcaggattatcaaagacgtcttccttgcttgtgattatatataatacatggatgaaagcaaactgggagattggaacagaaaaggtaattaagttaaaaaatgcaaagctaaaattgaactccttgggaggtaggagccacaaatgtaacttataactgaaaagccctattaaggtaatgattcagatttgagattctaaataaggagtaaggtgttgcaaggcatccctcgaataacacacgagaggcccccctacaacgaccatcatccttggagtgctggtcttcatttctgaagcagctggtgtattaaagtgtaatagtacatcctagctgggggtcacagttgtcttttcaactgttcattttaaagaatcttcaagaatcattttagataaaaattagttacttttgacataaagataatcaagaatgttggattctgacaattaggggtacattaaatgttggaaccaccactccgcctcaaataaaaaaacagtggaaaacacaaggaaatggtggaagattgtgtatgtgaaatctaggaatcatgaaaaacacagccatttcttcagagtgaagggactgcccagccatatgagctcactatctccagcatgggtcagcaaactaccacccaaggacccccctcccatttgtgtatgaactgcaagccgagaaaaagaattttacactcttaagtggttaaagttaaaaaaaaaaaatcaaaagaaagataatatttcacatgtaaaaattacatgaaatgcaaactgtggtgtccaaaaatgtagttgtgttgcgctctgcccattcatttacaaatgtctatctcagctgttgtcctagagaccgtatggctcacgcagcctaaaatagttattctctggctctccacagagaaagtgtcccagtccctgacctagcatatgcattttggttctcacattcccctactgtgaactttcagaataaaaggatgggaagcgaacactgacacaatcattcccaaggacctgtcatattctcttgatttgtgtacctgtcagaggacacatcaccttgtctatttcctatcaaatctctttgcctccttaagttgtaaatatttgaaccataagatctgttttagcccacattcttattaaaaagaagtgcctattttccctaaacctcaaatctatactggcttagtttggaaaaataaaccaaaagggtggtagaaaaaggttccgttatactgaagcccttaaaaattgatttgtatcaataaattctttcaacagggtttaaatacatatatggacagaaacaggtaatattggtggatattgagagaaatctattttcacagtcatttggacagaagccaaagagtttgtttttacaataaattgagtaatttttttattttactttaaaggaagactaggcaccatggctcagcctgtaatcccagcactttgggaagccgaggcgggtgggtcacttgaggtcaggagttcgagaccagcctagccaacacggcaaaaccacatctctactaaaaaatataaaaattagcctgtaatcccagctactcaggaggctggggcaggagaatcacttgaacccgagaggcggaggctgcagtgagccgagatggcgccactgtactccagcctgggcaacggagtaagaccctgtctcaaaaaaaaataaaaaggaaaagaaatagtaagaagtatcagtgtgctaaaaaggcaaatgtactacgtcggccaataaaaaaaagagattttccaaaaatgttcaacaaatgctatttttctttctttgacccaaatactctactttaaaggagaaaataaatatatttcctccatctctgtgaacagcgcctcctccatctacccagtggctcaaataagaaacctgtaacctcaacagcacaggcctgtgggtgtgttctccatgtgacctaccaaatccatctactcctccctccctcgcctgccagccgcctgggcccggccactaccatatctcctccagacaaccaccactgcctcatatctggcccctccattcacaccatggctttcctccaatccattctccacacagcagccaggaagaaaaacaaactttttaaagtaccatgatccctatcactcccttgccaactgataactcttttttttttctgagacggaatctcaccctgtcggccaggctggagtgcaatggtgcaatctcagctcactgcaacccctgcctctcggattcaagcgattctcctgcctcagcctcctgagttgctgggattacaggaacgcatcaccatgccccgccaaccttttgtatctttagtacagaccgggtttcaccatgctggccaggctgcgcttgaactcctgacctcatgatccgcccacctcagcctcccaaagtgctgagatcataggcgtgagccaccatgcccggccaaccaacagacaactcctaacgggtttccactgcattagggagcaaagcccaatcccaaagcaaggctacaaggccccagagctccctgacctcacccacctcctccagctgcgcagactgcctttcaggtccttcctatcctatgcaggcctctgagcatgctgcttctctactagggaagatctttctttagctaacttttagtctttactaaggtctctgcaacccagagagccttgcagagctcccactctaaattagctcttcttgcagcaccctgatctcttccctgcacaacacttgccataatttagcagcataaatgtatttgtcttttttgtctttttttaaaatcttgttattttattttttaatttttatctctttatttatttttagaccaggttatgaaactagctaatttttgcatttttggtagagatgttgttttcccaagttgcccaggctggtctcaaactcctgggctcaagcgatccacccgcctctgcctcccaaagtgctgggatggattacaggtgtgaggcattaagcctggccacagatgtatttgtcttcagtctgtctccctggaagggtgaaagccccatctctggaacactagtttgattaattattaggtacgaagcatttttcagtgcctcatctagagtaattgcacaaagtgtttatggaaggtgggaaagacttaaatccaagaattactttctgagggtaatttgcttccctgtcttccattcaccactggactccttgacctcgacctccatctgtctacagaagagtcactgtggcctcctcagtgatcaagccaggggactgtgttcaccagggcccagctccctgcacctccctgttgggccctacctcctaccccaaacttactttcttagctcctatgacctcacgctccctaggtcccccctgggccacctggcactctgtttttggcctactgttcttctaattctacttgcacatacatatttgaggtcctggctgccacctgcggccaaatcttcaggatttaccatccatccaagtacctattgaagagctccacctagtggtcctacagaccaatgtggccaaatctgaaccctcatcacctaactggcttctctttctgtccccagccatcacacctctcaagctgggcaccctaaatatctcaccagtctgtccctgacttccctacaaggcaagcccttgtcgtctctgctttcagacctcctgtgcccaagtcctgtccccttcaaagccactctactccatgccactgttttcagaatgccctattgaaaacaatgatcaaagcttgttatattaatgctcaaaaccactcatggcccgttggccccagtgggagaaagcccctacgccctggtggggtgtgaggaggtgctatggggttggcctcatcatcaccttcacctgccagtatattctgctccagtagcacccagctttacacccgcagccacctcatgctgctgtgagactgcctgactttgctcatgccgcgcttctcccaagcagaccctgcagtctccttctaagctactgttttgtgagcacctgttatgtctaaagctgttctgcaggttacatacaggtggatctgggatctgactccaaagcccaagttcttggcactacacaatcttgcttcagatgatggtaaaaccacatgaattcaaccacaagatgtccctgcctgtacttatagtataatgagtaactacaagcaggaagaactacaccaatgacctgaagcatcttccaataagctttctcaaccaacaataccatcttccaaaaatcctcaaagattaagcaaagaggggtcctgtgaaagatcgtgaaagtcagacatgaaagattttttaatttcacaagcccattttaatttgaagcaagggacttttcattaagcatccgacatgtcagtaccttcagtttgtaagatttagaactaatctttcttggccgggtgcagtgtctcacacctataatcccagcactttgggaggccaaagcaggcagacagcctgaggttaggagttttgagactagcctggacaacatatagtgaaaccctgtctctactaaaaaatacaaaaattagctgggtgtggtggggcacgcctatagtcccagctacttgggaagctgaggcaggagaatcacttgaacctgggaggcagaggttgcagtgagtcgagatggcaccactgcactacagcctgggcaacagggcaagactctgtctctcaaaaaaaaaaaaaaaaaagtactaatctttcttaagttcttaagctcggcaaagacacacagatcacaggtcatttggttctacactggctgccagcatatttactggtgcttccaaatccacacgataagcttaccctgttgcaacaatgtcagccagctgaggtgtgttcggtgcaattttgatggtgaccgtttcaaagtagaggtgctctttctgagcatggatggtgtatgtccctgtggttatgttctcaaggcggaatgagccatcagcttttgttttaactgtaaaacaaaaacacacaaacagaagataagccaaaaataacagtgtatccttacatgtacaccagaatacttggaccaaaagctgccatgttctcatatagtcatcagttcctctccatttctctctgtgatccaaaaagagcgctggccatcagcctggggctgctgtgtcagcccacctttgatttggttattcagggtgactactgcttctggaacaccatctccttcgggtccgttcaagaccctcccggtgacggagaatcccatgacgtggaacacgggctagaaaacaaagaacaagaagaaggtgctcgaaggtgctcctgtgccagagccacaaagcctccttctgctgcgccggccaccacctaccatgtctgctcctgccgcccacctcccaacactcagtgccccggtcctgtgtgccagccgggctccctctcactttacccacatctgtcttctctgttgtgttcccaacacactgctgagtgtcaaacaacagaaaagaaaagtctagagacttacttccctcgttaaaaggtcactgactcaagcttctagaagccccccacccttacccctgtgccatctcctcccctccagatgcccccattttggtgaaccacgtcttcctccagtctcccatgcacaccccggcatcactttggatgccccgccccgctcctccagcatcgatcagtcctgtggattccacctctgcaaggtctcacgtgtcccctcctgtctttccaccacgacctgaacacaggtccttatgaaatccacctaggccaggcgcagtggttcacgcctgtaatcccagcactttgggaggccgaggcaggcagatcacttgaggtcagcagtccaagaccagcctgaccaacatggtgaagccctgtctccactaaaaatacaaaaattagccaggtgtggtggcaggcgcctgtaatcccagctactcgggaggctgaggcaggagaatcgcttcaactcgggatgcggaggttgcagtgagccaagacagtgccagcctgtgtgacgcagcaagactctgtctcaaagaaaaaaaaagaaatccacctagaccaccctcctccaccaccatcactggctcacacgtggtcccatgctccatgtgtctgtgtctgtgtctgtgtctgtgccccacttgcctgtgagcagcacacctgtgctttctctgcagttactgagttccagccctgatctgtgtatccccaaggtcaccactgctaacccattttagtatcttcatcaaacttaccagtatctgaaatgtcctcgttcgatttcttagttgtctccctcccactagcatgttacctcatggagacagggactttttctgtcttagtcacctggtacacagcaggcactcaataactgactcctgaatgaatgaatgtgtgcacgcacgtgtgcaacagcatttgagatgaagctttaaataattaaatgacttcctttttatgcagggagcccttcttttttatttttttattttttttttcagcaaatggtttcttagtgatggtctcacatgacaggtagtccttcctgatctttccaaaaagacatgtttcattccatgcattacctacttattaattcacatatgtactcaacaaatatttttgctgggcacctactatgtgccaggcactaaatcacatgttaggaaaacagtaaagaataagacacggtacctgacctcagggaacttacagggccccattccctgaaattccattcatcattttcaaaatatgtatttggctgtaatctgggaatagctgtctctgctcacctgcccccatccttctctgcaagctacgagaagcaaagtaaaggcttcatcttcttacccttctctttcccctccagtgtacagcagaacagtcaaacactccactgaatcttaaaatgcagagtctgcaccccactgtgcatatgacctaaaagtccgcttctgccagtttaagcgattttaacacagtactttcaaatgtaattattaaaagaaaatgattaaaatataattgcttcgataactctaacattgggtggtccacttaggagaggctgttattttcttttgggatttgttctagctagccaattttctacagtaaccattttctacttctgtaattaaaggagacgtaagtgagatgaaaaatacatttaccatttatgtgagggtctaggcagtttatcaagccatgtatcacactgcccattcctaccatcacggtccaagctctgccagttctcacctggtttacggccatggcatcccaactggtctcccacttccaccctgacaccctgcaaactctcctcaatgcagctgccagaaggatcacgccactcctctgctaggaaccttccagtggcaccaattctcacccagagttataggcaaagtggcccaccaagccctgcacaatctgccctgtcacctccctgaccctctttccgcctcctccttccttgctcattccctccactccagccaccctggcctccttgggatgccccaaacccttcagcacactcctgcctcaggacctttgcacgtgccgttccctcagtcttacacactcttcctgcaggagtgaagtatggttctcttgttctttcccttcaggttgttgatcaaatgtcaccttcacagggaggacttcccaaaaacaccctatgtacaactgcaacccctgtctccaccctgatactgtacgacctcctttcttcctttatttttctagagaacacttatcaccttctactgtactttctaacttatacatctatacatgtattgacccttcctgtcattagaacatgaggtctagccaggtgcgatggctcacacctgtaatcccaacactttgggaagccgaggcaggcagatcacttgaacccaggagttagagaacagcctgggcaacatggtgaaaccccatctctaacaaaaatacaaaaattagctgggcatggtggcacgtgcctgtggtcccagctactcaacaggctgaggtgggaggatcacttgagccctggaggcaatggctgcagtgagatgagatcgtaccactgcactccagcttgagccacacagtgagaccctatcttaaaaaaaaaaaaaaaaaaaaaaaatgaggtccacagggacaagaatttttgcctcttttggtcactgctatatccccagtcctggaatggtgcctgaaatgcatgtcactggcaatcaataaatatatttcattgaatgagtagatttaactaggaatccagctctctacgataaggacatcatgggtaagaatataataccagatggcattttttccaacagcccttccagataaaataattgatttttttttaaaacatgtttgcaatacctgtgcctagggatgggaactcaaacacctgtccctccagaagacagaaaagccttacctcgattttcaagctgtcatgctccactgtgaagtcaagtctggaaggcgccacatcaaaggtaatcctctcccctcgatagaacggaatctggaaggaagagtctcttaatcactaagaaccactaacatgatcaatcagcaatattaataatcgatctagcagcccacaaatgacaaggggttcagacagaccaagagaaacattcatcataactgttgcagattcgaaaagaggaagccttgccctttttgtagctattacgaaggggtgagtgtctcatcttaagtaagttactgcttaacagcgtgttcagagaactgcaggccaaccatcttttcctttaacacccaaacagcattggcttttactgtgtcatgagagtcccagacataaacagaacggaaatctgcttcactcaccacagtgtagcccccacttggcaaggaatagaaagagaacgagccatcttctctggagaccgtgtagcacaaatacaccagactctcgtcttggggctggaacccaggcactggtgagacattgcagcccaggacatcctatgccagggggtaaaaaagacaagacttccttttccatttacatgttctgaataccatcaattagccacattataggaaaatttttttaagtttcatgtcaatatatgtatttctgaaatctaagacacattaatacagataaaaggaacaaaaatcttgacattcaagttgcaaagttaaaaactggcacagtcttcccgggaaagatgacatgactgtccttccttatcatgggtcaccattctccaaataaggaaacggaagctcaggaaggtaatgtgaccggcccagggtcgcatagctaggaagaggaatttgtttaaacctgagatttgtttaaacccaggtctgatttcaaagcctgtgtactttccatcacataccactgcctcccagtgtagatgtgcaatgtcttgtgagtcaacagagacacatgatattcttgaatttttttttttttttttttgagagtctcactctgtcacccaggctggagtgcagtggcgtgatcttggctcactgcaacctccacctcctgggttcaagcgattctactgcctcagcctcccacgcagctgggactacaggcacgtgccaacatgcccggctaatgtttttgtatttttagtagagatggggtttcataatgttggccaggctggtctaaaactcctgacctcaagtgatccacccaccttggcctcccaaagtgctgggattacaggcatgagctaccacacccggcctgagacagacgatattcttaagtgttaaaatgataaatcaactcagacctgcattttttaaaacagtatgttctggtctataatcccccaccctcctacccttcacaccatctcttttgttcttttctttgcttacctctttagttactaaagaagaaaagagaagaaacttcacccctttcatgggctccccatcacttcggacagagccagacacattgtagccagcaactatgaggggactggccgcattggcattggagttggttacacgcactgtggtgcttgcctgtaacagaaaaagattttaacctgtaaaaaaataaacacttgcaaagtgcctaacaacatgaggacacgctgaagctaaaatattaactgggaaacgtaatctataaaattgcttattcagtatgatcacttcttttcttgagacggagtctcagtatgtcacacaggcttgagtgcaatggtgcaacctcggctcactgcaacctctgcctcctgggttcaagagattctcctgcctcagcctcccaagtagcggggattacaagcgctcgccaccacgcccggctaatttttgtatttttagtagagacagggtttcaccgtgttggccaggctggtctcgaactcctgacctcaggtgatccgcctgcctcagcctcccaaagtgctgggattacaggtgtgagccaccgtgcctggcttatcattattttttaatgcccaaaatgaagtgaaaggaaatgtggcaaaatgtaaacaataatgattttgtctatatggtgctattttacttgtatacttttccagcttccaaaatttgtttccactgctttatattcctctatatgttccaatttttttaatgagcatattttgcctttttttctatttttaatgatatacagtgttaactgaagattagcctaaagctgcctccttacatattttaagtttggcctaaaggtttctctgtacgtgttgccaagtctcacccaattcaagcagccacccttcaactactcacaggcagccaactgttcaaaccatgtgcaaataagacaaacgtccagctgtaaccaatccaactgtttctgtacctcacttccactttctgtccgtcactttctttttctgtccataaaccctttccaatcacgcaacagtgccacagtcactgtaaacctattctggctcagggggctgcccaattgacaaattgttctatgctcaattaaactctgtttaatttgccttaagttgttcttttcacaatatgtgtatatttttaaacatttttgttaaggtacaataaacacagagaaaagtgtacagattctaagcacgcagcacagggcttgtcacaaattgggcactggttacccaacagaagagcaccagcaagccagaagtgccctcacacttgcttccggtcactaacaccccaggaggataaacattatcctgacttctaacaacatgctttacttgaaaatcccaatctcatattaataaactcagattcttctatgcagacaattaacatacaatgtaaacctcaaaatctcttctatttataaatgtgtaagctctttcatttcgaataaattttttttttttttttgagatggagtctcactctgtcacccaagctgaagtgcagtggtgcaatcttggctcactgctacctccccctcccaggttcaagcgattctcctgcctcagcctcccgagtagctgggattacaggtgtatgccaccattcctggctaatttttttctatttttagtagagatgcggtttcaccatgttggccaggttggtctcgaactcctgacctcaagtgatccacccacctcagcctcccaaaatgctggaattacagcatgagcaactgcacccagccttgaataaaatatttttaaatgttgctgcagaagagaaaaacccccaaaaccaaaagtcataaacagtaagaagagacatctaggtgtgaaactatcatcaattataagtgcgtaaaacctacagagtaaaaataataataaaacagatagagtagaagctgaaatactgattccaatgcttctttagcaaaaatgagatacagcttcaatactaacacagaagctaacatgtcaagatgtcccttaagtcttatttcaatttggtctttcacggctattacagaacctcacctactaggtggagttccttttttgatctttgactataaactatttcagtcaaacaaaaaaagatatgctaaagaacacttacataccttctaaccagctaaagaaatttaaaaaaatacaattcaagatgctggcgtaccccgaagtccccctcctccctctttctctagaagtcagtatcattttgaacagcatctgctattcccatacatgtctttataatttttctacataagactgtatcctccctgtccctactaaaaatacaaaaattaactgggcatggtggcaggcacctgtaaccccagctactcaggaggctgaggcaggagaatcgcttgaacccaagaggcggaggttgcaatgagccgagatcgccccattgcactccagcctgggcaacaagagcaagacttcatctcaaaaaaaaaagactgtatccttagctaggggcagtggcacatgcctgcagttccagatccttgggaggccaaggtgaaggatcgcttaaggccaggaaccagaggctgcaatgagccatgaatatgtcactgtactctagcctgggcaacagagcaagaccctgttgcaaaaaaaaaaaaaaaaaaaaaagactgtatctggccgagtgcactggtttatacctgtaatcccaccacttttttgagagcccgaggctggtggatcatttgaggctaggagttcgagaccagcctggccaacatggcaaaatcccatatatactaaaaatacaaaaattagctgggcgtggtggcacatccctgtaattcagctgctcaggagactgaagccggagactcgcttggacacagaaggccgaggttgcaataagccaagatcatgccactgcactccagtcttggcaacagagcgagactccgtctttaaaaaaaaaaaaaaaaaagactgtatccataaatgattatcacaagtatttaaaatcatatttccttcaactctgtttttaaatgtagttacattgatatatgtagctctggttcattcattactgctgacatacagcagcctattgtatgatggaaccccaatccattcttctcttaaaaggcatttaggttgtttacaatattttgctattacaaacaaagctgcaataaacattctcatacattctccttggtcacgcgtaccacagtttctagaatgtttagtatatttacagatttctgtttcaggctgaaaaaagaacaacaaataaatctcgtcagggccttctgttgttgatttagtttaaaatagctatagttaataaaacagatctatttcacagcaggaagacaacactgtcacctaaaactgaaactaacacaagcaacatctgctacagtgaggagttacaccttataaataactaccaaactaaacaacagcaccattggttcttcatctagtcctggaggaaccataaattcttttcatatcctaaattgaaaagccctacatttgtcccaagaccagcatattattggcatggctatagacgtagctgtcactcacctctttcaacgcccaggttggatgagttgcgaggatttcataatctccaggcagaactttaaaaaatgcaaacctaagacataaaaaataaccatttaactttctccaaacaacccaagtatttctaattctatgactaatgttggcagcacaagaaaacaatgttggaattatcgcaaacttccattagcttgttaaatgagcatgaatgaaattcaatccttcactgtacaaatctgcataaaagagcgcttattgagcacttactgtgtgtcaagaggggtgctccatgtgctgatcggaaagaggagtgcttacgtctcccttaatctcaaggatttctggcataaaaccaatccttgtagcacagcagggaccagtcacagaacattcgactgtgtttgacagaggtgacaggcatgaactgacaaggagaaggggacagaagtgtccaaggaaacacatgggaagggagaagtggggtgaaaaagaacagaacagatgcacaggctgagggggacgctgacccaagatgatgcaaatgacacagggcagggtaaactatgacaagctttgaatcccagaaaaaaggctttagagaaacacagataagtcattctgggtttttgcacaaagcaactgagataagaaaccagcagctgatgaaaattactctactagccatagacagactaacaccagagtgagccgagctaaagctggaaatgctgctgccagtatactaacatgtttatcccttcaaatttgtaaggcaactgacaaatgagaaggctaagtccggtgaaatgaactagaaaacgcatttgatttcttcttctgtggtattttattgtatcaaatcttgcctgcaataactggatagggcttggaaatcacattactacaagtattggtaagattgagcttctatttcattttcataatagcccagtgctacatgtttcattgtttcagttagtgcagatgaaaggtattcagaaggctcaagacactatttttttctagtaaggtcaacaccaaattactagcccagaaaaaaaattacagctccatattcctgctacacaccagggctggagaggcaccagtcaagcagaagtaaatgttatttcaaaaatgaaaactagtttcaacaataataactttaaaattgaataacttactgacagactcattataaacttctattttgcaatttactcagtttgtatattaacggagttagtaatgatttgaacgctttcggaattatcagtttgaactattctggtattaatcttggcatatctgttaacatttacaactcaactatatacatccattaaataaatgctttaaatctgactcagcaaggtcagctaggcatctgctccaactacaaagcagttttgatataataatgataatgattttttctaatcataactgagctaacctgtttgagctaatatgccaggcagcttgaagtaataatattaatttcatctttccagtaccttaggagataggttccacaattatcttcatttacaaaagaggaaactgaggcacagaggggttaaggaacttgccctaggtcaaccagccagcaaatgggggagctgggattcaagcccgggctggcaggctccagagccaggctgagctgctaaatgaagacccactaagccccaggccttgaagcaggtgctttatgggtattaactctttttttgtttgtttcagacagggtcttgctctgctgccgaggctggagcacagtggcacatgatcacggctcaccgcagcctcaaccttccaggctcaagcaatcctcccgcctcagcctcccgagtagctgcgaccacagaagcatgccaccacacccagctaattttcttcccccgtgggactctacttgatataattttttaaattatttgtggagattgagtctccctatgttgtccaggctggtctcgaactcctgaactcaagtgatcctcccatcctggcctcccaaagtgctggcattataggcgcaagccaatatgcctggccagtatgaactcatatttaatcatctcatcaatgctaggcaagatgggtcaaatggattccatttcacatgtggggaactcagcactctgacgggcatgaactcacccaaagttaagaggctgaatcaggatctgaacccagaactccctgaatccaaactcccaaacccagctccatgacccctgtcagagcccggctctaaggcaacactaagagacaggacgctactcactttccgccaggctgtgtaactgtggactggatctttgcttcggtcccagtgtttctcagagacacctgaactcccgcaggacccaggggctgccctttgctgaggacctgccatggagaagaaagttagggcccacccagcaaagcaccctcctctcaaagcactggcagtcctgcttacaactcccaggtggagcccaggaaccctctttgggtcaagaatcccattgaaaagatgctataaatcatggatatgtttcctggggatgaggtaggagagggaacagtaacagtaaaataagactctatttcaatgaatctaagacatcatcagttatagattcaccattattggtctgggtgggtgtggtggttcacgcctgtaatcccagcactttgggaggctgaggcaggcagaccacttgaggtcaggagtttgagaccagcctggccaacatggtgaaaccctgtctctactaaaaatacaaaaattagctgggcgtcatggcacatgcttgtaatcccagctactcctgaggctgaggcaggagaatcacttgaacccaggaggcggaggttgcagtaagctgcaatcgcgccactgcactccagcctgggcgacagagggagactccatcttaaaaaaaaaaaaaaaaaaaaaaaaaaaaagtaaatgtacataaaaataaaaatataaaaattagctgggtcaggtggcacacgcctgtaatcccagctactggggaggctgaggcaggagaattgctcgaacccaggaggtggaggttgtggtgagagagactgcgctactgcactccagcttaggccacagagcgagactctgtctcaaaaaaataaataaataaaaataaaaataaaaaaagattcaccattattttgcaaaccatcgataaagaaaaaactacccaagatccccatctctaacaagaagcccacacatacagctgggatggaagggcctccccgtcaccgcaaaggtagaggagaaagaagtccatcatgaagagaaggacaggaaggaaggaagcacatctcaacctcaggcacagggcgggtggaagagaaatgactctcccctgagaatctgaatcgcgggagctgggcacacacccgttaggactctaaattcacaccaccgtggcggtccaaaaaaatctcagaacttaaataataggaatcctcctaggtaagtgtcggaagcagatgcacgctctctctgggagaagctgacttcaattcacccacagggacagcaagatgccacaaggcttagagagtgcgtccttccaattcggcatccctgtaaaaggccatccctgacataaacgctaacagcggctgggtgcacagcgtacacctgtaatcccagcactatgggaggtggaggcaggcggatcacctgaggtcaggagtttgagaccagcctggccaacacagcaaaagcccatctctactgaaaatacaaaaattagccaggcatggtggcacacacttgtaatcctagctactcgggagggtgaaggagcgggagggtgaggcaggagaatcacttgaacctgggaggtggaggctgcagtgagtcaagattgcaccactgcactccagcctgggcaatagagcaagaccctgtctcaaaataaaaaataaaaaaataaaaacaccaacagcctatgctctgggagcagaggggatgaccagcaacctcaatctcactcctaaatacacctgctgcgttctacacggatgaagtacagagttcacaggctcacttgccacttatccatgggtcccttgtgggatcaaagtccccaggttaaaatatcctgcatttttttaaaaaaggatttagtatacattatagagtgaacaggaaaaataatcaagttccaaagacaaaccttgccattcacagagaacccagtgaagacaaagttgatgtccccaccctttgtgcagatgtcactgactccatccacatggagctccacggtcgtcggctctgaggaacgaagcaggggaggaaaccggggcacaagacacaaaggcaagcttagttttggggtacagtgaacctaagtagaacgtatttttattattcaggtttcattttacttttgaacacttaatacactcgtgtgtttccaaatccaaaggtacaaaaaagtattctgggaaaagtctccctctcacccctatccccctagcctcctggtttcctgccccagagggaattcgtgtttagagtataaaataattttacaacgcctttcagctaagttatatctcagagttccagggaaaattcagtgagcaccaaataattttatttcctgaatgctcatcaccgaccaggcactgagctgagtgcctttaatcctcacaattatcttaagagacaggcagtaatagctgcaatttactgaggggtaaattaaggcacagaaaggttaaaggagctcccaagatcacagagcttctgagtgacagagccccagttcaaccctaaaagtctggctctggatctgttctctgaccaaggacatgagctcagccatgttaaaccaggaacacaaactccagggccacaggggcctcatgggttcgaagtgagcggagcatcctcagggggactgtggcaaattgaaaggagacaaccgccactcaagtctgccaaccactaccatgctttgccagagcttccaacttctccgaaaaactggaaatctggattttatataccatctcttgatttttcaatatcagcaattaactccattttttaactgaagagttcatcataataggggttaaggttgagtttttgaaaggttaggaagaatatggagtaatgagtagagaaaaaaatggaaaaccatgagatgagattttcagttaagatgaattacacacgtgcttgcacgcgtacatgcacacacacacacacacacacacacacaaagactccaataaaaaatgggcaaaagacttgaacaggaatcttacaaaaatagctagcccatggcaaacaaacataaacatacgaaaaagtgtgcaacctcattggccatcagtggaatgtaaatcaaggccacagtgagataataccacacccccaccagaagggctaaaattaaaaaaaactgacgataccaagtgtaggttaggatgtggagcaatggaaacccttgtacactgctgggagaacacaaactggtgcatccactttggatgtttgcaaacacctaaagctgagcatgtatcagctctatggctcagcgactttactcctgtgatacactcagcaaaaatgcagacacatgtatcaaaatatacatacaagaatgttcacaggagcactgctcttagtggccaaaatcggtaagcaactcaaatggccatcaacagtagaagagatcactgatacaaaatatgaatataaaatataaatataggccaggcgtggtggctcttgcctataatccccacactttgggaggccaaagcgggcagatcacttgaggtcaggagttcgagaccagcctgggtcaacatgatgaaaccccatctctactaaaaatacaaaaattagctgggtgtggtggtgcacaactgtaatctcatctactgaggaagctgaggcacaagaattgcttgaacccgggccgaagttgcagtgaactgagatcacactccagcctgggcaacagagcgagactcagtctcaaaaaaaagaaaaaaataaaataaaatataaatattttataaaatataaataattttatatttatgcatcagaattctcaacagcaaagagaatgaactaaagctacaaatgatagagataaagttcataatgttgagtgaaagaaactggatattaaaaagttccctgcatgatagcatttgtataaagttcaaaacagaccaaatggatctctaatttgtagaaggtcagggtggtggtcacctggagggtggggcgggatggctaatgagcacccaggatggggacttctggggtgctggtgaagtgctatcttatcatctggatggtggatacatgggtgtgttcacttagtgaaaattcatccaaggcacttttctgaaagtataattcaattaaaaagcttatcaacagcaccagttgggggtagcgtggggggtggcaaacacaacactcctccaggccaccaatctggacttctgctttggccatgagcagggctgcattcctctccagctttctggaacgtaccagccaggcaccccccaccctacccctgactataaactgataaaagagctgctctcacagagccaaattagctgtcagctgcctgagcctcattttagccttggcgatggcaggtgctaaattcttccttgtctaatgcacgagcaagcctgatatcaacaacggtgatccctactcctctccccaagccatggactggggtcacccacacctgctctactgaaacatcaagagtctctcctcttcaaaaatgtaaactacatcaaaacagaccctctcttctgatctcaaccccatccccaactccccagctatgcttgaaggcagttagttctatgaggaaagtttggagcttttgttgggatgtgtgcagaagggctgtttctgaatactgagtacttgctaattacgtgccagcccctctgaacactcagtattggtttattaatcctccaagtacccagtggggcagggactatatctacccttgctcgacagtgaggagccaggctgacacgggggaagtaacttgcccaaagttatttaactggtaaggtataaggctgacagtcttctcatctcatgggacataaatctggatttttatgacaaatctcacaatctttaaatgtttcaattaattccataaaaaattaaaaaactgagagggctaaaaaagaagccatcctgggacgggaaccaagtccccactcttgatttctatactgttccacggccacgtaatgagtgaaactgcaagggaagagtttccagaaaggtagaagaaaagatgtctatttttcaaaggtgacagaaagtcttaaggtagattaaggtaaatccgaactaaaccagagtgatgggggcaaggaggggaggaatacaaaccctcttccatactggaaatgatccttaatattttaatagtttatgcactctgctagcctaaattaatattcggcatatcatctaatcttttacaaagaatgtctagtgattcagttaacttaccaaaactccaccctaggggaggctcaatcttcagaatgaaatccccctaaaaggaaaaaaagaaaatgtaatttcaagaaatgagaattgtgactctggctaaatttagtttagtgttatcatttaatctaaaatttttttacaccggaaatgaaattctaagagtaagccttgttcttctacatggtactgagcactgattctcttcagaagctacaagctgaagctgaacaccagaagttttcatctaaacaatcagaagacagtgctgaagcccattcatgagttctaaagacactaggttcagccactcactgtcttttaatactaaacatactataattctattaattgagtctcccattaagccctcacatgcctacagttgcacaagttagcatgtatcttcaggaactaaagtcaccccctaaaactagatttggccaggcacagtacctcacacctataatcccaacactgtgggaggccaaggcaggagggtcacttgaggccaggagttcaagaccagcctaagcaacatagcaagaccccatctgtacaaaaaatgttcttaaaaaatcagctgggtgtggtggcaggcgcctacagtcttagctacttaggaggaagaggcaggaagatcacttgagcccaggaggtcagtgctgcagtgaaccataattgtgcccctgcactccagcatgggcagcggagggagatcctgtctctaaacaatacattaactcattaattcaataaataaaactagattttacttatcaaccctggtttctttgtttctgttttagtttttttttttgagatggagcctcgctctgttgcccaggctggagtgaagtggtgcgatcttggctcactgcaacctccgtctcctgggttcaagcgattctcctgcctcagcctcccaagtagctgggactacaggcatccacgtgacacccggctaatttttttgtattttagtagagacggggttgcaccatgttgcccaggctggtctcacactcctgagctcaggcgatccacctgcctcaacctcccaaagtgctaggattacaggcatgagctaccacgtccagcctcctggtttcttgagactgatactgatactatttaaaaattaattaaatagatttcaggacagacccagctagtccatctctagaaatcagtcctatgcattctggatgaagagttaagttcaagaatatttcctggtgtgttatgttaaaattactattattttaaaattggggaaagtctatatgtccaagtagttaaataaattacagtttgggtttgactctgacacactatgcagcgattaaaaagaagtcagtaggctgagcatggtggctcatgcctgtaatcccagcactctgggaggctgaggtgggcggatcacctgaggtcaggagttcaaaaccagcctggccaacatggtgaaacaccatctctactaaaaatacaaaaaaagttagctgggcatggtggtgggtgcctgtaatcccagctacttgggaggctgaggcagaaacccaggaggcagaggttgcagtgagccgagatcgcgccactgcactccagcctggctgacagagtgagactctgtctcaaaaaaaaaaaaaaaagtcagtagatctatctatgctaatgttgaaagcatgcaagaggaaaaaaccaaatgtccctctggtattgaaagcattaacacaggggaaaaaatgaaactgcagaataaatcctattgtttgatttcatttgtattaaaaaatatatcaaaatcaaaactatgtgtattgactatttttgcaacttcctatgaatctgtatttccaaataaaaggtttataggtgggaggatgggattgtatagaggtgtttgtggatacatatcgatgtgcatgtgtgcttgtgtgtatttccatgtatacatatgcatgtgtacccgtggatacctgaataactataaatagaaagcaatctgttaggatgcccatcaaaattttataagagggccggaaacatcggctcacacctgtaatcccagcactttgggaggctgaggcaggtggttcacttgaggtcaggagttcgagaccagcctggccaacatggcaaaaccccgtcactattaaaaatacaaaacattagctgggtgtagtggcaggtgcctgtaatcccagctattcgggaggcctaggaaggaaaatggcttgaacctggggggtggaggttggagtgaggcaagatcacaccactgcactccagcctgggcgacagagcgagactccatctcaaaagaagaaaaaaaaaacaacaaaaaaaacctttatcagattatcagaggttatcactacagagggaggtaaaattggagggaaaagggtacaaatttatttcacatacttctaaagaccttgactttctttttcacaaagttcatgaattcatgtattacttgtacaattgttttaacaatactttaagctgcttgcaagtaacgggttccatgaaatcagggtttctcagccctggcactactgacatctgggctgtcgtaggcagcactgtagcgcatttagctccacgcctggccactactcactgggtgactgtagcgcacagccacagatgtcacaacaaaaacgtctctagacattgccaaatggccctaaacacagagagagccactgtattcgtcaaggcagtttgtaagttgtctccctccaaatgtgactaggattatcatattccactaataatttacaaaacagatgagcatttgctagtgtaggaaagggcatggttaatgcagcctggtgaggcacactagtgacttcccatcataagtgacaagcagtcccctcttaccttatcatacaaagggatcataaagtaaccattattaggggcacagtctgtctggtatttcaaagtcccatgcttggtgtacagctttatctggaaaggaaggaaggaaaacagaaatcataacattgcctttgggaattaactacacatgttacacctgaatgcactcagtcagtatacattcactgaggacctactatataccagcttttaacacggggcattactggggacagagggaaatcaacaaactctctcccaaatcatgtgactcaatgtttttcagattagaaaccacctacagcctattacaatgccttatttttcaatgctttcctgtttattttagtggctgtctctaggttgctcgtgtaagtttccgggtctaaaacaaatttgcaaactttgccattagtaaggtgcttattaacatgcaaattcctggctgggcacggtggctcatgccagtactcccagcacttcaggaggctgaggtgggcagatcacttaaggtcaggaatttgagaccagcctggccaacaaggtgaaaccctgtccctactaaaaatacaaaaaaagttacccaggcatggtggcaggcaccggtagtcccaggtacttgggaggctgaggcaggaaaattgtttgaactcaggaggcggaggttgcagtgagccaagatcatgccacagcactccagcctgggagacagagcaagactccgtctcaaaaataataataaaaaaaaataaagtaaaataaattgcaaattcctggggcccacctctatttctcaactaaaggtctggaatgagggccagaaatcttccttactaactctgaataatttcaaatacttggagcaacattcatctagaaacttaattttctcattactttcattctctgaagaaaaagagactaaaaagacatttaatatctgtcctctcttcaaggactctctaaaactcttacattctgagcattaccagacacgaagtgttaacccagtaagatgcccaaatgccatctgagtcttccacgtgttgtgtggccttgggcaagctcgtgttcggtttcttcaggtgtagacacagagccgctccttttcatgtggttgtacagattcacatcaatgcatattaagcacctgctacagaatatggattcaaagaaaaatcagtttgcggccaggcatggtggctcatgcctgtaatcccagcactttgggaggccaaagaaggaggatcacctgagcccaggagaccagcctggacaacacagccacacctcatccctactagaaaaaaaattagctaggcatgatggcacgtgcctgtagcctcagctactcaggaggccgaggcaggaggactgcttgaggccaggagtcagaggctttggtgagctatgatggtgccactatactccagcctgagcaacagtgtgagaccctgcctcaaaataaaacaaaataaaataagtaaaatggaaaaagcagtttgtattactgtttaatatctctctctgaagaaaaaggcaacacagtgtaatacgtagggaacatactgggctcaaggaaaatttcctaaatgtacctgcacagctcaaccactctgaggctcagtttccatgtctgtaaaaggaagcagttgggtctgatgcacctaaaagcctcacctccaaaatgttaatgctctatgaccatgaaacaaaccatgacacgagccgcaatgaaacagtcgaatcttaccagctaagaagatgtacaaagtgactaactcataaaacgaacatttgaacatttgggaaaggactcgtgtgaaataaggttaagcctgtatgtaaagttctctgaggtcagtgaccacaacttcattccccagtgcctgagacagtgtcttgcttactctaggtactcagtgaatttgctacaggtgacaaagagattcagatgcatgcatttagtgcagggactggaaattcaccagcctagaccggttagggaggcaacatcaagggacattcatccaaaaggattcagatcactacaaaacccaagccaagggtggcagcctaaagatcggctggttttccagagaaataaagaacccagtttttaatgtgaaacctgctgattgttaaagtattagcaaccagtataattttttttttttaacagtaaggtccctgttagagaacaaaatgtcagtctcatgagagtatggagttttgtctgttctgttcactgtactgctatatccacactggggacaaggcttcagtatgtgccggggctcagtaaatagttgttgactcaatgaacacgatgtaaaaacactcaggatgggagaaagctagagaagaatggcggcagttgcataggaacacaaaaaacacaatcaagaaataaccgtgaaatatcatgattatttctacatctttcataaagtacaatcaggacacaggatggcaatgtaatctacatcaagatggccagtatgaaatgtctgatttcagaatctgaattacttacgaaagaatgagtgtcccacaccatctggacaggcagcccttgggcttaaggaacacactttgaaatgggtcacaaaacctgttctctgctctcaaggtcactattagtatgagggtgagggtggaggggggtgcctgtcttttccttccttccagaacccctggaaactacaagttgcaagaggccttactggcctcttgcatttcagcttctgaaatgccctgtgccgtctacagccataccaccctgaacgtgtcctgtccccagtgcagacctaggaggtggcatgggcacccagaaacatgtacccaggaaatcctaggagccctgccgctgccagtgggtattcattcaatgcctgacctctgacctcttcagcctgaaaaagcagcaaacaacggggccttgaagaagatcacggatccgcttgttaaagaaatgtatctgctgggttccactgtttctctcccaacaccatcctataggtacaaaaactgaaacctagagcaagggcaggtcgcagagctgatggggtgtggaactgactccctacccctcccccaatcctcagcagcccgctttgcagaacacagagcttcacccttcactgccagccctggaacagctcaaaggtgctttcagacgatctttggggtcttattccccaatccctctctttggcatttcccagcctcttccttcgttttctcctaaattacctccgaggcacccgctcttttcctcttccttgtcctaccccaccataaatccccgcccaaaaatgaggcccaggccttgctctggtcccctcccatctaccgggacaaatgacattctgcccctacctccatccatccctttcctctttacgggaacctttctgggtcataatcccaccgggctgataaacatttaacaggactttacaacttaattaaaaaaaaaaaaaaaaaaaaaaaaaaaaaaaaaacctttacaaatctctagggtaattccattaactactcattaaggcaatcagggcagctggcaactctccattttcagaagtggaggggagccggagaaataaaaaatagctttccggccctagggttgccaatactgatctactaggtcagaatctatgggatgggaattgatgctctttaaaatcatgccgcggggtttggaggagcagtggattagaacttcggggggttctgggctgtggagtttgggggataagacatgtggtctctaggttctggaatgtgggtttggggaaatctgagtttcagggggtctgattcgaggagatctcaggtctaagttttaaagaaatggagtctgggctccagggaatttagggtctgggttttgaggatctggggtctgtgttccgcggatctggagtcggggttttgaagaacctgaggtctggcacccctcagtccttagacgaccccatgataagaacctcccctccagcgcgactggggaggggctgcagggagcccgcggacagcatagcctcggaagaggtaagggctccaaggactccacaccgcccggtgtcagagacgaggccagcgcggcccagagaggctgaaccaccggcccggcgactcggcgccgggcggcggggcgggcgctcacctcgatgagcgagtagttgatctccacgtccgacttgacgaagccaccgcagcccaccacgatgtcctccgagccgtgcgccggccccacgccgctcagcagcagcaccaccgcggcggtgaccaccgcgggccccagcagccccgcgccctggcccaccagcatggcccgacctcccccagctagacccaccgccggcagccgggtcccgcccctcacactgcacgccgcaggctccttcctcctcctaggccggctgacagcccaggccccgccccaccgccgccgccagagccgccgcgcacgcgcgcttcgacgccacgttcacagccccagaagagagaactaaggcgcatgctcggcaaggaaacgagaccatctctgccttctagaggcctggaggactccgcgcgacatctggcaggtgcaacgcaaggtgcatgcctacagggagaagctccaaagatgaattctactttagaattcaccatcacagctggaaaggacgggagattttgttggtggaattatctaacaactttctcaaatctttctgacccatatatttcgcaggtaaaatatataatctcacaaaaagctttagggccgggtgtgtggctcacgcctgtaatcccagcactttgggaggctgaggtgggtggatcgcttgagcccacgagttcgagaccagcctgggcaatatggcgaaaccccatctctacacacacacacgcacacgcacgcacacacacacacacacacacacacacgaaaaacgctttaggaatttgtgtaagctggtgtatttttccatgataaatgatcgatacttttttaagcgaaacgtgttaatgttagcatattaaagaaagtatgtaagatttattttaatcctagctctaataacatatgcctagaaacaaattttgatgagttttcttcccctaagcaagaagtgcatgcagtcagtatactttgaattagctctgcaagatgaaacatgatttgcctgaaaacaagctcaaatccagcatattttgtcccaagagtgaattcatatgtacactgaatttaactaccagtcaccacatcaaaatacacaccaaagaggccgggcacagtggctcacgcctgtaatcccagcactttgggaggccaaggctggcagatcatgaggccacgagatcaagaccatcctggctaacacagtgaaaccccgtctctactaaaaatataaacacttagccgggcgtggtggcgggcgcctgtagtaccagctactcgggaggctgaggcaggagaatggcgtgaacctgggaggcggagcttgcggttagccgagatcgcaccactgcactccagcctgggcgacagagcaagactctgtctcaaaaaaataaataaataaaatttaaaaaacaccaaaaaattgcttttctaacctaatattaggatttcttccattttgtctcaaaaaaaaaaaagctagtgctttattttgataggttttgtattttgtttccaaatgacaaagtaagactgaatttcccgctgcaatttgccgttgtggctaaaacttaagcaataaacaactaagaagcacaggttcaaaccatacagtagtcaaaccttcatgggggcaaggagggaatgaagggaatgacacattgacctcagggtcataatcatgagtgcatctgatttcagcttctcttgctgcattttcactcaaatacagtagactctcaactattcagtgataatgagaaaccatttaaataattcgtctatttattggggtttgttatttataaccacaattgaaatagatgccttttatgcaaatcaccagaggattgaaagccaccaattagaaagtgtaggcctatggaaacctttcatcttacagaatgggaaactgaggcccagagaggaaaaggaagttgtctaagactctgcatgcagccataggttttcccggagctagagagcaggaattggggccagaagccgtggcttactactgtaatatgaacatgttgggagtccgaggtgggcagatcatttgaggtcaggagttcgagaccaacttggccaacatggcaaaaccctgtctctactaaaaatacaaaaattagctaggtgtggtggcgcatgcctctaatcccagctacttcaggaggctgaggcaggagaatcacttgaaccagggagccacaggttgcagtgagctgaggtcttgccactgcactccagcctgggcgacagagtgagactccatctcaaaaaaaaaaaaaaaaaaaaaaagcaggaagtgggatccccaagttttgttctggactcacctcaattgatttctgctgtgttcttcttgactttctgactacttccctcaaattcatcttcaaatatagaaagaaatgaagcaccaggactgtgacaatgccaattcatgggggtgggattggggagtggcttgcagagagacagggatttagcttccccataatttccatcagtttccaccaaaaccagctcagataagcagacatgatttacatggaaacagtagacctgccacactgagcttcatgacaaatccttgggttctttctgtcctgaagcttccagaagactcaggcagaaggacagctgaagggggcaggggagggggtgctccctgggcccaatactggatttagagtgatacaaaaagatcggggaaaacacgctgtggggtccctgcagaaggcaagagtagaagatgaggacaggaccccgagaattagcaaggcagcatggagagtgcagaggattttaattcttctcccaaactgagcacctgtgcttgtctgtctaaaagagccgaatatttcattcctatcttgaaacaagtacttgctcactgcaacaacaaagaaattggaaaagaaaactaggattccccaagatcactgtgttaccacatttccatctttttatcgatggatttatgctagtatgacatcgagtcatttctaagaagtggtggctgggtctttgacactttgctttaagaccgaagagagagctgggcatggtggctcacgcctgtaatcgcagcactttgggaggcctaggcaagaggatggcttgaggccaggagttccaaagcagcttgggcaacaaagtgagacaagtctccacaaaaaaatttaaaaattagccaggcttggtggtgtgtgcctgtagtcccagatactccagagaggctgaggtggaaggttgcttgagctcaggaggtcaaggctgcagtgagccatgatggcactactgcactccagcctgggtgacagagcaagaacctgactcaaaaaaaaaaaaaagagacggagagagaaaaagactcaagagaggaaggtaaatgccttggccttcttctccatgttccctaatttaggcatatccttttcttttttgctttaaaaaaaccaaagcctattttatattataatctcttttattcaatcatcatttagcaaccaccttttcatattcatatatgtcttcaatggcattttgtttgcttgttctgagacagagtctcgctctgtcacccaggctggagtgcagtggcacaatcttggctcactgcaaccttcgcctcccaggttcaagcgattctcctgcctcaacctcctgagaagctgaaactacaggcacgcaccaaaacacccagctaatttttgtatttttagtagaaacggggtttcactatgtttgccaggctggtcacaaactcctgacctcaagtgatccgccctcatcagcctcccaaagtgctgggattacaggcatgagccaccgtgcccagttgcaatggcattttaaaccactggttagtaacccatggcctcaattataacagtaacaataaaagctaagtcttctgagcatttaatgtatatctggcagtgtgctaaacgcttgcataatctcactaagttctccccaccactccacgggtagacagtgtccattccagcagtgaggggactgtgacgtggtctccatcctatctccctcggatattatgaaaaatatcacagagtgtacacccactgtgatattaggagaaagctctcccttgggtattagaataatatcacagggtgtacactcactgtgatattaggagtaagatctcccttggatactatgaataatatcacacagtgcacacccactgtgacgcggtacacccactgagatattaggaataatatctcccacggatattaggaataatatctccctcagatattatcacacccactttgatattggaagtaatatctccctcagatgttatgaataatatagaagggtgtacactcactgtgatatggagagtaatacctgcctcagatattacaaataatatcatagggtgtaaacccactgtgatattgggagtaatatctccctcggatattatgaataatatcctagggtttacaaacatggtgtacacccactatgatattaggagtaatatctccctaaaatattactaataatattacagggtgtacacacagggtgtacacccactgtgatattaaaagtaatatatctgtaaaatatgagtacacccactatgatattaggagtagtatctccctaaaatattacaaataatatccccccagtatataacagataatatcatagggtgtacacccactgtgatattagttataataatatcttcttgggatataaggaataacatcacagggtgtacacccactgtgatattaggggtaataatatctacttagcacataacgaataatatgagagggtgtacacccactgtgatatcagaggaagtaatatctcctcagggtgtacacccactgtgatattagtagtaatatctccctaaaatattacgaatagtattacagagtgtacacacagggtgcacacccactgtgatattaagggtaataatatctccagaaaatttgacacaccctgtgatattagcagtaataacatctcaccaggatataataaataatatcacagggtgtacacccacagtgatattagatgtaataatatcttcccatgatgtaatggataatatgacagggcgtacacccactgtgatactaggagtaataatatctccccaggatataacgaataatatcacagggtgtacaccaactgtgatattaggggtaataacatcttccatgaatataacgaagaatatcacagggtgtacaaccactgtgataataggaataatatgtctccaggataaaacaaataatatcacagggtgtactcccactgtgatattagcagtaatgtttccctcggatattgcaaataatatcacagggtgtacatccactgtgatattgagagtaatatctcccttgaatattatgaataataccacagggtgtaaacccactgtgatactgggagtaatatctccctcggatattatgaatcgtatcacacggtgtacagggtgtacacccactgtgatattggcagtaatatctctctcagatattatgaataatatcacagtgtttacaaacatgctgtacacccacaacgatattaggagtaatatctccctaaaatattacaaataatatcatagggtgtacaaacatggtgtacactgactgtgatatttggagtaatatctccctaaaatattatgaataacatcacagggtgtaaacacagggatacagccactgtgaaattaggagtaatatcaccccaagatataatcaatactgtcacagtgggtacacacactgtgatattatgggtaataatatctccagaaaatttgacgaataatatcacagggtatacacccactgtgatattaggggtagtaacatctctcaaggatataacgaataatatgacaaggtgtacatccactgtgatattatgggtaacaatatctccctaggatgtaacgaataatatcacagggtgtacacccactgtgataataggaataataatatttctcaaggatataacaaataatatgacagggtgtacatccactgtgatattatgggtaatactatctccccactacataatgaataatatcacagagtgtacaccactgtgatattaggggtaataacaccttccccaaatataacgaatactatcacagggtgttcacccattgtgatatgagacataataatatctccccaggatataacaaataatatcacagggtgtacacccactgtgatattagaggaaataatatcttcccaggatataatgaataatattacagggtgtacacccactgtgatattagaggaaataatatcttcccaggatataatgaataatatcacagggtgtacacccactgtgatattagaggaattaatatctccccaaaatataatgaataatattacagaatgttcacccactgtgatattaggaataataatacctccccaggatataaccaataatatcacagggtgtacacccactgtgctattaggagtaataatatctccccaggatattacaaataatattacaggatgtacacccactgtgacaatacaggtaatatctcccaggatattatgaataatagcacagggtatacacttactgtgatattaggagtaataatatctccccaggatataatgaatagtgtcacaaggtgtacagccactgtgatactaggagtaatatagtagtatctccccaggatataacaaataatatcacaaggtgtacatgcactgtgatattaaaggaaataatatctcttcaggatataatgaataatatcacaaagtatacacccactgtgatattaggggtaatattatatctccaagatatagtgaataatatcacagggggtacacccacagtatattaggggtaatagtatatccccagaatataacaaataatatcacagggtgtacacccaccgtgacaatatggataatatcttccaggatgttacgaatagtatcaaagagtatacacccactgtgatattaggggcaatatctccacagaatattacaaataatatcaaaagatgtacatgcactgtgacattaggggtaatatcacccaaaaatattacaaataatatcacagcatgtacacaatggtgtacgttcattgtgatattatgatatccatagggtattacaaataatatcacagggtgtacccccactgtgatattaggagtcatatctttctgggaggtcacagcgtgtacacacatggtgtaaattcactgggatattaggagtaatatcgccctagaatatttcgaatcatatcacagggtgtacacccactgtgatattaaaaggaatatctttctagaacattacaaatagtatcacaaggtgtacacccactatgagattaggagtaacatctccctagaatattatgaataatatcacagtgtgtacaggcactgtgattttaggagtactaccttcttaagatattatgaataatatcatagggtatacacccactgtgaaattaaaagcaatagctccctacgatattatgaataatatcacgcagtgtacactcaaggtgatattaggagtagtatctccctaggaaattacgaatattatcacagagtgtacacccactgtgatattaaaagtattatctttctaggatattatgaataatattacagggtgtactccctctgtgatattaggagttatatctccctaggatattacaaatcatatcacagggtgtacacccactgtggtattaggtgtagtatctccctaggatataacaaataatatcacagggtatacacctacggttatatcaggagttatatcttcatagaatattacgaataatatcacagggtgtccaccctctgtgatattaaaagtaatatctttctaggatagtatgaataatatcacagggtgtactctcactgtgatattagcggtaataactccctaggatatcacgaattctgtgacagagtgtacacccactggagtaatatatctctagcatattatgaataatatcacaggttgcacacctactgcgatattaggagtaaaatctccctcggatattataaataatatcacagtgtgtactcccactgtgatattaggagtaaaatctccttcggatattatgaataatatcacaggatgtacacccactgtgatattaggagtaatatctcccttggatatttctaataataccacagcgtttacacacatggtgttcacccactgggatgttaggataatatctcccttggatattaccaatcgtatcagaggctgtacacacgtggtgttcacccagcgtgatattaggaataatatctccctcggatattaggaacagtctctccctgggacttagcagaacgtagccccccagtgttaaataagcgaccacagcaagaggtagaggcgcagggactgaaatgaagacaaatatctgacaagtttaaaacacgtatttaaaatagaatttataaaatgcttaatctgccgactcaggagcccgcggtgcagggtggggtgggagttggcaggtgaccgctacaccagcagagtaagactgcagggctgcggccctccctcctatgcccttctgttcagacacccgaggggctcatgtgcactcctgggatcatacgaccagaaaacaggaccctagaggtttcttgagtttctgcttaccagggcggctgggtatagccctgccagcccattgcataatcttctaagttctccccaccaccctccattccagcagcgaggtgcctgtgatgcggtctccatcctctcggcctcgacccggtggtccccgcgattggacgcttaggcggtcaccaggcctccttgttactaacgtgtgcacacctttcagttctctcatcaggatgaactcctggaaattgctgggtccaaagtgtttgggaagtttggagtgattcttgttgcagggggaagagggaactatggaggtgtcactgaactttcaggggttccgggaccccccaacccggtgcccgtcccagctccccgagcgcctctcttcccccctcccccacctcgcctgttttcacctcccgtggcctcactcccgccgcgcagctggaccttgcccggggcctcccgatcccggagctcgaatcccagccggaccagcctagcccgaccagcccagccccgcctcttctccggcaggatcgcggccgagcagtctgcccagagacttagcgacagacagacgctgggacccacgacgacagaaggcgccgatggccgcgcctgctgagccctgcgcggggcagggggtgagtgccccccatcgcgccccactctccttttccaggcttggtttggctgcagatctctcgggctgcgatactggggagaggagagacccccaaattcctggacccgggaagcgaggagacttactccggccccctcactgcagcgggttggatttctttcaccaagccagccgccgagagcccagctctatttaaggggccaccagacctcccagctactagaggctttgacccttctttgcataaagctagtgggtcccccaagccctcctacccccggagagcccttacctctctggtttctttttccattgctcttagcaaaggactccagggagtggagttcatggagtgggggtgggggttgcaaactgccagcatttcgagggccagggagttgaagcaataaactggcaatgaactgagggctttctctgtgcctagccttgtgcccaaccttgtgccatgctgctatgaactttgctgctattcatccatttaatacaactcatagaggtagagtctcgttatcccccttttgcagggaaggaaactgagatacagagaggttaaagtttgcacagccagtgagttgtgaaaccaggaggagtaaaaagacagcggagagagaattgaagaggccacgtccactaaacttcaaatttcttctagggttagataggaccagcagacctgctgagatgaaaataacagatcaagctgggccggtggctcttgcctgtaatcccagtacctaggaggctgaggcaggaggattgcttgaggccaggagttcgagaccagcatagagagacccccatctctacaaaacataaaaaaaaaattagccaggcctggtgaggcggcttatgcctgtaatcccagcactctgggaggccgaggtgggaggattgcttgagcccaggaaattcgaagctttgttaagctttgattgtgccacttcagcctgggcaacagagtgagaccctgtctctaaaacataaattaattaataataaaaaataaaaataaatcatacatcaagaccaccagtcgaacgaggtttggggtcagataagcctgggtcagagtcagctttgccacttcccatttgtgtgtccctgggggaggcatttccccgattggtgcctcagtctgctggtttctgaaatggagacagtactgtctgcgtcctggagttgttataaggattaactgacagtccatgcctagcaatgattatggagcccaggtctcctagaccacatggcccagttccctgggttcaaatcccagcccttccactcctcagctgggtaaactcagcaaagttactcaacctctctggtcctcagcttcttcatctgcaaatcaatataattgcaactacctagggttaatgtcaggatgaaaggaattgagaattagtaggtattccaaagagtgcttggcacatttttgtgtaaatgttaaagatccaaaaagttgcctggccccccgggcaggtgagctggggacccctgccttgtaccatcctaagggtcctctttgtgttccctcaggtctggaaccagacagagcctgaacctgccgccaccagcctgctgagcctgtgcttcctgagaacagcaggggtctgggtaccccccatgtacctctgggtccttggtcccatctacctcctcttcatccaccaccatggccggggctacctccggatgttccccactcttcaaagccaagatggtagctgccatccctgggagcctggaaccaggcaatggtggggggaggcaggggacaggctggaacctggtgaagtcttaaagtagactcctcctatcggggtgtagaagggaatctgttaatcaaacagagcaatattagaaaggctacagaggtcaattcagtggaacacggttctcccaaacagattttgtaattccgaaaatccacgcatgcgcaaacatacgcatacactcccatgttcctggacagtttatagctaccataacctggcattttccaaaacataccatgtagactcttggatacacaaggtaattttagggccacattaggatgaaccttttaaaaagttatgcatttatttttatgttcccccactggctgtattataggacaatttttatatgtgatatgtatttaccttagtgtgttaaataaacactggcattccaagtgtgagcctttctgctcatccatcctcttctactccattcttgtaggcttccaaagaatgttcttcagagttcattcattcttctgccattgtattaatttttatattatcacccgccaccaacccaggggttggcaaacttaaagagccaagcggtacacagtatttgagactttgtgagccaggtaatcttccttccgaacactgaactctgccattccagaatgaacgcaatagtcataaccatagacaatagtcatgactgtgttacttttttgttttgttttgtttttgagatgcagttttgctcttgttacccaggctggagtgcaatggtgcgatctcggctcactgcaacctccgcctcctgggttcaagtgattctcctgcctcagcttcccgagtagctgggattacaggtgcccacccccacacctcgctatttttttgtatctttagtagaaacagggtttcgccatgttggccaggctggtctccaactcctgacctcaggtgatctgcctgccttggcctgccaaagtgctgggattacaggtgtgagccaccacccccggccgactgtgtttcaataaaactttatttgtagtcactgaaatttggatttcatgtaattttcacctgtcatgacatatgctttttgtttttctttgatgattgatagtttgccaacttctgctttaaactgaggttctttgagcagttcctccaacgtaacctagctctggccttccctctggtgtgcccacgttctctcattttcttcctttcttttattcaatagagaaaccaaaatatattagagagaccctagagacttactggcccaacagagagttgcttcttgatttcatagcaaggattgaaaaatgacttggagaaaggatagttttttacctggtgagtacatttcatttcctgctgtttctccatacccagagtcatctcatatgtgcacgattggagcacttcctgcattttggaaaacattcggttggctcaagcccttcctgtgcattatttatatgacagttacaggtcaggagtgatctgcaatgccctttacacattgttcacattggcacgtttctagctggtgaccctggtatactcagtatcagccaggatgctgcagaaccagctcccagttggacatggggccgcctaccagtttgctgtgacctctcttattgccccccaagcttatctaagcctgtatcctcaggtgcttggattcgccctcatagtcctgtgtacctccagcgtggctgtcgctctttggaaaatccaacagggaacgcctgaggccccagaattcctcattcatcctactgtgtggctcaccacgatggtaatgatgccctcagtctggagcccggcttcctcccagctgctgctttgcctgccacagtggagaacaaggggaagagaagaggctcccctcagcctcccaccctcccctaaggggcctccctgactttcccgtccagagcttcgcagtgttcctgattcacaccaagaggaaaaagggagtccagtcatctggagtgctgtttggttactggcttctctgctttgtcttgccagctaccaacgctgcccagcaggcctccggagcggtaagtcggggcgtgggccaccctgggaaaccaaaatggtggttcatgccttgggtcccttcctttctcctcctgtttccacatacaacttattctctatacagtgacacacacaagccagtcacttacactctagagacacaaaatccactcccgcacctgtcagtacccatcatcccatacatttcttatccacacaatttcctgtcttacacgcccacatcacacgtgccacttgctcacgatgcacacacttataggcactgattcatacatcgcacaagtacatgcatgcacgcacacacacacaacctgggcacagacacacctgtgtgcacacatacccctccgtgcacacctcccctcatgtcatggattcaccctccccatgttcctatgcacctatatttacacactcattctgcacaccactcgtatttctgttgtccaatctgggaagcagctttttttttttttttttttttttttttgagaggcttgctctgtcgcccagactggaatgaagtggcatgatctcagctcactgcaatttctgcctctcgggttcaagcacttctcctgcctctgcttcctgtgtagctgggattacaggtgtgtgccactacacctggcttattctaaatttctactaaaaatttttgtatttttagtagagacgaggtttcaccatgttggccaggctggtctcgagctcctgacctcaagtgatccacctgccttggcctcccaaagtgtcgggattacaggcgtgagctcttgtcattcggccggaagcagcgtttctctattaggagacatgatgggtcattttctctgtaaagagaaaaacatgtagcctagaccagcttccctcagcctcagctttagtaatgttgtggccagacaattctttgttgggtggacagggctgtcttgtttgctgcagggtgtgaaacagcatccctggcttctgcccataggtgccagtagcataccatccaattgcagtaacccaaaatgtctctagatattaccaagtgtccctgggggtgaggaggacaaagtcacccacctattgagaagcactggcctcgacagtgtgcttagccaaggcttctgggagagggagttagcttaacaccaatgaataggctgcagcaggtttcagatattttacttcattattttatttttgtggagacaacatcatgctttgttgcccaggctgatcttgaactcctgggctcgagcaattctctgacctcagcctcctaaaatgctgggattagaggcatgagccaccacgtctggactcacagatcatttcttcagtccagtggttactccatcctgctcctaaaggagaaggtagagaagcatcaccctgtccttaaggacagagtttttattttttgtttgttcattctgagacagagtcttgctctattgcccaggctggagtgcagtggcacgatcttggctcactacaacctccacctcccgggttcaatcgattcccatacctcagcctcccaagtagctgggattacaggcatgtgccaccatgcccagctaatttttgtatttttagtagagacaaggtttcaatatgttggccaggctcatctcaaatgcctgacctcaagtgactcacccacctcggcctcccaaagtgctgggattacaggcatgagccacagcgcctgaccaaggacagagtttttaaaagagtaacctttgtaactaaggggaaattccacaggttattcagtaatttctgaaatggtgggctcccgcagttgacataagtcagctttttgggacacagcatagaaacaataatactgggaccatatacactctggggttccaaccatgtgccaggcactgtggcaggcacttacacacgtctcctcactggattctcacaagagttcacagtgatgggttcttctttatttttttaaatagaaatagaaacaaagtctcattatgttcccaaggctggtctcaaactcctgggctcaagcgatctttccacctaagcctcccaaagtgctgggattacaggcttgagccaatgtgccccagccaatgatgaattccagccgtcccattttaaagatgagggagactaaggctaggagaagggaatgacggcctcagggccacaaagcttgggagtgcagagcccgagttcatctcaggcaaattcagaacaaactttctgagagaaacagtggggaaaacagtgggagtttagggaagatgggccatattgtcattggaatatccaattgtctgctatctgccaaaaaacaaacaaacaaacaaaaaccccaaaactagaagagtataaaatccagtagaggaatcgtgatttaaaactagggctctggtttaaagccataaaacctcagttcacactagcttaatgaaaagggaaagtcaagggggttcattagctcatgcatttattagctcatacccatgggatctcccaggcatgactgatccaggcctgggaccaggtaccatcaccagatctccacttctgcctcttggctctgccatgttagcttgattctccaatggagtggcaagaagagccaccaataccttcatacttacattctagcatgtagcaaagccagcagaatctcccgatggttccagctctcaagtacccagcattgggtgctatgtgcattcctaaccctgccatggtagccaaaagactcgaatgtattcattggccaggcctcattcacccacccagcctcggagtagggtcagttctacacaaatcacacgcctgaacacaagcaaaaaacttaggaagaaagaaaatcagtacatggaagagatctctgcactcccatgattattacagcactgttcacaataaacaagatttggaagcaacctaagtgtccatcaacagattaactgataaagaaaatgtggtatatatacacaatggagtactatgcagccataaaaaagaatgaggtactgtcattttcaacaacatggatgttaagcaaaataagccaggcagagaaagacaaactttacatattctcacttatttgtgaaagctaaaaattaaaacaatgtaactcatgaacatatagagtagatggaaggttactagaggctaggaaggaaagtgggtgggggaaatgggggtggttaatgggtacaaaaaaacagaaagaataatatctatttgatagcacaacagggtaactatagtcaataataatttgattgtacattttaaaatatctaaaagaggctggacacagtggctcacacctgtaattccagcactttgggaggccaaggcaggaggatcatctgaggtcaggagttcaagaccagcgtgggcaacatggtgaaaccctgtctctactaaaaatacaaaaaaagtagccaggcgtgctggcacacatctgtaatctcagatactcaggaggctaaggcaggagaatcacttgaatccaggagatggaggttgcagtgagccaaaatcaagccactgcactccagcctgggcaacagagtgagactccaactcaataataaactaaaaaataaaataactgaaagagtagaatggatcatttgtaacagaaaggataaatgattgcggggatggagacctctttaccttgatgtgattattatgcattgcatgcctgtatcaaaatatctcacgtcatctagaaatatatatagcaggccgggcgcagtggctcatgcctgtaatcccagcactttgggaggccaaggcaggcggatcacctgaggtcaggagttcaagaccagcctggcctacatggtaaaactccatctctactaaaaatacaaaaattagccaggggtcgtggcacatgcctgtaatcccagctactcaggaggctgaggcaggagaatcgcttgaacccaggaggcggagggtgcagtgagccaagatcatgccactgcacatcagcctgggtgacaaagcaagactccgtctcaaaaaaaaaaaaagtatacacacacacacacacacacctaaaattaaaaaataaaaaatgttttaaattaaaaaaagaaagaaaattagggtgtttctgaccagatgacagggcagaaggtgcaaaaatcattgtggtgtggcagcaggagcatcacaatttggaccagatcatctgcgtgtccttgaacaaggtgctgtcacttctctgagccttgttttccccatgagtcaaaggaagcaagtaaactccagctgatgagactgtgtatggcaagaatgccgcatgtgcccagggcagggtcagtgctcaataaaaccagctctcacctctgcaaaacagagaaccctggccaagggggagcagggttgaagattagggtagagggtggaatggagaaaggatttcttttgtggcacaaagaagaaggtaaattgtttcttcatctcattgtcccagcagctgtggccaatcatcacgtggctaaggacaaaacccagacacagccctggcccaccatttgtacagacagaatattataaattgggtatttgaaaattaggacctgctgggcgtggtggctcatgcgtgtaatcccaacactttgggaggccaaggcaggcagatcactttaggtcagcagtttgaggccagcctggccaacatggcaaaaccccatctctactaaaaatattttttaaaaacattagccaggcatggtggtgggcaccggtaatcccaactactaaggaggcagaagcaggagaatcacttgaacccaggaggcagaggttgcagggagccgagatcataccactgcacttcagcccgggcgaccaagtgagactttgtctttaaaaaaaaaaaagaaagaaaattagaaccgctaggaaagccagggctctggctttcaaatactcttgccctggtccccagagtgggcactgaccccagatcagaaaccttttctctcctctgagcaccctcctctgtctccattccttaccttctgctttccctcccacagggcttccagagcgaccctgtccgccacctgtccacctacctatgcctgtctctggtggtggcacagtttgtgctgtcctgcctggcggatcaaccccccttcttccctgaagacccccagcagtctgtaagtcaccaagttccaacctcattcctgttccactttgaggtctcagtctcccccaggtgaccaaaagtctttaatttttttattcatttagccattcagcaaaaagtgtatcgcatttctactcgatgccacagttggcagactttttctatatgggccaagagaaaatattttggactctgtgagccatacagtgatctcagtggcaactactcaactctgccattgaacgcaaaagcagaatatgtcaacaaattgcatggctgtgttgcaataacactatttgcagaaacaggcagtgggccagatttggtcatagtttgccaaaccccgctatgccctagcaagggcataaggatctatggtgaacaagcagatagagtttctgttctcacgtagctactggtcaagcaggggaaccagacactggtcacaaaattaaacaaatatgttgaaaattggatggtcacagtggctcatgcctgtaatcccaacactttgggaggccaaggcaggtggatcacttgaggtcgagagttcaaagccagcctggccaacatggtaaagcctcatctcttctaaaattacaaaaattagccaggcatggtggtgcacgcctgtaatcccagctactcgggaggctgaggcaggagaattgcttgaatccgggatgtggaggttgcagggagccgagactgtgcatttgcactccagcctgggcaacaagagcgaaattccaccaaaaaaaaaaaaaaagaaggaaaaagaaaattacccttggcgtaagtgctccatagaagaagctcatgagagattgagagatttacaataggtaacactgaagcagtctgtgaaatcaagaaacaattcttttgtggaagagactgatctgacatcatataaacagatgttcaaatggggccagatgcagtggatcatgcctgtaatctcaacactttgggagaccgaggaaggaggattgtttgtgcccaggtgttctagatcagactaggcaatgtagtgagaccccatctctacaaaaaggtttttaaaaatagccaagtgtggtggtgcatgcctgtagtcccactacagagtagctctgtggagactaaagcaggaggattgcttgaatccaagagataaaggctgcagtgagctatgattgcaccattgcactccagcctgggtgatagagcgagaccctgtattcaaaaaaaaaaaaaaaaaattgctcgaaggcttgagaatagttaaaactatcataggaatcttttttgtacctaccagagtaggaacaaaatttaaaaattgataagctgcgatggcaaaaacgtggtgaaatgggcaccttcacgccttattggtaaagagtacagactgttgtaatcttcctggagcacctgacaaaaatcgcacgacaggtctgtcttcacaacatttgccgagggatattgtcaaggatctaatttcttcgttatgcagtgtccttccttttgagaagcaaagcaaggttttggtttcagtataatcatagttgttcttctgagccactgttagttcttaccttgtggacattgtcaggcctgtggcccaacctctttttacgctgcctgctgggaagcaccaagctcactggtctacacccctggcaaggagacagggcacctcgatgtttactttcagtactaaatacaccgtcagggctgggtgtagtggctcacgcctgtaatcccagcactttgggaggccgagataggcagatcacttgaggttaggagtttgagaccagcctggccaacatggtgaaaccctgtctctactaaaaacacaaaaaattagctgtgtgtggtggcgcacacctgtcatcccagctctttggaaggctgaggcaggagaatcgcttgaacccaggaggcagaggtagtagtgagccaagatcacaccgctgtactctggcctgggcaacagagtgaaaccctgtctcgaaaaaaaaaaaaatacacagttcgtcctgtcttcctacccttgccacatacttcccttctccatttttgtctgttgcagaacccctgtccagagactggggcagccttcccctccaaagccacgttctggtgggtttctgggtaagtaaagtcgcacggaagggttggggtggtgcctcacccgcctgcatttgctgctctgattcccagccatggcccttcccctgtgcttacaaaggccagcaagtctttctccatcccagcctcagtgctttcttcttcgtgttcagtgtctaccatctgcatcctgttcccattcactcactggagtgagatcttgatttgaatcccggctctgcctgttagcaggccatgtcgcaaacctccggagtctcagttttccctctgtaaaatggggatgactcaacctgcatgagacggaaagtgcttagtgcttgcacacagcgggtgcttaatagtaatagaattgtctccaatacttgatttcagtcattccaccaacatttaataggcacctactatgtgctaagccccaggggtgaggagataaaggagcaagtgtctactttctagagggttccaggcagattgagaaaatagctgcttctccagggccagctcacaaggcatttgaggatgtgctccctcccaaccacacggcattcagacctcagtagcacctgacatgtggatttgaatcctggccctaccacttcctagctgtgttgctttggacaagttacttaacctctctgtgcctcagtctccactccttcaaaatgggattaataatagcacttagcttatagggttgtgaagcttaaataagataagatctgtaaagcacttagaacagggcctggcaaataatgagtgtaagtggtaattatttttttttcttttgagatggagttccactcttgttgcccaggctggagtacaatggcactatcttggctcactgcaacctccgcctcctgggttcaagtgattctcctgcctcagcctcccgagtagctgagattacaggcatgcaccactatgctcggctgattttgtatttttagtagagacagtgtttctccatgttggtcaggctgatctcaaactcccgacctcaggtgatctgcccgcctcggcctcccaaagtgctggggattacaggcgtgacccactgtgcctgggctattcattttctcttttttttttttttttttttttgagacagagtatcactcttgttgcccaggctgcagtgcaatggcacaatctcagctcactgcaacctccacctcccaggttcaagcaattctcctgcctcagcctcccgagtagctgggattacaggcgcctgccatcatgcccagctaatttttgtagttttttgtagagactgggtttcaccatgttggccaggctggtctgaaactcctgacctcaagtgatctaccaccctcgacctcccaaagtgctgggattacaggcataagccaccgcacccggcctaaatggctattaaataaatgaaaaatatcaggctttgaatgtgtggaactggtagaaagagcttagagattttctaaacagctctactggggggtccagcccctgcttcccaaacttaagcatttatggaccactcttgatgcttttttgtcctactggggcaaaaactaaattgagtcactttttttacttgaataaagtgtttttaaaaagaaactctctatcactgctaaaataggaaaaatctatagcatcacttgccatataggagaactccaataacaatttcagggaaaatcaagccacgttaataatttctatgtcagaacggttgcttccccaagttggctctgcattagaaaagggaacttggtggcctggcgcagtggctcacgcctataatcccaacaccttgggaggctgcagcaggtggatcacctgaggtcaggagttcgagaccagcctgaccaacatggtgaaaccccatctctactaaaaatataaaaattagccaggtgtggtggtgggagcctgcaatcccagtcactcaggaggctgaggcaggagaatcacttgaacccaggaggtggaggttgtggtgagccgagatcacaccagtgcactccagcctgggcaacagagtgagattccatctcaaaaaaataaaaagaataaaaataaaaaagaaaagggaacttggtaaggcttagagaagagtcagagatcagaaccaggcaagaccttctggctggtgtcatcagaaagattaaagagacctgaggccaggcacagtggctcacacccataatcccaacactttggaaggccaaccccgacagatcacttgaggccgggagttcgagaccagcctggccaacatggcaaaatcccatctctactataaacaacaaaattagccaggtgtggtagcttacgcctgtagtcctagcactttgggaggctgaggtgggaggattgcttgaggccagtaggtcgagaccagcctggccaacatggtgatacaccacctaaaaacacaaaaattagccaggtgtgatggtggcttgtaatttcaactactcagaaggctgaggcgtaagaatcacttgagccagggaggcggaggttgcagtgagcccagatcacgtcagtgcactccagcctacgcaacagagtgagactccgtctcaaaaaataataataataatttaaaaaaaaaagctgagggaggagttcaagcttcttctacaatgatagttttggtcaacggacttccgattcccagggaaatgtctgtttcccttgccaagggctatcccttggtttagccactgaatctctctgcacttctatttccttccccatctgtaaaatagatctataataatatactcacacatttatacaattataaactattaaattacaggctgggtgtggtggctcatgcctgtaatcccagcactttgggaggctgaggcaggtggatcacctgaggtcaggagttcgagaccagcctggccaacatggtgaaactccatctctacaaaaaatacaaaaattagccgggtatggtggtgggtgcctgtaatcccagctactcaggaggctgaggtaggagaatcgcttgaacctgggaggtggaggttgcagtgagccgagattgcaccactgcactccagcctgggagacagaacaagactccatctcaaacaaacaataataacctaccttatgggttcatgtaagaattaatgagacaatctttgtgaaacgagaaatgccctgcagacattaggtggggttagtgaattgctttctttttacccaggggccagtagaggtacagagaggtaaagtgacttacccagggtcacacagctacttgcctggccaggatcctgcaggggtgaatggcaggaaaagctttccctggtgcccctcttttgcagcctggtctggaggggatacaggaggccactgagaccaaaagacctctggtcgcttgggagagaaaactcctcagaagaacttgtttcccggcttgaaaaggagtggatgaggaaccgcagtgcagcccgggggtaagtgggtggaggtcaagaactcacctgatgctccttcagaaaagctcatcattggccgggtgcggtggctcacgcctgtaatcccggcattctgggaggccgaggcaggcggatcacaaggtcaggagttcaagaccaatctggccaacacagtgaaaccccatctctgctaaaaatgcaaaaattagctgggcatggtggtaggcacctataatcccagctactcaggaggctgaggcaggagaatcgtttgaacccaggaggcagaggttgcagtgagtggagatgtcaccattgcactccagcctgagtgacagggccagactccgtatcaaaaaaaaaaacaaacaaacaagacaaaaacaaaaacaaaaacaaaaaaaacctcatcatttgacccccagtccagcccccaacgctactctggctgcactgccgcctccccaccttgccttccagctgatcccactaagtagtatcaggctcaagatatggttcctcccagaacgcatcacaggttcctacaaacggggaacaaacaggttcctacaaatggggaaatggcagaatgacaggcagcaaacagaagaggtattttaaggccggggtggagggttgggaggggactcaacacacaagcagctgctcacttactatataacctgagcaattcctttcctgggcctcagttttctcatctgttcagtggggatgtcattagccccagctcatagcttatggggatgaaaaaaaaggatgatttatggaaaagaacttgcaaatgtcttgcaaatgggaagtgctcaagcactgttagtcatccagagggtgttaagatctttggagttatccactctgtccactcctgccctcagtggcatctctggaaacttctctgcagcccttagagcctgggatgcctcatttgagaaactctggtctagataaatgagcctgcataggattagataaaattgggttaaatgctgccctgccttcaaatagtgatgaccctggacacgttgcttaacctcaccggaccttggtgtttcaggagacagaacaaaaaaggaagttagctctgtgggaagttccctgcatactccgggattttgtggtagttgttgcagatggctgaatcccacacattaagagagacagaggagacagagactgatactataggctcacacagctaagaggatctagcctcaggtgttgctggatcaggggactcaaatgatgtcaggattctctcctttcatctcccatcccaactattgtctatgtgttggtctctccataaggcctatcccttcccatgcaagttcagcaaactccagcagaatgagagagcatctctctcctaacgtccatatagtaaatcccaaggaaggcctctaattggcccggctcaagtcatgtgcctttcaggggccaatcccatgcccagggggctggtgccatgactggtggtcccttcagagccacagaagtgggtaggggctgttcccacaaaggaagggcatgtgtttttccaaacagaataagtagtgtgagagaaccaaaacatcagttctctctcaccccaggcatggcttgctggacccccttcactgggttggttggttggtttgttttttgagacaagagtctcgctctgtcacccaggctagagtgcagtggtatgatctcggctcactgcaacctccacctcctgggttcaagcgattctcctgcctcagccttctgagtagctaggaccacaggcgtgggccaccacatctagctcatttttaaattttttagtagagacagggtctcaccatgttggccagggtgatcttgaactcctgacctcagggtatctgcctgccttggcctctcaaggtgctgggattacagatgtgagctactgcacttgactcaccctctacttttaaatgattttacggaagtggcagaattcagtccacaggggctctggaaggagcctctgccaactcctggcatccccagccaacatgaaaattacaggtcacccaacactagaactaaagggtagaaacattctccagaacagtttgagaatcctcccataaacagttgacagaaagaaaggggaaagatggggttatacaaagaccaggctccgtcagcttctgaaacaaccgactgcacccacagagaactttggttttctttctgaagtattttgcaaccactgggggaagggagagggcgtcctcctgagaggccacacaacagccacctgctggtcaagtcggcttcactaatttttgtattttttattagaggcggggtttctccatgttgctcaggctatcagactggccctgaactcctgacctcaggtgattcgcccacattggcctcccaaagtgctgggattacaggtgtgagccaccgtgcccgtcctccaccactcccttttgtatcccccaactcacaccttgcccatgccactcatgcataccccctgccttgccccaccatcatttgtgagatctgcactaaatggccttcagtccagagaccagacgtcagacagcaatctggacatcttccttgatgggaggtgcgacctgcaggagaggaaaacacttgctatggagcctgcaggctgaacacactgactctctggggcaaacagctcaaatagaactgagcaaaacctcagccagaaagaaaactttccagtcaactcttccccgaccccattttgcacatggaaacactaaggctcagaggagaggagacagagcaggcattggaaccacagtctcctggctccaaagccaagttctgtccacccagccaagctccttccttccttctataaatttttataacagcatgtgcggggggcactcttattaggccctttgcacacatcactcaatctgtttttcccattcatttgacaagtgtttattgagctcccactgtgtgcaggagctggactctatactagggacatcttggtggaaaacacaggcaaagtctacccacctggggttctaacgagacaaagagagggttggagccatgggcatagctgtgaaggcaatgaattaaatggcaggatcaaacaggaaagggtgggcagggatgctctctgtatggaaggggcatcttcttggctttgagatccaaatgccaaaatatttgtgagcagcaggccacacccactcagtaacagagctgaaccacaaccctccatagatgccaaaccaaacaccagatcagaccaataatgtgggacagagaccttggccttgaagggtctggccacctgagctcaccagaggttttttcttatgcttctttttttattattattttattatggtgaggttgggggtccttagtgcacaagaaaccctctacgaaccataaatcaagatctaggctcaaaaccctgctctgcccttgctgtgtgacctcgggcggctgtcgccatctctcagagcctcagcttccccttctgtaaaatggagaacctaataatgctcacctggcaaggggatccaggggagtcagtgagctccttcgtgtaaagagctgatcccagcacgtggccccgggtcacagatctgtaatggggattgaaattactgataagtggccaggcatggtggctcacacctgtaatcccagcactttgggaggccgaggcaggtggatcacctgaggtcaggagtttaagaccagcctggctaacgctgtgaaaccctgtctctaccaaaaatacaaaaattagccaggcatggtggtgtgtgcctataatcccagctacttgggaggctgaggcaggagaattgcttgaacccaggaggcagaggttgcggtgagccgagattgctacactgcactccagcctgggtgacaagagcgaaactccgtctcaaaaaaaaaaaaaaaaagaaaaagaaattactgataaacttataggttgtcagagccacaggggactcagcggaggaccacacccatcctctcacacacagagagaggagcagtgtccccgcccaggaccacacagcaaccggactgtcagcagctgcatcgccccagcctctcctttctggcccagggcttctgacctgcctcacaggcgccctcgggcctcccccatctcctccctccctccctcaccttagctcttctctgtggcccctggttatagccaaaggctggggatcttattagtttgaggcagcctgagcttctgtctgcactttcacccagagctagagcaccaggccccatgcccatcagccatgattctccaccagttcaaaaccacctaagggctggctgattgtgtgtgttggggacggggtgctgttcttcctccaggttgacaacacgataggttgaaaagtacatgagaggccaggtgtggtggctcacatctgtaatcccagcactttgggaggctgaggtgagcagatcacctcaggtcaggagttcaaaaccaacctggccaacatggcataaccccttctctactgaaaatacaaaaattagctgggtatggtggcacttgcctgtaatcccagctattcgagaggctgaggtgggacaatcacttgaactgggaggtggaggttgcagtgagccgagatcacaccactgcactccagcctgggcgacagagcaagactttgtctcaaaaaaaaaaaaaaaaaaaaaaagataaaagaaaagtgcatgggctctggaggcagagagctggaatcaaattccagttcttttacttctcagctgtgtgcccttgggcaagttcgcttctctgagccccagttttctcatctgtgaaatgggaacaacacctggcttctcagggggtcttaggatgactggggagtgcctggcacatagtaggtgctcaacaggtgtgctttcccatggccatctaagaggcctcagagtgccctcctgccctgccccccaactcccatgattgtctcttaagtgggtactcagggtgataaggaggaacaggtgagggagccaggctagatccacacccacccatctccactgttgggaaaacaaccctttaatgcctggccctgccgctggtggctgagagtataaaatgggacccagagctaatctctcccttcccctcaggcacaacaaggcaatagcatttaaaaggaaaggcggcagtggcatggaggctccagagactgagcccttcctacggcaagaagggagccagtggcgcccactgctgaaggccatctggcaggtgttccattctaccttcctcctggggaccctcagcctcgtcatcagtgatgtcttcaggttcactgtccccaagctgctcaggtgagtcccagacctcaagtgccctgctaaggtgggtggtctcttagtggcatccttccagggccagggggcttcagctctcctgcctctgcctatacatctggtgctcgggacactggatggtgggtgagaaggatactgaggaagggaaatggattaatgagaaagtgactgacccccagaagggcaaataagcaagctcttacctgactgcaccaattagtttttgctgtaaaatgccccaaaagtgagtggcttaaaatgacaaacattcttttatttagttcatggtaatgtgggtcagtaatgtgggctgggctcagctgggtggttcttcttttcttggctgggttttctcatgtgcctgcagttgtgtatctgagactgggatggctgtctctgctccatgtgggtccccatcctccaaaaggctagctcagacttgttcatgtgggtgcttgggagggttctaagaaataaaccaaaaaccacattttctcttgaggcctaggctcagagccagcatggctttacctccactgtactctgttggccaaagccggttttgtagccagcccagattcaagtggtgtctgctcagctgacataacaaagcatcacagactgagactgagtggcttgaacaacagaaatgtattttatcatgattctcgaagctggaagttcgagattagtatctgcaaggtggttccatctgaggcctctgtccttggcttgcagttggccacctcctccctgtgtccccatatggtctttcctctgtttgcgccccctggtgtctccttatgtgtctacatttcctcttcttaaaaggaccccagtcagattggattagggcccagcctaatgacctcattttaacttcattgcctctttaaaggccctatttccaaatacagtcacattcagaggtactgggggtcggggcttcaacatataaagtttgtgaggacacaatttagcctataacaagtgggaacaaaaactccacctcttgatcttgaggagctgcagtcagattgaaaaggagtatggacagtgggggaaataacggagaccattattgcaaaaaaaaccacactgactgatcctccacacctggactagtttgggccgactgatcctccacatctggactggtttgggcaaaggcaacacccttaggcacctcctctcaccagctgtaccttctccctccttcccctgcaagccttttcctggagtttattggtgatcccaagcctccagcctggaagggctacctcctcgccgtgctgatgttcctctcggcctgcctgcaaacgctgtttgagcagcagaacatgtacaggctcaaggtgctgtagatgaggctgcggtcggccatcactggcctggtgtacagaaaggtgagccctgggggacaagggcaggtcttcccagccaggaaaagcagtatcactgagcaggcagtaatgttatcagcagctgagaacgcattcagtccttgcttattagagtcactcaccatacattctcacttccttagttatttctctttattatatgtatttatttttttgagacagagtcttgctctgtcacccaggctggagtgcagtggtgcaatctcggctcattgcaacctccgcctcccaggttcaagtgattctcctgcctcagcctcctgagtaactgggactatagacacgtgtcaccacgcccagctaatttttatatttttggtagagacaaggttttgccatgttggtcaggctggtctcgaactcctagcctcagctccttagttattcctgtaaggtcttgtgtgatctgtccctagggtgtctctgacctcatcccgtcacctcctcccatgctcactctcctccagccacacaggtctcctttcagttcctcaaacactccaggcacccacccaccctggggcctttgcagttgttctcactgcctagacaccgtttccactccctctaatctaattttaatttttgagcctaattttaacttccactcattcccccttgaggataaaggattaaccttctgataaggtggcctgtcagctgtgttcccagacaatactgcttgaggtaaaaatgacccctaggctgggcacagtggtgcacgcctgtaattccagcaatttgggaggctgagacaggaggatcacttgaggtcaggagttcaagaccagcctggccaacatggcgaaaccccatctctactaaaaatacaaaaattagccaggcatggtggcgggtgcctgtaattccagctactcgggaagctgagacaggagaatcgcttgaacccgggaggtggaggttgcagtgaactgagatcatgccactgcagcgcagcctgggtaacagagcgagacctcatctcagaagaaaaaaaaaaaaaaaatcccaaattgcatctgggctggaagttctgtccattgactgtgaatacctggttggaggccatagctttagacttctctctgtgcagtggctcttgtcccttccggggactctggaagctaagtccctggactgctgccccaagagctattggctcctgtggggtatggagcatctgagccagggcaggtcccgtcccatgtaagtgtcattctctgatacctgagctgtcacctaggggaggaggggacagaggggacagctcctaggtggctgagagggcagctcttgatgctgtcctgccagagtgctgcgtcccaggctcctgttcccctgagcatgccagagctgggtgtgccctatcctgtcttgagagtccacatttccttgagcctaagaggaaggccgcctggtgagcaggcattgatcttcctattccccacccacccgccaggaggccttctttgatctcctgatgagatcagatccctcctctctaacctctgggcttttttttttttttttttttctgacagagtttcgctcttattgcccaggctggagtgcagtggcacagtcctggctcactacaacctccgccccctgggttcaagtgattctcctgtctcagcttcctgagtagctgggattacaggtgtgccccaccatgcctggctaatttcgtatttttagtagacagggtttcaccatgttggccaagctggtatcgaactcctgacctcaggtgatccacctgcctcagcctcccaaagtgctgggattacaggcatgagccaacgcacccggcctgggctgcttttttatgttactcatcataactgccattaaagcatgagttatagaaatatttttgttttgtcttatttttttgagacagagtctcactctgtcacccaggctgtagtgcagtggtgcaatcttggctcactgcaacctctgcctcctgggttcaagtgattgttctgcctcagcctcccaagtagctgggattacaggcgcccaccagcacgcccagttaatttttgtatttttactagagatggggttttgccatattggccaggctgatctcgaattcccggcctcaagcaatccacccgcctcagcctcccaaagtgctgggattacaggtgtgagccactgtgcccggccagttatataaatctttattatagagccttgttccccacctcaaactccagtcccgggagagcaagcctcatctctgttgttcacagctgtattttcagttcccagctcagtgtgagtcacacagtgggcactcttcaaagacttgctaagtggagaatttctatgtccagtcattcctggatcacttcttcactccctcacgcagtcacaaagggagggctgcatgtggaatttagcattcaacaggctggaagaggtccactgtgaccccagggttaaggcagatgtgaggctgccagagaaccaggttggtgtcacagaagcacgtgaaaggtctcacccttgtcatgccttcgtcaccctggattccattccttgtgtaggagcttacaaggcctgtgactttgggcaagttgctcaacttctctttgcctcggtttctttagccataggatggggttagtaaatgttcatttcattgattctagtctcacttttttttttcactctaatacttccaaaatcgagatgtctcttacatgtcttaatttaactggaagtggtattttccttggtgagagaataatagagagcaatttatccatagaattttttttaaagacagggtcttgctctgttgcccaggctagagtgcagtggcaccaacatggctcactgcagcctcaacctcctgtactcaattaatcctccctcctcagcctccccagtagctagctgggaccacaggcgcaccacaaccatgcctggctaattttttctttttttttccccccgaaatggattttgctcttgttgcccagactggaatgcaatggcttgatctgggctcactgcaacctctgcctcctgggtttaagtgattctctttcctcagcgtcccaagtagctgggattacaggcgcctgccaccatgcccggctaatttttgtatttttggtagagacagggtttcaccatgttggccaggctggtctccacctcctgaccttaggtgatctgtccacctcggcctcccaaagtgctgggattataggcgtgaggcaccgcacccggccccctggctaattttttaaagtattttgtagagcttgggtcttactatgtcgcccgggctggtttcgaactcctgggatcaagcaatcctcccacctcagcctccagagtggcgggattacaggcagaggccactgcacctggcctggcattagagggaatgaatatggtagtgcctgcttggtaccattcatggctgtgagcaccccgggaaaggataaggctgttcatttagcacagtgcctgcaacatggtgagcactgggcagatgaccaccgttatctgtgttaatctggtgttttctcctaaggcaggaggatctctgcagtctaggagttcgaggttgccgtgagccatgattgcactacagcactccagcctgggtgacagagtgagaccctgtctcagaaaaaataaaaataaacattaaaaaaaacctttccccggaaagcaaagataaccagaagcaggtttatgtcttgttctttcaggaattccaatcaaaaaaaaaattatcttttccaatagttgtagcaaaggtcccagaattctaattggttctggttggcccaatttgatgtttttgattggtcaggtctgggtcttttgcccacccctagcaccaggaataaatcaggcccatctgagccacctgccttgggagtaggggaagggatcctcctagggaaataggggtgttattattcagagagatcattaacctgtggacagataagaactccagatatcaacgacacttccttaccactctttttctaggcatccacagcatatctgaagaaatattcagaagttaactaatctcagatgatttcagcaggagtaaagaagagaaacagactcagaaatgccattacaacagttaattatgtcaaatttatcaccctgattgatcacgcagcattaacctcaagaacgccaagccaagtttttttgacaaatgtgagccaaggtttccgaaaaactagcagatatgactgtgacttacaaaatggaaaaagtaaacgagaaacacaatttgatatgatttaataaaagatttgtttccaccacttctcctgggaacctcagcacattttctttccactgacagttattatctctacctttattgaacaaagacacccggaacacagctgctgaggatcagtaaagaaaatcattcttttattaataagactgttattagcaggaaaaaaaaatccatgtttgggagtttgcactgaagttacaggccattttgaagaaatatggctgactagtgccaacattatttcaggcaatttcatgatcaaatgtcttattaggttgtttaaaatttttatagagattgtaaatcagaactattttctatttgccctaaatatttagatgctacagggaaagcagatcaaattaaagggtactgtgcacatttttttactgggaactcccagggatataaatcatttcgcctgcagcatggaattcttcagtacacatgcttgtggaaacattccacgctccgccagcacgctcattaaagtgatgatttgggttgcaacaacagtgccaagtacttcctgtgttcaactggggaccatgtggcaagacccaaagcttccccagagatcctatgggaataagttttttgagccaccatattccattatttcagcctaaaataacaccatgggacaagaatcagaagacagaggagcagacaaatgtgtgtagacatgctggaaggaatctttctttttagaaacagggtcaatatctattaaactttaagatgtgtatctcttgacctggcagtttctgtatttgagttttaacctactgatatacccatgcatgtgaataaagtatcttcctgcatgtaacaggatatttaatgtaaccttgattatagttgcaaatgctgggaaacgatccaaatgtctttcaatatggcactgattaaataaattatggcacagtctcacaatgaaaaacaaatgtagccattaaacagaatgaaatgggtctagctaaattgaaataggactacctctaagatatgttgttaaaaagaaaaaaaagaaagtgcagaggaacaagtatgataccattttgtattttttaacatatgcaagcgtgattgtgcccacacagaatacctttgaaaataaactcagtatttgcctcagtggataaaaacaagaaccagccttattttcactgttatatcttttggtgccactttttgaactttttaccatatgtgcatatgtaactttctaaataaattttgtaaaaaagagaaatatggctcgttgcaataaatctaacaagataaaagatttgttgaagaaaataataaaactattcagacatgagcgttcttgaaaaatggagaaatacattatttccttgtatggtaaggaatggtaagtaagctgggtggtatggtaagctggatattgttcccgactcttcattccctctcttaacagaattatacatccttgcacctttgcaatcttcccactgtgagtggaacatacatcctgacccactgatatcagtcttgctaatgccaatagtgttagtaaatgtgatgcaagtcaaagctttatatgtgcctctgtggtctggtttggccccttgcacttctgccatccaccctgagaagtacaaatctttgggatccattggtcccagaataaaaagatacatagtgcagacccagaccaacccacagcctggagtcaagccgagccaacagagcccagcagaatcacagcctatgcacagacctgtgaaagaaaaaatatttttttgttgtaagcaagatttggggggatgcttgttatgcaaccttgttgtagcaatatctgacagatacatatgggaaaactacattatttcctttggctctattccacctccactaggaaaatattcctgattaacctcattccacaccagattgtgatctcttcaatgacaggaagtgtgtgttattcatccctgtgttcctagacttctgcacagggcctaacagaatttctagaaaacaaaaaattctgactactgtgcctaaagtagccatctctgcccaacagttaatctctgccacatcacagagtttatttagttcagaccatgcataacaatcaataatcatctttctattttgctatgtttccctcatacacagtgtaaacttcctagaagaaatgaatcaatgagtgggggaaaaatgaatatatgactttcttactctgatttgcataagtactcatacatttttgtctaccaccctcgccaaacttctcaggctgcctttcaaaagctggtcccaaatggttcccaatttgatcacccactgctccccttaggcatatgtagttattcaccattgcccacccattacccacactttttctttctctgcaacattagtgttatattccctatgtcatggatgctcttctttaccatccctgcttgtttaaatcctgaccatctgtattcttttgcaataggttcagctatgagtaactgcaaaactcaaaacaatgacctaagcaaaagtttattaatttctgttgtttagtaaatttagaagtaccagaatagaactggaaaggtaatcagtggttttagaggaacaagacactcccagcttattgctctgccaggagtgtcttccattcctaaacttacttcatgatccaagatggctgctggagctccagctattacatacccattccaggcaacataaaggaaaaaaagtggaagaagagcataccttctccctggaaggaaattccccagaaattacacacaccgtttttgtatgtagaaacttagtcacatggatacactcagctgcataggaaactgtactagctagttttgctaaatcacaaaccactattcggcagctttaaacaataagcattcatttagcacatgattctgcaggctggcaatgtgcgctgggtctatctgggcaaatgtagtgctcttgattgggcccatctcaggtaccagcagttagctgcctggttggtcgggtgctgactggtccttacctgggctgtctcctctccatgtggcatcccatcctcccaaaggctagctggggctggttcacatggtggttgggcaggattccaagagattgagtggaagtgtgcaagttatcttgagatataggctcggaactggcacactgtcacctccatcacactgtattagccaaagcaagtcacaagactggcctggattcaagggtggggaaatagactctaataggagaagctacaatgtcacattgcaaaggggtgtgcctatagagaggagaataattgtggccatttttgcaatcactatttcacagaactctagtcttaattctgagggacagcttgcattttctgtgacaccaacttttaaagcccagttcaaaatgaactttctcctccaggaagccttccttgactattgagctagaattctgaccaccaaatatttttacccatttgttctgtggcctttgcatagctacacatggagagacactgtcccatcagtgatggttcgggatgacagaaggtgagcccttcgccatcctcagaagccaccaagaacttagaccccatcttcaccaagatactaacatttctgttgaaacaagtgcccttatgatttaaaagtaatagaccccttgtttcaatggcaagagtatgaaattgttacttttgctttcagcaagcccacaagaggcacgaagaatccacgtgacccaaaagtaagaggtcaaatactgagatctggaaggaatcccttagcatccggagcctgaatagatatatacattcttcatcagagaagatgtcggaactagtccatgtgtacattggcatttttctttctccctttgtaatttttcctcctctcggtatgactgaaatataaatcagtagcctagagtccttctggttaacaaggttctcatttgggaggttgcagcctaggaggctattaaaaacagaaagaaaggcttcttctataaacatttcctgccagctgctgataactggggaggagggagagcacaggggtgacagcacaaaacaggacaattaggggaagaaatctgcaaaagaggaagaattcttggtccacgtccctggcagaaggatccatgaatagaagtccaaagtgcaaaagaaaacctctgggaagaaaggaggaggggcaggagagccttccactgatccaaacaggccagtgccatcggaagggagacaggaggacaaaatccctgcctgcagatgcttccaaatgtttaagacaaaataccaggacattaaaagttggaggaggggtggtcttggcatcttccctcaactcctacaagaataagagtttgcatttgttgagtgatcactgtgtgctggcccacattaatcatttttttaattttttaaaagttgtatatatttaggggatataggtgcagatttcttaaccgcatacatttcattatgatgagatctaggtttctactgtatccatcacccaaacagcgaacattgtacccaagaggtaatttttcaaccctcactcccctcctaccttcccaccttttgtagtctccagtgtctgttattttactctgtatgtctgtgtgtacccattgtttagctcccacttataaatgagcacatgcggtatttgacttcctgtttctgagttatttcacataggataatggccttcagttctatccatgttgctgcaaaagacatggtttcatttttatatgcattaattatctcaattaaggccataaggttggagctattattaaccccatcttcaccatgagcctggtgatgctcacaattttcccaaagccccttggttaataagtggaagaggtagagttcaaatcagtttctctgactgcataggccagactcctggacctctgcaccatcctggtctttgacaccatgatagagtaaaagaggagatgtttcagaacctaccatagaatcatctatcttcaagattacccatgggatgagactgttaatggacacagtgtctcattgaagagctcctgaactttgtgaagacagttgagtgtttacaaataagaatgaagcaacaacaacaataataaattgagtcattgtgttgtgttaggtactgtgctaactgtctagattctctcacttaatgcactgatgtaagaattattgtccccatttcacagatgagaaaatagaagctcagagaaggtaagtcacatggccaggatctcacagtcaaggagtagcagagttagaactcaaacccaggtgtgagaccaaagagcaggctctttgtttattgttctgaggtgcctccttaagtgggcaacttggtcactcattgcttcattcacccttcagatatagactactactcactgtgtttggaaaattttttaatttctaaaattgaggtgggggactagaaagaaacccattgcatttttgtttgactgagggacacaaaccttttatttgtaaaaaaatgtaataactgcaaagcacaataaagccaagtgcaataaaatgagatatacctgtaatcggtttttttataagctaatttcagaagtgacagcccatcaggacagccatattgcattcactacaagtgagtcagtaagtccagcccatgctaaggggagggtattacacaaaggcatgaataccaggagacagggatcactggggtccctcatagaggctgcctgccacattgtacctttcataagatcacaaatacctttcagtcatcctatcacctaatctcttaacatgcaacctgctttctcaatgaaaatcatggtgtaaattgagttctccatcattctcaagactatgaaatcaaggtagagccctggttttcaagctttttgatgacaaagatttcttcaaataaaatcttcctcaaggtgaatggacatactcattgttttgtactataaaacagaatacttctcaaggtgagaaaatagaaaaacatgactgatacacacaataaatagcacagatgaataaccaaagcattattctaagcaaaagaagccaggagcacatactgtatgatttcattcatatgaaactcctagaaagaaaaatctaatgtattgggatagaaagtagttcagtgggccaggcctggtgactcatgcctgtaatcccagaactttgggaggttgagccgggtggattgcttgaccccaggagttcgagaccagcctggacaacatggagaaaccccatctctttgaaaaatacaacaaattagccaggcatggtggtatgtgcctgtagtcccagctgctcaggaggctgaggtgggagaattgcttgagcccaggaggcagaggctgcagtgagcaaagaccatgccactgcactctagtctgggtaactgacagacacctcagggaggggaaggggaagaaggagaggaaggggaaggggaggttaagttcagtggttgcctggagttggggtcgagattaaggattaactgggaagaggagcaaggagccccacccaactcttacttaatccccactgttggaggtggggcctcctgggaggtattgggatcatgggggcggatctctcatgaatggtttagcactatccctttggtgctgttcttgtgatagtgagtgagtttacacgacacatgatcatttacaagtatgtggcacctccccacctactgatatgcctcctcccccttgccttccaccatgattacaagcttgaggcctccctagaagctgatgctggagctatgcttccagtacagcctgcagaaccgtaagccaaataaacctcttctcttataaattacccagtctcagctatttcattacagcaatgcaagaacagcctaatacatcatcacgaaagcttctttgcctaagacttgcagagatagatatgtcctatcaggccctcctcagcccaacctctaacacccacagaaaaccctgaaaagtgagaacccagtgaacatcctgaacatcctctgatggctgtgaaaagttagtgcacttctgctgttattgacacctgataactcattaaaaccagactaatcatcaacaagcagcaggtttctttcacactcaaagcataccagctccattctgaaatgatggctaaattaactgcagagaagcagccaataacctcctcctctcaccctgttcactctttgggctaataagtgtcttcttcatcagctgccttggataaaaaacaaatgactgggttatacattttcttgtacttgatacataagcctttctgcagaatatgataacaacgtaaataataaagatggccattgcttattgaatcatttactgtgtgttgtgtcttttgtacagcatataacactatatgctgtggcctctatatatgctagagttataaccctcaccctgagccgatttaactttatcaatatgaaaatggatacaaagaatgtaatctagtcacccaatgtcatgcagctaatgtggtgtctcaggtccctctattccaagccccaggtttagagtgagactaactggacctgaccgtcaggaaaaattaataaacaaataaggacttccctgctgagataccccaggataatttgtacaagtctccaaagcctagcacactgctggcacatagtaggtgctcaataaaatcttgtgatacgagaaaactggaactcctcatgcactgttttgtcggttacaaaatgtgaccccggacagagcatcatgatttgattagagtaagcggacttgttttcaactccacaggtagtcaaatggggagagtgggcatcagaaaatacataggtatatataagataatccatctttcaaaggaggctgaatggcagctcaaaggcatagagagaacctagggcaaggttatccaacctgtggcccaagacagctttgaatggggctcaacataaattcatcaactttcttagctcatcagctgtcgtcggtgttagcgtattctatgtgtggcccaagacaattcttcttcttccaatgtggcccaggaaagccaaaagactggacacctctgacctgggaaaaaagtacattttctccccagtgtcagaaagggatgtcataacaaaatattctaaaatcagaaaggaccaaaaaaaattgggtaactatccaaaatgaaataaattcatgaaattatgaaatattagtcatggtttgatttattctgcagctatataacatcactccatcaacaacacagaaacaaaaaattctctcaaaaatgaataatggatatgttcaatcaatcatggcataaccagggaatggaatgctttgaagctattaaaaaagtgtaattggccaggcgcaatggctcacgcctataatcccagcaacgtgggaggctgaggcacgtggatcacttgtgcctaggagttcgagaccagcctggccaacatggcaaaactctgtctctactaaaaatacaaaaagttagcgggcatggtggtacatgcctatggtctcagctactcaggagactgaaacgggaagatcacttgaacctgagaggcggaggttgcagtcagcgagattgcaccaccgcactccagcctgggcaacagagcaagaccttgtctaaaaaaaaaaaaagaaaaaaattaagtaaacaatgtaatcaacacatatttaaggagttttaataactaaatgaataaagtcagtaacaaaacagaagatgaagtataataccactttgcataagtataaactgataagaaaaataatctggaaggatgcggaatagagaaatgtacagttttttctagatggtcagcttatgggtgattttttaaattttaattggcatatctgtgttttgaatttttatatagtaaatgtgaattgattgctgaatttaaactaaataagggccgggcacagtggctcatgcctgtaatcctagcactttgggagaccgaggtggatggatctacaaggtcaagagatcaagaccatcctggccaacatggtgaaaacccatctctactaaaaatacaaaaattagccaggcgtggtggcgtgcacacgtagtcccagcttcttggaaggctgaggcaggataatcgctggaacccaggaggcagaggttgcagtgagtggagatcgcaccactgcactccaacctggcgaaagagtgagactccgtcttaaaaagaaaaaaaaaaaaaactaaataaaacccgttgtaatggtggtgtttaaacagagacctaaggagaagtcagtcagagcctaaaggggtcccaggaaaggaataaggaactggaaattcaaccaggcttggcaattagcaaaggatctgagacaatttaggtggaaattagaaacagctaaaaaatgaagaaggggctttttaagacctcacactactatggttcacaataatgcctctcaaaactctgtcataactatttttcaatatgtcaaagtaaatgtcatctctagttatctaaaaacatcttgatgcctgatacctactagaaaaaacagcccgagtttgtccacagttttcagttcctgtgtcatttcagttgcctggcgaggaacttttcttactatattggctctcaggtaactctctaactagaccattccatctccccaaaaactgtcatggaaaaagaacagtcttgaaagtcgagagaggcagcccagctctgctattcaggctgtgtgaccttgggcaagtctctccccatggtctcagtgggttgatctatggagcccaagcaataggattctctcccccaggaatttgaaacttggaatccgagattggaaagtgagacacattaatggtagaactcaagaaaggtaggggctgggggccgtggctcacacctctaatcccagaacttcgggaggccgaggtaggaggattgcttgaggccaagagctcaagaccagcttgggcaacagagcaagaccctgtctctacaaaaagcaaattaaaaattagccaggcatggtggcatagtggcattagctacttggaaggctgaggcagcaggattgcttgagcccaggaggtcaaggatacagagagctatgatggtgccactagattctggtctgggtgatggagtaaaaccgtgtctctaaaaaaatttttttaagagaggtagatcatgaattccatctgctgctaagcttccaaaactctattagtattttccttcctatgcaaactcctctctcattcagtgagagcacctgttatcctaacaatcacgaatttattttccttacattaatcagagtcagtttctattgcatggaaccaggcaacacttagctactgtggcttagatagaaggaagtccttcctgccagcatgaaaggaattggtcagtcaggcaaaggagtctgacccaaagggaaaagctgccacaaagagtgactttcatccttgggctaagaagcaggggcccaatggggcaacttgtcacattcaataaggattcttggtcagcccaaccatgctctccaagcatccaggcatgaatccccacagggcaaggcagcagagaggagcaacagtgagcatgatgggttatctattctcccagctccccacagcccactgactgcactcagctgagtgcaggcaccaacttcttgcatctgagtttttgcagctgctgttggaatctctctaacacagagcttctcaactgggaaccattttgctccccaaggagcatctgacaatgtctgtggacatttttggtgatcacaaattgggaatgggggctggaaagggtggctcatgcctgtaatcccagcactttgggaggccaaggcaggtggatcacttgaggtcaggagtttgagaccagcctggccaacatggcgaaattgcatctctacaaaaaatacaaaaattagtttggcagccaagatggccaaataggaacagctctggtctatagctcccagcatgagtgttgcagaagataggtgatttctgcatttccatctgaggtaccgggttcatctcactagggagtgccagacagtggatgcacgacagtgggtgcagcacaccgtgtgtgacccaaagcagggtgaggcattgcctcacacgggaagtgcaagggatcatggagttccctttcctagtcaaagaaaggggtgacacatggcacctggaaaatcgggtcactcccaccctaatactgcacttttccaatgggcttaaaaaacggcgcaccaggagattatatcccacacatggctcggagggtcctacgcccacagagtctcgctgattgctagcacagcagtctgagatcaaactgcaaggcagcagtgaggctgggggaggggcacccaccattgtccaggcttgcttaggtaaacaaagcagctgggaagctccaactgggtggagcccaccacagctcaaggaggcctgcctgcctctctaggctccacctctgggggcagggcacagacaaacaaaaagacagcagtaacctctgcagacttaaatgcccctgtctgacagctttgaagagagcagtggttctcccagcacgcagctggagatctgagaatgggcagactgcctcctcaagtaggtccctgacccctgacccccgagcaccctaactgggaggcaccccccaatagggccagactgacacctcacacagccaggtactcctctgagacaaaacttccagaggaacaatcagacagcagcattcgcagttcacgaaaatccgctgttctgcagccaccgctgctgatacccaggcaaacagggtctggagtggacctctagcaaactccaacagacctgcagctgagggtcctgtctgttagaaggaaagctaacaaacagaaaggacatccacaccaaaaacccatctgtacatcaccatcatcaaagaccaaaagtagataaaatcacaaagatggggaaaaaacagagcagaaaaactggaaactctaaaaacagagtgcctctcctcctccaaaggaatgcagttcctcaccagcaacagaacaaagcttgacggagaatgactttgacgagttgagagaagaaggcttcagacgatcaaactactccgagctacaggaggaaattcaaagcaaaggcaaaaaagttaaacactttgaaaaaaatttagacgaatgtataactagaatcaccaatagagagaagtgcttaaaggagctgatggagctgaaagccaaggctcgagaactacgtgaagaatgcagaagcctcaggagccaatgcgatcgactggaagaaagggtatcagtgatggaagatgaaatgaatgaaatgaagcgagaagggaagtttagagaaaaaggaataaaaagaaacgaacaaagcctccaagaaatatgggactatgtgaaaagaccaaatctacatctgattggtgtacctgaaagtgacagggagaatggaactaagttggaaaacactctgcaggatattatccaggagaacttccccaatctagcaaggcaggccaacattcagattcaggaaatacagagaatgccacaaagatactcctcgagaagagcaactccaagacacataattgttagatacaccaaagttgaaatgaaggaaaaaatgttaagggcagccagagagaaaggtcgagttacccacaaagggaagcccatcagactaacagctgatctcttggcagaaactctacaagccagaagagagtgggggccaatattcaacattcttaaagaaaagaattttcaacccagaatttcatatccagacaaactacgcttcataagtgaaggagaaataaaatactttacagacaagcaaatgctgagagattttgtcaccaccaggcctgccctaaaagagctcctgaagcactaaacatggaaaggaataaccggtaccagccactgcaaaatcatgccaaactgtaaagaccatcgaggctaggaagaaactgcatcaactaatgagcaaaataaccagctaacatcataatgataggatcaaattcacacataacaatattaactttaaatgtaaatgcactaaatgctacaagtaaaagacacagactggcaaattggataaagagtcaagacccatcagtgtgctgtattcaggaaaccatctcacatgcagagacacacataggctcaaaataaaaggacggaggaagatctaacaagcaaacggaaaacaaaaaaaggcaggggttgcaatcctagtctctgataaaacagactttaaaccaacaaagatcaaaagagacaaagaaggccattacataatggtcaagggatcaattcaacaagaacagctaactatcctaaatatatatgcacccaatacaggagcacccagattcataaagcaagtcctgagtgatctacaaagagacttagactcccacacaataataatgggagactttaacacccactgtcaacattagacagatcaacgagacagaaagtcaacaaggatacccaggaattgaactcagctctgcaccaagcggacctaatagacatctacagaactctccaccccaaatcaacagaatatacatttttttcagcaccacaccacacctattccaaaattgaccacatagttggaagtaaagctctcctcagcaaatgtaaaagaacagaaattataacaaactgtctctcagaccacagtgcaatcaaactagaactgaagattaagaaactcactcaaaatcgctcaactacatggaaactgaacaacctgctcctgaatgactactgggtacataacaaaatgaaggcagaaataaagatgttctttgaaaccaacgagaacaaagacaccacataccagaatctctgggacacattcaaagcagtgtgtagagggaaatttatagcactaaatgcccacaagagaaagcaggaaagatccaaaattgacaccctaacatcacaattaaaagaactagaaaagcaagagcaaacacattcaaaagctagcagaagacaagaaataactaaaatcagagcagaactgaaggaaatagagacacaaaaaacccttcaaaaaattaatgaatccaggagctggttttttgaaaggatcaacaaaattgatagaccactagcaagactaataaagaagaaaagagagaagaatcaaatagatgcaataaaaaatgataaagggaatatcaccaccgatcccacagaaatacaaactaccatcagagaacactacaaacacctctacacaaataaactagaaaatctagaagaaatggataaattcctcgacacatacaccctccaaagactaaaccaggaagaagttgaatatctgaatagaccaataacaggctctgaaattgtggcaataatcaataccttaccaaccaaaaagagtccaggaccagagggattcacagccgaattctaccagaggtacaaggaggaactggtaccattccttctgaaactattccaatcaatagaaaaagagggaatcctccctaactcattttatgaggccagcatcatcctgataccaaaacctggcagagacacaaccaaaaaagagaattttagaccaatatccttgatgaacattgatgcaaaaattctcaataaaatactggcaaacagaatccagcagcacatcaaaaagcttatccaccatgatcaagtgggcttcatccctgggatgcaaggctggttcaatatacgcaaatcaataaatggaatccagcatataaacagaaccaaagacaaaaaccacatgattatctcaacagatgcagaaaaagcctttgacaaaattcaacaacccttcatgctaaaaactctcaataaattaggtattgatgggacgtatctcaaagtaataagagctatctatgacaaacccacagccagtatcatactgaatggtcaaaaactggaagcattccctttgaaaacgggcacaagacagggatgccctctctcaccactcctattcaacataatgttggaagttctggccagggcaattaggcaggagaaggaaataaagggtattcaattaggaaaagaggaagtcaaattgtctctgtttgcagacgacatgattgtgtatctagaaaaccccattgtctcagcccaaaatctccttaagctgataagcaacttcagcaaagtctcgggatacaaaatcaatgtacaaaaatcacaagcattcttatacaccaataacagacaaacagagagccaaatcatgagtgaactcccattcacaattgcttcaaagagaataaaatacctaggaatccaacttacaagggacgtgaaggacctcttcaaggagaactacaaaccactgctcaatgaaataaaagaggatacaaagaaatggaagaacattccatgctcatgggtaggaagaatcaatatcgtgaaaatggccatactgcccaaggtaatttgtagattcaatgccatacccatcaagctaccaatgactttcttcacagaattggaaaaaactactttaaagttcatatggaaccaaaaaagagcccgcattgccaagtcaatcctaagccaaaacaaagctggaggcatcatgctacctgacttcaaactatactacaaggctacagtaaccaaaacagcatggtactgggaccaaaacagagatatagatcaatggaacagaacagagccctcagaaataatgccgcatatctacaaccatctgatctttgacaaacctgagaaaaacaagcaatggggaaaggattccctatttaatacatggtgctgggaaaactggctagccatatgtagaaagctgaaactggatcccttccttacaccttatacaaaaattaattcaagatggattaaagacttcaacgttagacctaaaaccataaaaaccctagaaggaaacctaggcattaccattcaggacataggcatgggaaaggacttcatgtctaaaacaccaaaagcaatggcaacaaaagccaaaattgacaaatgggatctaattaaactaaagagcttctgcacagcaaaagaaactaccatcagaatgaacaggcaacctacaacatgggagaaaatttttgcaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaaaacacatgaaaaaatgctcaccatcactggccatcagagaaatgcaaatcaaaaccacaatgagataccatctcacaccagttagaatggcaatcattgaaaagtcaggaaacaacaggtgctggagaggatgtggagaaataggaacacttttaactgttggtgggactgtaaactagttcaaccattgtggaagtcagtgtggcgattcctcagggatctagaactagaaataccatttgacccagccatcccattactgggtatatacccaaaggactataaatcatgctgttataaagacacatgcacacgtatgtttattgcggcactattcacaatagcaaagacttggaaccaacccaaatgtccaataatgatagactggattaagaaaatgtggcacatatacaccatggaatactatgcagccataaaaaatgatgagttcatgtcctttgtagggacatggatgaaattggaaatcatcattctcagtaaactatcgcaagaacaaaaaaccaaacaccacatattctcacttacaggtgggaattgaacaataagaacatatggacacaggaaggggaacatcacactctggggactgttgtggggtggggggaggggggagggatagcattaggagatatacctaatgctaaatgacgagttaatgggtgcagcacaccagcatggcacatgtatacatatgtaactaacctgcacattgtgcacatgtaccctaaaacttaaagtataataataataaaataaaaaataaaaattaaaaaaaatacaaaaattagccaggagtggtggtgggcacctgtaatcccagctacttgggagattgaggcaggagaattgcttgaactcgggaagcagaagttgcaatgggccgagaccacgccactgcactccagcctgggtgacagagggagactccatctcaaaaaaaaaaaaaaagaaaagaaaagaaaaaaagggggggtggggggaatgcggtgttactggcatccagtaggtagagaccaggtgtaaccatttcttattgtaactgtaaaaacttgccatgaatttagtggtttcatttttatttttttattttgagacagggtcttgccctgtcacccaggctgtagtgcagtggcaccatcatagctcactgtagccatgacctcctaggctcaggccatcctcccatcttagcctcctgagttgctacaactacagggcatgccaccatacccagctaattgttattttttggagagatggggcccaggctagtctctaactcctaggctcatgcaatactcctgcctcagcctcccaaagcactgggatcacaggcatgagccaccacacccagccaattaagtggttttaaacaactcaaatttgttcttataattctagaggtcagaagacaaaaatgagtccacagggctgcatgtcttctggaggctctaggggagaatctattccccacctttcccagcttctagaggttgcctgcattccttggctcatggctccttcctccatcttcaaagcaacagggtaacatcttctcttcccactcttattctatcatcatgtcacatcatcttctaaggacccttgcaattacctgagtctcacctgaataactcagaataatctcctcatctcaagatttttcattccaatcacatctgcgagagttttctcttgctttgttttcgtttggattttgccatcttaatgtaatgtattcacagattctaggagttgagatatgaacatctttgaggagagggggcattgttctgtctaccacaccaggtagacatcctgcagcccgcacaacaaaggatcatccagcttaaaatgtcaggagtacagaggttgagaagcctgcatgctctgatactaccagatttcccacagaccctaattcaatgccactgcttaatgtgcatgacaactgcagaccccctattccttgataccatccatccaaaacactccctacaatgttttttaaatatgtgtgagtgttattgagtccaagtaagtgacagaaatcctgtttccctaaaaagtttgataacaggaaaaaacagtcatttattaggcttgacatgattcttgtgacttctaagtttggggcttcaggtgtttgaaagttactcagaagccaggcacggtggctcacacctgtaatcccagcactttgggaggccaaggtgggcggatcacttgaggtcaggagttcgataccagcctgaccaacatgttgaaaccctgtctctactcaaaaaatacaaaaatcagctgggagtggtggtgcacgcctgtagtcccagctactagggaggctgaggcaggagactagcttgaacctgggaggcggagcttgcagtgagcctagaccatgccactgcactccagcctgggcaacagagcaagactctgtctcaaaaaaaaaaaaaaattttttttactcagaagggaaaaaatgaactcctcaaactttgggacagaaaatgggaagtaaaagcagagaaaagctatcaccaacccggtgcctcatacctgcccattttctgcttccacttcctgggagtaaaagtctttaggaagggaaggtgaattagtattgattatacatgcaccaaaagacaaacaccaggctgtatgccttacgtatgtgactcttccaggttggtgtcatcattcccacgttaacataagtggtaaagtgaatggagacaccaaagaggtgtaatataacttctttaatgaaataaaccaggaggcagcaaacgttttctgtaaaccatcagttagtaaatatttgaggctcttttgaccatgtgggctctgttgcaatcacttaactctgcccttgtagggccaaagcaatcattgatgctatgtaaatgaacgggtgtatgaggctgttccaataaaactttatttacaaaaataggcagagaccagatttggccctggagctatagtttgctgccccctgaaatacatttttttaattcccaaaatagccttcatcagcaaatatttcccaagcacctactatatgtcgatatacaactgaacagcccagaaactacaaagatgaataaagaagccaataaaagtccaggtgcagtggctcactcctgtaatcccagcactttgggagaccaaggcagtggatcacctgaggtcaggagttcgagaccagcctgtccaatgcagtgaaaccccatctctactaaaattacaaaaatcagccaggcatggtggcgggtgcctgtaatcccagctactcaggaggctgaggcaggagaatcgcttgaacccaggagacagaagtcgcagtgagcctagatcacaccgctgcactccagccggggtgacagagcaagactccatctcaattaaaaaaaaaaaaaagccaattaaaaataaaacagttcaaatgccaccacccagaaataaccactataaacatttggtatttatcatgaatgatttttttaaactctatgaacatatattttcaagacaaaaataagatgattgcatacataatttttatgacctaatttcaaaataaatccaagactgctttctctgtcaccaactgtaaatgtagatttaacatttaatatttcatgactatgcaacgatttgcatgtagcaggatttgctgagtgacctccctattgatagacagtgagactgtctcctttttatcaccaatagcatttacccagtttcctcctccgcccccttctcctcccactcccaacctcccgccctctttctggcataccttacattgctcgtgggaatataagtcagcacaatcttcctaaaaacagtttaacaatgtgacccagaaattctaggtctaagacaagagggcaaagatagagatgtaaagatgttcttggtagcattgcttagaatggtggaagagggaggatagtctcactgtccatccacaaggagtcatttcacaaaccctgctacatgtaaatcattgccatagttaaatgttaaatctacatttacagttagtaacagagaaagaagtcttggatatattttgaaatcaggtcagaaaaattatgtgtacaataatcttatttttatcttaaaaatatgtgcttatggagttttttattaaaaaaattcatgataataccaagtgtttatggtggttacttctgggtagtggaatttgaacttttactggcttcttagtctttgtagcttctgtgctgttcagttctacactgacacataggaggtgctggggaaatatttgccgataaggtgaacacaacactccagcatcaggggtttcatgtggctataaggaaggtatttctaccatgatgcttggcaaacacaggaaaggatcattaaagtcgcatctggaatccccttttctgaaggtgtttttttaaagaatagaattatcttatgatcttgaaatgacaaaggtttttcttagtatgtcacaaacccgggagacccccccgcaaaaaaaaatttgattacatagaagttttttaaaaaacagagctgcggaaccaaaaccaccctaagcaaagtcaaaatacaaaagaaaacccaggaaataatgtttgtgaagcaaggcgtggaaaatggctaattcccctaatgtataaaatcaataagcaaaagagcagattcatagaaaaatggacaaaagataagaacagtttgtaagaaaagaaacacaagtgattcttgggcaaatgaaaacatgctctgtgttattcagagtaagataaatgcaaattaaaactatgctgagatatcaattttcacctatcagattggcaaaattaaaaagaactcaataatacatggtgcttgatgccactatgggaactcaaacattccttgagggatgggtgtaaattttttacaacctctatggagaaaagtgtgtcatttgacccaactattacacttttagaaatttatcccacagacatttgcacaggagcaaattgcaccggtatcagattatcgattatagtttttttaaataatagcagaagagtagaaataacccaaacatccatcagtaggaggttgcttaaacaaattatagggtactacatggtgtactctgccactcagaaaagaaaataagaaagttaactgtgtactcataaggaaggatctccaagatatgtatttaagagaaaggtgaaaaaagcaaataacggagaagcatttttcatattaaaaaataaaaggagatgatatgtgaatatcatatatatactatatatagtgtggatatgtatatacataaactatacacactatatatacacatatacatatacacactatatatagtatatatgtgtgtatatatacacatatacatatacacactatatgtagtatatatatacacatatacatatacacactatatgtagtatatatatacacatatacacactatatatagtatatatacatatacacactatatatagtgtatatatgtatatacaccatacacacatacattttgcttatgtatgcacaggatatttctagaagaataccaaagaaattggttcatttgttgcttcagggatagaggtagggggaaggtggtaaatggaaaaagggagacatttcactgtttatccttttgtattttttggaatttggaccatgcaaaagtattacctattcaaaacattaatgggtcaggcatggtggctcacacttgtaatcccagcactttgggaggctgaggcaggcagatcacttgaggccaggagtttgagaaaccctatctctattaagaatacaaaattattggggcatggtggtgcatacctgtaatcccagctactcaggaggctgaagtacgagaattgcttgaacctgggaggcagaggttgcagtgagctgagactgtgccactgcattccagcctgggcaacagactgagactctgtctcgaagagggaaaacaacaaaaaaaaaaccattaacagaggatccttcctacttcagagcttcctatacactgtttccactgctggaggtgttctgatgttgactgacttacacacacacacacactcctcctggaagtattttatctttcagatctctgttcaaatgttacttcctccaggaagtcttacctatcacctccacctcctccgcagaaagggagctgttatacccattcatggtaccttgtgagatttatcacaatgggtatcaattaataattaacatctgtcttccttgctggaggtaccagagggactagtctgccaatgaaccccaggcaccaagtccagcatatgccacataagacacgcatctcagagactttcttctgttggaagggagggaagaaaataggaagaaataaccacagttacactcctagcatgagccagacagtggtctatgcgctttatgcagattagcacattaaattctcacaagagagttgtgattcttgcacagatgaaaaaaacaggctcagagagaccaagcaacctgcccaagatccccaggcagaggcatgattcaaaccaggcaggctggttccagagcctatgctcttggctcctagaagggaaaacagaagaaagggaagaagaggagagagggaagaagagaggaggttgctcacaatatcaggaggatgcatttttctgctgtctccagttcagtatctcacaagaccagcaagccttccagtctgggaagttataagaacatcattgtattactccattttcatactgctgtaaagaactgcctgagaccgtgtaatttataaaggaaagaggtttaactgacttacagttcagcatggctggggaggcctcaggaaacttacaattgtggcagaaagtgaagaggaaaacaatgcatcttcttcacaaggcagcaggaaggagaaatgccaagcaaagagggaagcgttccttataaaaccatcagatctcgtgagaacgcactgtcatgaaaacagcgtgggggaaactgcccccatgatttaattatctccacctggtctctcccttgacatgtggggattatagggaatgtaattcaagatgagatttgggtggggacacaaagcctaatcatatcaaccattaatggggattctgtaatgtatatgaaacacttgcagactgacactactggacctcaacaaagagacagcagacttgaagtatgacagctgtcttatctagaggagcaggtaacatgcattgtagataaatacactatctgatgtgggttaataggcttcattgaattaatgatgacagaataattacagcgacaagcaacagcagcagggactctaattgaggataattcaagcacacggcaagatcggaagttttgactttaggactatggaaacttccctgagattggagatttattatttctattattttaaatcaacaatatccaccactggcaaggtgcagtgtctcacacctataatcccagcacgttgggaggctgaggtgggcagatcacttgaagtcaggagttcaagacgagcctagtctgtttagtaaagatggttaaaccttgtctctactaaaaatacaaaaattagctgggtgtggtggcatctgcttgtaatcccagctactcgggaggctgagtcaggagaatcacttgaacctgggaggcggagtttgcagtgggctgagatcatgccactgcactccagcctgggtgactgagcaagactccatctcaaaaaacaaaaacaaaacagtatccatatctaccatagcatgtctgagctctctgcaagtcaatgggaagttatccacaggacaggatttccttacttttatttgttaataagagaaatggaagggaatgggaaatcagaaaagcagaggcataccaatttttgccatttctcctcacatagaatttgttcctcatcttaaaggcttggacaggatgctgaaaagtataagagaatggggattacattcaggtaatcacaacagcaataataatagttatcatttattgaacctttacctccaaacagcatctaaagtaagcactatttataccttagcccactgaattcccaaactaattttgtagagtgggaacaaatgtgtttgcccattttatgggtaagacaactgaggctctgagaagtaaagtgatttgcctaagctaggaaaatgcagaagttaagaaatgaaagcattagaataatacccaagaaggggtcatttctgaaggaggagatggattcatgaacaaacaagcaggcaggccaatatgtaatttgttgataagcatgaatatatttaattaaataaggatctactggatacctgtcacaagcccagtgcaaggtccttgtggcagatggtttttttccaaaggtggccatagtgatatctcccataccacatgctgtcataatgtgaccttttatttctcttgttgagtgatgaagtccatgatccctccccttttaaccttagaaactgcctcaatcattaagattacagcagaaaatatgctatttgatttccagggctagaacataaaaagcatatgcacttcctccttgttttcttgagctactcgctgttggaccccagctactatgttgtgaggaagtccagttagcccacctgaagagaccacctagggaggccacatgcagacgttttggctaactggctagctgaggtctcagctaacagtgagtatgaaatacaggcatgtgacagaagattcctctagatgcctttagtccccagccatcaagtcaccctcaacttttgagttttcccagctgggtccccagacatcatgaggcagagcaagccactctctctggtctgattcttgacctacaggatctgtgagtgtaataaaattgtggcttatagcactaaaaattggtgtgatttgttacccagtaatagcaactggaagagccctcatatatttttaatacaaaaaaaaagtgtgtgaaacaggacctgcccttctgtttaatttggaaaacaagacttctataacaatgttatttacaaaatgtatcttataatagccaaaaggtggaaataatccaaatgtctgtaaacagataaataaacaaaatggggtctatccatacaatggaaagttatttagccataaaaagaaatgaagtactgatatattctacgacagaaatgtagaaattagaaattagaaaacactgtgtttcgtgaaagaaccaagacacaaaaggccacatattgtatgactccatgtgtatcaaatactcagaatgggcaaatccacagagacagaaagtaaattagtggttgccagaggctgggggacaggagtgaaagagtggctgcttaatggtagaggtctggggttggagggtgatgaaaacatcctagaattagacagtggtgatagttgaaaaatcttgagaatacactaagaccactaaattatacacttttaaatggtgagttttataagacatgaattatatcccaatgtaaaaaaaagcaatgtgccatattaggaccttctgtgagggtggaaactcatcagctttggggtcaagtagatctgggttgttgtccagggactaccagtgcctaattgtatggacttgagcaagtttctcagtacccaagggctcagattatccatctgtgaaatgggaataataagactcactttgcaaggctgctgtcaggattaatgattgtctttatcaaagatggtaacagaaactcactcgagcagcataagccaaaataagcattttatgaaaggaatcagggacattttacagaagcccaggtcactaagaacaatttggccacataagaaacttgaaccaggaatttaaaatatatcaaaagccaaggttgatattctttctggcgtatatgtagtgaacagagaaatttctttcaaattattcattcgtggaaaatcaagatttggcattgcattttaaagttaatccattagagtcacttagttatttgcaaaataacattttggtaaaggagaatttatttgaatatcaaataagaaaaggttcaataccctacctggtagagctggaaaacagttaatgatcacaggcttggaacacaaaatcaacctcctgtaacaaatttagtttatgactttaaaaggaaaaatggacttttctacaataaacattcaaacaaacatggttcaaacaaacatggtttccaataataaatgtttttaaatctcaaggtcataataaatcagtcctgggactcttaaagcaaacttttttatagtataggaaagtgctttcctattttataatcaaaattagaaggaaactagactctatgttgacaagagacaaacttacacatagactttaagttaattctttagggtagttgccttaatagccattgaccttctttattagtctgaaggagtgattctcagctctagctacacattgaaatcactgagtacctttttaaaaataccaatgtcaccggccgggcccagtggctcacatctgcaatcccagcactttgggaggccaaggcgggtggatcacttgagcccaggaattcaagaccaacctgggcaacatagtgagactctgtctctccaaaaaattcaaaaaattagccaggcatggtggcacatgcttgtagtcccagctacttgggaggctgaggacaggtggttgtaagcttctatttctcatgttgagtgatgaagtctatgatcccttccacttgaaccttagcaactgcctcaatcattaagattaagattacagcagaaaagatgctatttgacttccagggctagagcataaaaaatcataggcatgtcctccttgctttctggagccactcactcttgcacaccagccaccatgtagtgaggaagtccaactagcccatgtgaagagaacacctggggaggccacatgcatacattttggctaactggctggctgaggtcccagctaacggtgagtattagaaggatcgcatgagcctgggaggtcgaggctgcagcgagccgtgttcgtgccactgcactccagcctgggcaacagagtgaccctgtctcaaaacataaaattaaattaaaaacaaataaaatactaatgtcctgatcccactcaaaaagtctgatttaatccgtatgaagtagggcctggcacgtttgacgaacaagcaaggaggcaggaatggctgcagcggagtaagcaatggcgagagggacgggagatgaggccattgaggctagggcaggtgtgtcctggcatgccaacgtgagggcttgggattttcatctaaagaaatggggagccatcacggggaccacttggctaaagtagcaaaaaaccaactcaaatcagtccaagaaaagtgggaagttattggcttttctaagtctagatagagctgatttaaagctcaacattatattatgtctctctctttctctcccccacttcaatgtccctctccctctccctctcaatgactttccatcttttggctcgttctccctatagacgagatttctcctcatggtataggagacagcccctggcagtccctgactcacttctttcagccccattattcaaaagccaagaccctgtctctcacagctctgtattaaagaacaaaaaacattctgaataggtgattggcttagctaaggtcacgtgcccatagctggaccaatccacatggccaggatattggggaactctgattggcctggtcacttgcccagtccttctacgggagtgagggagaaggcaggatgctgggactggaaattatcaggactgatgtgggtaaaagaaagtgaggccgggtgcagtggcttacgtctgtaatcccagcattttggaaggctgaggtgggtggattatctgaggtcaggggttcgagaccagcctgaccaacatggtgaaaccccatctctgctaaaaatacaaaattagctgggtgtggtagcacacacctgtagtcccagctacttgggaggctaaggcaggataatcgcttgaacccgggaggtggaggtttcagtaagccgagattgcgccactgcactccagcctgggcaacaagagtgaaactccgtctcaaaagaaaagaaaagaagagagagagggagagagagagagagagagagaaagaaagagagaaagaaagagaaagcgagaaagaaagagagagagagagagaaagaaagaaagaaagaaagaaagaaagaaagaaggaaagaaagaaagaaagagaaagaaaaagaatagaaaagagagaggagatgctcaacagtcaaaacaatccaggtttacggcatggtggtgtaaaattctactcttgctttgcccatttgattcacccatgtgtgtgatgggccgtagaggaatagtaacattttttttctttattcttatccctctactaactcgggcagaccagatagaacacttagagctccatagaaccttctcttcctctctcttctctcttcttttctcctttcttcactccttctctctctcaccccagtttattctcctgtctttgaatattgcctttctgagctaaaagaagaactaccatcaacccagcaatcccattactgggtgtatacccagacgaatataaagcattttaccataaagacacatacacgtgaatggtcactgcagcactgttcacgatagcaaagacatggaatcaacctaaatgcctgtcaatgacagactggataaagaaaatgtggtacatatacaccatggaatattatgcagccataaaaaagaacaagatcatggcttttgtgggaacatggatggagctggagcctatcatcctcagcaaactaacgcaggaacagaaaaccaaacaccacatgttcttacatataagtgggagctaaatgataagagcttacgaacagaaagaaggaaataacagacactggagtctacttgagtggggagggtgggaggaggaagaggagcagaaaagataactattggggactgagcttaatacctgggtgatgtaatgatatgtacaacaaacctctgtgacaaatctttatgtaacaaactttcacatgtatcctcaaacctaaaataaaaaaaaaatttaataataaaaaattaagaattaaaaaagatcacctttctctacttttctgcttttctttccaacaaacattcaaacaaatatggtttcctataacatttttttaacctcaaggttctaagtcaacagagcagaaagtggtcactcaaggacgcttgacatcacttcccagtctacatatccaaccctgaatgacaaatattggtgtccaatttcaaaattccaggagaaataatacaattgtcctggcttggttcagggaaccaaggtcccaaggtcttacggtccaccgtttttttcatcacaggtacaaaggcaaactctgataaactaagcagagaaacatatagttctattgaatcattggtagtcaatagcataccaactgctggccagataccaggctaaaagttttttcatgcttttttttttttttttttttttttgagacagagtcttgctctgtcgctcaggctagagtgcagtggcgcgatctcggctcactgcaatctccgcctcccaggttcaagcgattctcctgcctcagcctcctgagtagctgggattacaggcatgcaccaccacacctggctaatttttttatttttagtagagatggggtttaaccatgttggtcaggctggtctcaaactcctgacctcagataatccacccacctcggcctcccaaagtgctgggattacaggtgtgagccaccgcacccggcctcatgcattatttcattggtgcatcataattgccctataagttaggcactattattacccccattttacagatgagggagtcgaggctagggtggtcaagtgaacttgctcaaggtcacacaactaaaatgattttctgaataaagagcacttgttcttttttttaagagacagggtctcgctatgttgcccaggctggtctcgaactctcggactcaagcaatactcctgcctcggcttcccaaagtgctgggtttactggcgtgagccaccacgcctgacctcaagatcatttgttcttaaccaccatactctactgccacttaccacaccatggtgctgtgattatccccgcaaaagataggaggctaatgtaataaatgctctcaattgtgtgaacacactggactaccttactttacatgagaaaagtactggaaggagcaaatccaaagctagtgataaagaggaaagcagcccctgacagcagggaactggcctggtactgacaggtcaatctcggtgttttcctaaacataaacaatttcacagagcatcaatgttagacaaagccactctgtagtcatgatgaatcaggacagaaagaagactccgtaatcacacgtgaacacagacaaaacaggaacattgttcaagccacaaaatgccaaacatgaccttctcctggtgaatgcgagtaactagtgttcttcaccaatcatagttttagcctcgctctagtctgctttccctcccttccttatagataaaatttattgagagagtcaatggtaacattgcctctttcaggctgcacccatgccagtgcacatcccagcttgcttggactctccccaaaatcacacaaccaaagtccaattccataatgagtcctttccaacaccttccatggttccccatgtgtgtgtcctctcttgctgcaatgaacatgaaacacaacttgttcaatatgggtgtgttcctggaggtctttggctggagggcatcaatactgttcacttgtcaggggcctgttctgacagactcaagactgctctctctcccttgaccaaagagcttgaaaaccagtccttggtcctagaaggcagcgcaatgcaaacagaattccagtaaccagagacatccactaaacctcccctccacacatacacacataaggaaagtagagagggccatttctgcatcttgctctacagcagagtgaccccaacaccatagaatggatggaacccagtgagatgcacccaaggtgccacaccgcgttcctgcttgaagttgctccaattctttcccaaccccaaagttcttctctgtcactctgagctatacaattgtaggcccataacagttggacagctgagaaaaaaactcaaggctcaatttcatgcttcctgtaagactgtggtgaagttcaagttttccataaatgtaacaaaccttcacagattgaaaaggaaatggtttcccttatcctcttgtcctcaatctagttgcatgggactgactcagcatctcacgggggtgaaaatcaaggatcagtgtttcttaaagcacccccgagtgactctcctgtgcagccagggttgagaatcactactctagtcattcaactgatcgttgctgggcacgcactgggttccatgaactgtgttgtatgctggagacgctctggcaaataacacagatgcaattcctgtccttgagactctacactctagggggagagaaaagcaacaaataaacaaagaaacgtctaattatacattgtggtaagtgcaataaagaaaatttacagtgtgttagggtagagaacaacaggcagaactctttaggtaagaaaggaattaaaagcttcactaaaggggtgaaatgaggctgagagtggaggaataagagggaatgagcattgaggaagggaagtaagactgttctagaggctggttgtggtggctcatgcctgtaatcccagcactttgggaagccaaggtaggaggatctcctgagcccaggaatttgagaccagcccgagcaacatagcaagaccctgtctctacaaaaaaagttagctgggaggccgaggcaggtggatcacgaggtcaggagatggataccatcctggctaatatggtgaaacccatctctactaaaaatacaaaaaattagccaggcgtagtggcacatgcctgtagtcccagctactcaggaggctgacgcaggagaatagcttgaacccaggaggcagaggttacagtgagcagagatcacgccactgcactccagcctgggcaacaaagcaagactccgtctcaaaaaaaaaaaaaaaaaattagctgggagtggtggcacatgcctgtagtcctagctcgtcaggaggctgaggtaggagaatcacttgagcccagggaggttgaggctgcagtgagctatgatcacgtcactgcactccagcgtgagtgacagagtaagactctgtctcaaaacaagaagaaaaaaatgttctaggcagaaaaaaaacacacatgcaaaggccctaagatggaagagtatttgcaaagaagtgaaaggaggctgccatggcttaggtgagccaggagcaagtggcaggcatctgcttcctcgagctgccacacaaagtgccgctggcagggtggcttaaagtgactgaaatgtattttcttgcagttcaaaggctagaagttgaagatcaaggtgtcagcagggttggttccttctgagggctgtgagacaaggatctgttctgggctgctctctttggtttgtagaatgctgacttttccctatgtcttcacgtggtctgccttctgcttgtgtcggtgtatgcctttcttataaggatgccagtcatatcggattaaggcccagtcaaatgaaatcattttaacataagtacctccacagaggccctaactctaaagaaggtaggatttggaaggaaacaatgagggttaggacttagaatttggagggggttagggtgagggatacataattcagcccacagcatcatagtagggggatttggaacttatttaaagtggaataggattggagggttttaaatgagatggcatgtctgatttaaatgaatgctctgggccaggtgcagtggctcatgcctgtaaccccagcactttgggaggccaaggtgggtggatcacttgaggccaggagttcgagaccagcctaaccaacatggtgaaaccctgtctccactaaatatacaaaaattagctgggtgtggtggcacacacctgtaatcccagctactaaggaggctggggcatgagaatagtttgaacctgggaggcggaggttgcagtgggctgagatcacaccactgcactccagcctgggtgacagagcaaatgctctggctattgtgttggtagcagattggaggaaaacaagagtgggagggtgagacctctgagcgagttacttatgttcagatagcagtcctgtcctttacttgttatgtgaccctgggcacattacttgacctttctgagactcggtctccccgtctgtaaaattggaataattataatacctcacacacacatttgttgagagaattaatgaatcatccgtgtttagtatatactaactgcaaatgctagataaatgttaaatattattatattttagccatcttaggaagagacagcagtgcccgtgataggcagcctctaagtggcttccaaccctctcattctcgtatttatgcccttgtggaacctcctccctagagtgtgggctgaacctgatgacttgcttctaaggaatagaactggcaaaagtggtgagatgtcacttccaagatcaggttatcatattaggcagctcaggctgccaaaacaaaatatcacagactgggagattaaacaacaggcacttattttctcacagttctggagggtagaagtccaagatcaaggtaggacagcagggttggtttctggtgagggctctcttcctgccttgcagacggccaccttctcactgtgttctcacatggtctttcctatcatgtttcttcctcttcttgtaaggacacaggtcctatcagattagggccccacccttataacctggcttattttaagtatctctgaaagggccctgtctccaaatacaggcacattgggagtgagaacttcaacatgtggatttgggagattgggagagggctgcaattctgtccataaccgttaaaaaaaaaaaaaaaaaaaaaaaaaacctgtgagttctgtcttctttctctatgtagatatagacatatagatagataaaggcagagatagagatattttctcacaagcttgctttgatggaacaagcttccctgttgtcagggagaaccatctagcaggaaacagggcagcttctggccagcagccagcaatgaaaggaggccctcagcccaacaactctcaaggaactgaattctgccaatgaccacatgagcctggaagcagagcctctccaagttgaatcttgagataactgcagccttgtgggcaccgtgattgcagcctgtgagagcctctgagtagaggtcccagttaagctgtacctggatgcctgacccctagaaactgcgtgttgttttaagctactaagtttttgggtgctttgttatgccataatcaaaaacaaatacattagctagacatggtggcatgcacctgtagtcccagctatttgggaagctgaggaaggagaatcacttgagtccaggagttcagggtaagcctggacagcaaagtgagaccccatctctattgaaaagaaagagagaggaaaggtaggcagggaggcacaaagggaggggaggggaggggagggaagggaagggaagggaagggaagggaagggaagggaagggaaggggagaaaaaattttaaaaagtgagtaattcgcccaaattcacacagtaaatggcagagccaagaaaaataaaataaaaaaatgataacaggtcaggcatgttggctctcgcctgtagctccagtacttcgggaggccaaggaaggaggatctcttgtgcccaaaagttcgagaccaacctgggcaacatagggagatctccatgtctacaaaaaattttaaaaattagcaaggcatggtggcatgcacctgtagtcccggctacttgggaggctgaagtgggaggatcgcttgagcctgggaggtcaaggttgcaatgagctatgattatgccacttgcactccagcctgggcaacagagcgggacactgtctcaaatgaagaaaaaaaaagaaaaaaaatgatgataataatattaaggaaagacaaaaacaaagaatcctaccaagtctcttggattccagaaccaatgttaaaaaaatcatgaaaccaaagtaaactactgctatcctgaaacaatgataaataatccacagatcataaaaccagggactctggagcatgtacattaatataattgtatgtcccttagactgaagttctatcaaagcttaatgaccaaacaaattagctattggcattattttgcctccactaaaacctaagcagtagcagaagtacagatccacaattctaaaaacttcatcatgcgggctccttttataatagcaggtggttgtgattttcttgtttctcgtttccttttctctatcctttgggggagccatctgtaagtgtttggtttcaagtttcaaaaacaatctccatgaccttgaacaatgggttaaaagggttgtccacatgtgaactgaaaaaggaacaagttatagaaaaacattccaggccgggcatggtggctcacgcctgtaatcccagcactttgggaggctgaggcgggtggatcacccgaggtcaggagttcgagaccagcctggccaacgtggtgaaacccccgcctctactaaaaatacaaaaaattagctggacatggtggtgggtgcctgtaatcctagctactaggagggctgagacaggggaatcacttgaacccgggaggcggaggttgcagtgagctgagatcgcaccattgccctccggcctgggtgacaagagggaaactctgtctcagaaaaaaacaaaaacaaacaacaaaaaagaaaaaacaaagaacattccaaaagaaatttcttctgaccattttcttaggaaacatcagtgctgcaaattaatccttccatccaaagtcctgtcttctaacattttacatctgtatatgtgctttacatagttgttgaattgctctcatattcagtatgtcttggtatttcaatgcctccatttccttctctataaaaaaattttaaaaaagaagcaataaagtgcttattccagtacctgggctgcttgaatgatagcactgttgttaatcatattcaacattcattcattcaacaaacacctaggtagcagcatgagagccagttttctatcaattcatggtcctaaaatggaggatccagaatttccatgtatagcagcagcaacctagctagaaatagaagacaaggctgtcatctggaagtggtgatggggaagggcagctgacagatgcttaagaaggcttaaaccatcctgctgctgctgttgcttggtcttttcagaaaaggaaagcattggttgggtgccctggcttacatttgtaatcccaacacttcaagaggccgaggcaggaggatccactgaggccagagttcgagatcagcctgagcaaaatagtaaaaccttgggtctaaaaaaaaattttttttttcttaaattagccaggtatggtagaatgtacctatagtcccagctactccagaggctgaggtcagaggatcacttgagcctaggagttcaaggctgcagtatggtggaatcatgccagtgcactccagcctgggtgacagtgcaagactaaaaaatagaaggaaaaaagtaaagacaagcactgttaccaccattcgattgataagaaatttgaggctcgcatagctccagcgacttctcaaaattacaagactaggggccgggtgtggtggctcatgcttgtaatcccagcactttaggaggccaaggcaggtggatcacaaggtcaggagatcgagaccatcctggctaacacagtgaaaccccgtctctgctaaaaaaaatacaaaaaattagccgggcatggtggcatgcagctgtagtcccagctactcgggaggctgaggcaggagaatcgcttgaacccgggaggcagaggttgcagtgagttgagatcacgccactgcactccagcctgggtggcagagcaagactccgtctcagaaaaagaaaaaagaaaaaacaaattacaagactaggatatggaaaatcagaccccctagaaggcactgagctgccttggggcagagactttgctcgaagggtttaacactctatctccaaggcatagacacagtgcccaacacacagcaggtcttaggcaggttctgcaggagcaaagcctgaaacagggacttatgccctgctttattgagggagtgttcttgttaccggaaaggggtcccaatctagaccccaagagagcattcttggatctcatgcaagaaagaattcagggcgagtccacagagtaaagtaaaagcaagtttatttaaaaagaaaaggaataaaagaatggctgctccatgggcagagcagccccaagggctgctagttggctatttttatggttatttcttaatcatatgctaaaccagggatggattattcatgagtttgctaggaaaggggccaggaattcctggaactgagggttcctcttcctcttagagcatatagggtaatttctggacgttgccatggcatttgtaaactgtcatggcactagtgggagtgtcttttagcatgctaatgcattataattagcatataattagcagcaaggataacaagaggtcactatcgtcaccatgttggtttgggtgggttttgactggcttctttattgaatcccgttttatcagcagggtcttttatttatttatttttgagacagagtctcactctgtcgcccgggctggagtgcagtggcatgatctctgctcactgcaacctccgcctccctcgttcaagtgattctcttgcctcagcctcccaaagagctgggattacaggcgctcgccaccacgcccagctgatttttgtatttttagtagagatggggtttcaccatgttggtcacgctagtattgaactagctggtcttgacctgctgacctcaggtgatacacccacctcagcctcccaaagtgctgggattacaggtggaagccgcagcgcccggccatcggcagggtctttatgacttgtatcttgtcctgctgacctccaacctcttcctgtgactaaggatacctaacttcctgggaatgcggcccagcaaatctcagcttcatttcacccagctcatattaagatggagtcactctcgtttgaatacttctgacaccctcaggagaaagagagtgagggaagtgagatagaaaaggaaagtatatagattcagcaggagcctattctcagaccaactccacaaggagctctggggcatgaagccatcacagaattatccagcctgtatcaaggggccagctttacatatggcctctccattggcagggggctgcccctggggagggtgcaaaatgtaacctcccaggcattcctcagcaccatcagctgagcacaattccctggcagctgccttagactcctaagtgggatccaggtgggaaaccaatcgtatccgggacaatgctcaataaatatttgttggatgaatgactcataactagaacacaattctctactctctctatatcttttctctatacccaagagaggactttcaacccacaaacattttacagtcatcatctctaattcagagaccttgcccagcacaactaaacagcctggcaagagtcacatctgaccgtgtttaattaccactttggaggaggaaggacacgctgttgaggttttaagctacagactaatactttcacccatcatccaaggccaccacaaattaacagttgcattgggtttttgtctgacggctggacaaagccaattcatgtcaagggacctgagacataacataaaaagtcccctagaattttatctcctggagagagtatttgcttctcacattcttgtaccgcccctgggcggagaactcagcctagggactaatatacctttcacagaaaatcggtgttaaagcgggaatgtgtagtacaatcattcctggcaagagaaatcaagccaggtctttccaccttttttcttttaattacacccattctccattcagctctcaaatgtcctgccattctggtagagctgctagcagccctcatctaccactactctgttcttgctcttcatctcacaaacaaaagcagcccatatgagggaaagagaatttggcaagagaagggttacaatgtgatcctttccaaaaaaggagagatccatcccctctccaccctgctgccagagtgagctcctgctaatatgctaatattaacatcctgtttaaaacccttcaatctttggacaacatgtgcaatctttcatagggctcacaaggtttgatgtaggagggtttgcacctgctctccctccagccacattgactttctttcagttcctccagcctgccacaggatctttgcatatgctgaatgcactcacctccagctacttcttcagatcagagcttaaatgttatatcttgagctccctgtcccactcagatctgctctggttgtcacagcacattttcttcacggcacgtcacagttactatcgttttatgtgggtgttctccagcgcaggtgcaccagaagaaagctcttagtttgatgattatcaaatagctagctctacttctcagttagttcctggcatggagggaataaaggatacactctctcattttagagatgaggaaattgagctggataggaaacaatatttatctgaggtcacatggtttgttggttaattggctgatttttttaaagacaagattagctattttctcctgaaatattcaacccttttgcaaacatcctgtgttaccacctcagctctaaggactgctgtcttcctgatttactgctggccagggaagagtgtcctggaactcagtgaagaaccacatagaaacctcataaggaggtggggcgtggtggctcacgcctgtaatcccagcactttaggaggctgaggcaggtggatcacatgaggtcaggagctcgagactagcctggccaacatggcgaaaccccgtctctactaaaaatacaaaaaaattagccggcatgatggcgtgcgcctgtagtcccagctacttgggaggcagtggcacgagaatcgcttgaacctgggtggcaaaggttgcagtgagccgagatcacgccactgcactccagcctgggcgacacagcgagactccatctcagttaaaaaaaaagaagaaagaaagaaaaagaaacctccataagagctctgtagaccttgctgttttcatcaccaatctcttctagaagtgccttcttcaaactcctgaaactatcaaatttcccatccacgctctcccccggcatcacctcaaagcttatctttaaatcatataaaataaaacaatttatcaacatcatattaatgcctagcctttattcagcactgactgtaatgtgccaagccccatgctgagcatgttacacatcttaatccatgagctcctgtgctcaccaaggcaggccgggcagaggccattctctgggggaaggggagggcacagcatcctccctgaggtgacacagctgctgagtggcagctcctggctttacacccagcttggtctgacgtgaaagtccatggactaccccatcatgttactctgaggtgatcagttccagactgggacagagtcctttatcctctcagccacaggacttggtccccggctccatgaccgtcttccagaatgtacatgggccttcatgagccaagacatctgcatagagcaagcatcaaactagtatacaggaaatggggcaatgcaaagtctgacagactccatgtccttgttgaatatctctccacattgacacaaaatcacataaagagaatgtgttctgtgccaggcacggtggcttgcgcctgtaatctggcactttggaaggccgaggcaggcggatcacttgaggtcaggagtttgagaccagcctggccaacatggtgaaacccagtgtctactaaaaatacaaaaattagttgggcatagtggtgggcacttgtaatcccagctactcgggaggctgagccaggagaatggcatgaaccagggaggcagaggttgcagtgagccaagatcacaccactgcactccagcctgggcaacagagtgagactccatctcaaaaaaaaaaaacaaaaacaaaaaaacaaaaaaaaagatgagttccactgcttgtgattgtagatgattttgttctttgcttcttgtgtttttcagtttccgataatgcacatattaactttttttaaatgaaggttatttaaaaagaaaagaaaatgagccccaaacaaagggtacacatggacatatagagcggaataatagactagacactggagactccaaaaggtaggagagcgggaggggaatgagaagtgaaaaattacctattggatacaatgttcactattcgggtgatgtttaccctaaaatcccagaataggcatgtaagaaatcttcgcttgtaccccctaaatctataattttttttttttttgagacagtctcactctgttgcccaggctggagtgcagtggtacgacctcggctcactgcaacctctgcctcccgggttccagcgattctcctggctcagcctcccgagtagctgggattacaggcacctgccaccacgcccagctaatttttgtatttttggcagagacagggtttcactatgttggccagaatggtctaaaactcctgacctcaggtgatctgcccatctcggccttataaaacatttttaaatatatttttaaaaaagaaaatgagctccctctgtaaccagcactccaatcatcaaaaacagttggctttttgactgcctggcatacaatccagcttctcctttccatggcagtgcccattttcttttttgaagcttaaaaaaatatataatgggtgcagtggctcatgcctgtaatcccaacactttgggaggcagaggcgagtggatcacgtgaggtaggagttcgagaccagcctggccaacatggtgaaaccccctctctactaaaaatacaacaattcgccgggcacagtggcacaggcctgtaatcccagctactctggaggctgaggcatgagaatagcttgaacctgggaggcagaggttgcagtgagccaagatcatgccattgcactccagcccggccaacaagagtgaaacttcgtctcaaaaaaaaaaaattagctgggcatgtcagctcgggaggctgacgtgggaggattgcttgagcccaggagttcgaggttgcagtgcgccatgattgcaccccagaattccagcctggatgacagagtgaaaccctgcctcaaaaaaaaaaaaattcaaaacaaaagacaaaaacaaaaatcaaaatgcagatttggattctgtaggtccctgagggggacctgagcctctgcttttcttatgagctcccaggctggtgctgatgctgctggcccaggcactacactttgagtagcaagtgtctagcaaggcatacagtggttccagggctctctaagcacaaaagccgctcgtgcatcaccctcacagggccaggcccccatgcaggacagatgctgctttgggtcagtttgctcagaacatctgggccttcctacaatcacaagtcaccccctgtctccccactcagatggcaagaggtgttcccaggggcacagaaggaaacatactgtcactcagggccaccccagatgctccctcagcctcagatcgagtcagtctgagaccccctgagccaagttgctcccattcacccctccttgtccaatgcccaacccctgtgcactgagcctcctctcaaaataaactcacagagccccccacccccactttccattgcacctgaggcaattattacttgtcaaaaacaagaactgccagctgtgcgtagcattcagcttgctgttcttaaaatcccttataatcatttccctcggagaagaattctccagccccacaatggttctgcacagccaatcacagtgtagtcccggacccgtgttttgataagacaatctgacactgtcagtcagagggattcaagactcttgctgcagggaggagggagagaggaagaaaagaggagagagagagagagaaagcgtatgcctcttctccctctggaagtgcagctgactgcagagtctcccaggagcctgtccctgcagaggccttgacaaatgtcaacagacaggacgagatttctgcctctccaatacctgtaggccccatcccaccccagctatactcacactcatttcttgtttgtttgtcttcaagctccattcagagagaatggagatgtcttcttggtctaaattaaagttgaagcccggctgggtgcggtggctcatgcctgtaatctcaaaactttgggaggctgaggtgggcagatcacaaggtcaggagatcgagaccatcctggctaacacggtgaaaccccatctctattaaaaatacaaaaaattagcccaacatggtgtggcgggcgcctgtagtcccagctactcgggaggctgaggcaggagaatcccttgatctcgggaggtggaagttgcagtgagccgagatcacaccactgcactgcagcctgggtgacagagtgagactctgtctcaaaaacaaacaaacaaacaaaaaaaaaagttgaagccaagagggaaaagttggagggcacttggaggaacagggaggccctctatggcccaacctgcaagatggtcccaattattcttgcctccaggtattcatccccttgtgtggcatcccccaccatgcacagaccagggctagtctgcatcatgaatagaatagggttgtgcttgctctctccctctctctctctctctctctctctctctctctctctctcgggaaccagctgccatgttgcagagacattcaggccatcaatggcgaggttcgcatggggaggcacagcccccatgtgaaggaacttcggagcagagtctcctctggttgagtcccagtgtgacagcagctctagccaacagcctgacttgcagcctcatgagagatcctgagtcagaaccacccagctaagctgctcctgggttcctgacccgtagaagctgtgagataataggtatttattgttttcagctactgcatttggggtaactttttacacaacaatagatgatgaatacactatcccaaatcaatccacaaatttggtgtccccacaagtgtggggtgtgtctttcaattttttgagacagggtctcgctctgtcacacagactggagtgtagtggcacagttacagctcactgaaacctcaacttcctgggctcaagcaatcttcccacctcaccctccccagtagctgggaccacagatttgcaccaccgcagctggctgattttttaatttttgtagagactagatctcattgtgttgcccaggttggtctcaacctcctgggctcaagtaatactcccgcctaggcctctaaacacgctggaattacaggcatgagccaatgtgcccagcaagtatggggtctttctatggcaagatgtggtgcccatcactgtgagggacaaagataatattattaataataataggcctgtaatggtgcctcacacctgtactcccacctactcaggaggctaaagtgggaggattgcttgaccccaggaggttgaggctacagtgagccatgatcacaccactgcactccagcctgggcaacacagcaagacgctattccgaataataataacaataataataatatctaacattttaatagaccttacttggagccaggcatcattctaagcatattgcatgcatgaactcatttaaacctatagccatctattattattcctgtcatgctcatcagccagaagccaccagaaacacacctgtagttgaacagaaatgggtttagtaacctgttgcaacaaggaagaccacacaccatggggagtgggagctgtgtcccagtaagagtgtgttggggcgcttctggttagctggcagaaagcagtgttaattccatggctgggcatcatcataatttttatgtaggaggcaggaggaatagagtggggctaaagctgtcattggaaaaccagcagtaactgcatgtgtcagtcagaaggagaggatgcgtttggccatttttttgtggtttgcccactgctcatactttcatgctcagataggattcattacagactgtcttgtttttgtcttgtttcatcatggtcagcatgacatcttccagtgtgaccatcctatgaaattgcttaagtagggaacaccacagcctagcagtagtaccaggccagctactagctgacaacgatcaagactgggctcccggccgggcacagtggctcacgcctgtaatcccagcactttgggagctccaggtgggcggatcacttgaggtcaggagttcaagaccagcctggccaacatggtgaaaccacatctctactaaaagtgcaaaaattagccgggcatgatggcacaagactgtaatcccagctactcaggaggctgaggcacgagaatcgcttgaacccaggaggtggaggtggtagtgagccaagatcgcgccactgcatgatccaccctgagcaacagagccagactctgtctcaaaaataaaataaaatgaagactgagctttccttttcttatcctcattttatagatggaaaatctgaggccaaaataagttcagtagttatgttgccaagcctgggcggaactgtagagcttctcagactgtcagggctgcagggccagctttgctttgtcttcttttgtttgccaatccatcgtgggccaatacgttcataaaatacaataaaagcaaattactagaataacgatcatgcattcagatgttttaggaatgttaaattgctatccttctaaacaggtaccctcaagttctgtcttatctggtctcagacaaggaacagttctcaggccattactgaccacagaccacactttgggcagctttagaagttgtctgatcaagagttttccaggttgggcatgatagctcacacctctaatcccatcacttttgggaggccgaggcgggcagatcacttgaggtcaggagttcgagaccagcctggccaacaatgtgaaaccacatctctactaaaaatgcaaaaattagctggacatggtggcaggtgtccgtaatcccagctacttgggaggctggagaatcgcttgaacctgggaggcagaggttgcagtgagccaagatcgtgccactgcactccagcctgagtgacagagactgtccaaaaaaaaaaaaaaaagaggtttccaaacttcatgcattggtacatcttcatttttgccatttctattgaacacctctactattatttacttaatattatcttgaaatatcctcatctcatatcacctcacacccattatgatggccacaattaaaaaaaaacagaaaataacaagtgttggcgaggacgtgaagaattggaacttctgtgcacagttggtgggaatgaaaatggtgcagttgctacaggaaaacggtatggaaactcctcaaaaagttaaaaatagaaataccatatgatccagaaattccatttctgggtatatatcccaaaaatttgaaagcaggatttcaaagaaatatttgcacacccatgttcattgcagggttattcacaataatcaagaggtgaaagcaacccaaatgcccattggcaaatgaagggataacgaaaatctgatatctacgtacgatggaatgttattcagcctttaaaaagagggatatttggccaggcacagtggctcacgcctgtaatcccagcactttgggaggctgaggcgggccaattgctggagctcaggagtttgagaccagcctgggcaacatggcgagaccatgtgttgcatcatttagaaacatttatagctacaaaagcttcagagatcttgtatttcaatgtacaaacaaactgccaaatgccaaaaaaaaaaaaaaagccaggcatggtggtgtgtgcctatagtaccagctactcaggaggctgaggtgggagtatcacttgagtcgagggagcagaagttgcagtgaaccgagatgatgccactgcactccagcctgggtgacagcgtgagaccctgtctttaaaaaaaaaaaaaaaaaaagagagagagagggaaatcttgtggggtgctgcaccatagacaaacctcgacgactttatgtgataagccagtcacaaaaggacaaataccgaacaattccactccaatgaggtatctcaagtagtcaaactcctagaaacagaaagtagaatcatggttgccaagggctggaggtatttagtgtttaatgggtctagagtttccgttttgcaagatgaaatacttctacagatctattgcacaacgtgaatacacttaacacaactgaactgtacattataaaatggtgaagatggtaagtacaatgtcatgtccttttcagcacagttataaaaagaagaaaagtcctcatcctaggcaataataacccatattatgtattaagatggctagttctatatgttttcttttatttttttaagagatagggtcttgctatattgcccaggctggtccggaacacctggactcaagcaattctcccacctcggcctcccaaagtgctaagattacaggtgtgagccatcacacccagctgagttctatatattttcttatctgcattaacataaatgtttaactgttaaataataaaatgtttttttccatgaacgaccgaaaatcgttttgtgtaaacattgatctttgaacctcctgtttcttcaatgcctatcatctgaggcctgacaagagaagggacttagaaccactcccagccttcaaggagtttgcaattacactgaagggtgaagacactctccccccagaaggaaggcgggaaaatcttaaaagaaatctatctgttccttgaaggccagctctgtgtgttcagtgctctctcccaagtccctagcacatgccttgcccacagtggggtctcaacaggtatttgctagagtctatcaaattaagagaaacacgaaacaggcccggtgcagtggctcacacctggaatcctagcactttgagaggccgaggcgggtggactgcttgagctcaggagtttgagactagcctgggcaacatggtgaaaccccatctctacaaaaaattacaaaaattagttgggcgtggtgactcatgcctgtagtccctgccacttagtgggctgaggtgggaggattgcttgagcccgggaagcagaggttgcagccagctctgatcgtgccactgcacttcagcctgggtgacagagtgagactttgtctccaaaaaaaaaaaaaaaaaaaaagagagagagagagagagaaatactaaataagcagcacaaaccaatggggtactaggccagggctcccaacttgaggtttgtgggtagaattcagagggtccataaacctgcctcattttctctgattgctaactaaaatttagcatttccttctattataaatggaagcaacaaaccacagtagtatttgcaatatctgtgatttttgtcaccgatataaatcacgatattttcatatctcattacaatcatagcagacatctcattatattgtacgtgtgcatcactaattggaattacatagttattagactcaccactaaatcttgttatttgatgcattagtaaagattcacatattactatgacacaaatttggtgagtttttttatattttgataaccatattttagtataattggtttcctttgtaattccatgcactttattttttgcatagataaataatttaaacaatattacaaagaacaatcaatcaaatctagtatagaatatttcatagcctaaataacattttcccaaaactgaatggaccaaaaataaaaagtgctaatggttaaatattgttttggagttagaaagatttatatatataaaaaaggaaatatgtgaattttgggccttaatttaaacaaacaaactgccaaagggaatctttaaggcaatagggaaaatttgagtataactagtatgatgatacttaagctatagttgtctaatatgaagattactaagtagaagaagttatataatatgtttactagcagatttataattgtaaacatatttacctataggttgagataaacgtctgacaccaagaagatctcagtttaaataaaataagggcatgcaataatactttaaaaaaagtaagttatattgagaacaagttatgttattcagtttgagttgaatagaagatcaatattagtaggcatatttaggtttgttgcccagaaagctaatgtaatcatccattaataaacatatcttctccaaaaaaaaaaaaaaaaaaaaaggatattgttctcagaaggaggtcatagactccgccagatgccaaaagggtacatggtaccaaaaagaggtcagggtccagcgtggggttaattcagtgggtaactgactgggcctaagaagaaacagactgaaccaaggacaagcccactgttaccaccttttaggagggaaacactaacttaccatcggaaagaacggtgaattcaccggctaacatttgtgtgcagaaatcccctgacaaccgcaggattcaatgttcctaaaaacatatgttcattggcaagatcgaggtctcagaggaaattcagtgttgagcactaagtgatctcacatctgctgggttcaaagcatggactctggagccagactctctctgtttgtatccaagctccaccagttaggacctgtgtgaatttggatgagttatttcccctcgatgtatctcagtttccttgtctgtaaaacaggaaccaaagagcctagtggtggctggcagaataatgtcccttcagagatgtctgtgtcctaattcctggaacctatgaatatgttagattctacagcaaaagggaatcaaagttgcagatggaatcaatgttgaccttaaaaccaggaggttgtgcaggtagaaccgatgtaatcaaaagggtccttaagtgtggaagagggaggaagaagagaatcagagagagatttaaagatgttatgctagtagctctgaatatggagaaagaggccacaagccaaggactgcaggtggtctctagaatttggaagaggcaaaggttctccccagagcctccagaaataatgcagccctgtcaatgccttgatattaaccaagtgagacctctttgggacttctgacctccaacactgtaagataataatttggattgttccaagccactaagtttgtggcaatttgttacagcagcaataggaaatgaatacacagttttaaagatttttgtgaggatcaataaatgcattcatttatgtaaagcccttagaacagttcctggcacataattggtgcaatataccattaattttatagaaatggtgaataaaaattagagaattaatcacttccaaaataaactggatccactcaagtcaaagccttgctctgttttgcaacccttaatgaattcatggatctaggcattatcatacagcagatagataacatcacaaatgaggctgggcatggtagctcatgcctgtagtcccagcaaattaggaggccaaagtgggaggatcacttgagcccaggagttccagaccagcctaggcaacacagtgagaccccatcactacaaattagttttgtaaaaaactaaccgggtatgttagtgcatgcctgtggtgccagctactcaggaggctgaggtaagatgactacttgagcctgcaaggtcaaagctgcagtgagccatgatcatgccactgcactccagcctgggcaactgagcaagacaccatctcaaaaattaaataaataaataataaaaataattttaaaaaataaaaacacaatgggagataaccagacatcagttacctcctcatggaaaaacataacaatctaaaaagtggtcttgctaaaaaaaaaaaaaaaagaaaaagaaaaaatcagacctaaatctgataaaaatgtatagatacaacttatcaacttacagaaatgtggacaatgggccaggcacggtggctcccacctgtaatcccagcacttcgggaggctgaggtgggtggatcacaaggtcaggagtttgaaaccagcttggctaagagaccagcctggccaataaggtgaaaccccgtctctactaaaaatacaaaaattagcggggcgtggtggtgggtgcctgtaatcccagctacttgggaggctgaggcaggagaattgcttgaacccgggaggcagcggttgcagtgagccgaagatcacaccattgcactccagcatgggtgacagagtgagactccaactcaaacaaaaaagaaagaaagagagaggaaaaaaggaaggaaggaaggaaggaaggaaggaaggaaggaaggaaggaaggaagggagggagggagggagggagggagggagggtaggggagggagggagggaaggaaggaagggaggaaggagggaaggaaggaaggaaaagaaagaaggaaggagggaaggaaggaagggagggagggagggagggagggaggaatgaaagaaagaaagacagaaaggaaggaagagaaaaagaaagaaagaaagaaagaaaaagaaagaaagaaaagaaagaaaagtggaagatgaaggaatgcactaaaggacaccacagagatgcaactggcaatgtctagactgcgggggactctacagcagtgcttctcaaacttaattgtgcatacaaaacacccagggaccttgtgaaaatgtagtttctaacccaggaggtctgggatgggatctgagatgctgcatttctaccgagttcccaggtgatgctgatgatcctggttcactgaccacattttgaattacacaagatgaataacctatttttccagcaataaaagaactgaaggggaaacctatagattaaaagacacatgagccaatcactatgtgtaggactttagttggattctgattcaaagaaattattattaaaatgtattaggcagagccgggagtggtggcttatgcctgtaatcccagcactttgggaggccaaggcgggcggcagatcacttgaggccaagagttcaagaccatcctgaccatatggcaaaaccttgtctttactaaaaatacaaaaactagactagccaggtgtggcggcatgcacctgtaatcccagctactggggaggctgaggcacgagaatgacttgaacccaggggaaagaggttgcagtgagccgagattgtgccactgcacttcagcctgggtgagagagcttactgcagcactatttacaatagcaaagacttggaaccaacctaaatgcccatcaatgatagactagttaaagaaaatgtggcacatatacactatgaaatactatgcagacataaaaaagaatgagttcgtgtcctttgcagggacatggatgaagctggaaaccatcattctcagcaaactaacacaggaacagaaaaccaaacaccacatattctcactcataagtgggagttgaacaatgaaaacacatggacgcagggaggggaacatcacataccggggcctgttggggggtgggggtcaaggggagggagagcattaggacaaatatctaatgcatgctgggcttaaaacctagatgacgggttgataggtgcagcaaaccaccacggcacttgcatacctacgtaacaaacccgcacattctgcacatgtacccaagaacttaaagtaaaataaaaataaaaaagaaagaaaaaattgtattaggcagtaagtaacctgaacggtgactggatagttgatgttctaaggaatcattgttaatgttttgggtgcactgatggtattgtgcctatgtttttaagagtttatcttttcaagatacacattgtaatatttacagatgaaatggtagtgactggaattggcttcaaaataatgtatgtggggaaaacaggtagaggtataagcaaaactgggcatgagttgtccattgttgaagccaggtagtgagtcctgagaattcattgtgctattcttctactttcatatacctttggaatttcccatcataaaattatttttaagacatatttcttaaaatcttctctgctagctaatccttctcttgaaccacattcttcaaaggttctcctgcggcccataagttataaagagctcataagttataaagagtctgtgacttttagcagttacagacttgaaatctcatgtttttcatgctggcattccctctggtttcctttttgcaagtctcagcaaaatactttgtgtacccacctaattatcacagtccttaaggcacgtaccccttgacccagtcttctgtctgttaccgggatgtttctggcacctgaaatgcttttctgcagaactgctcatggcagctcctccctccccttctgttcaattggccctgctcagaggggcctccactgaccactcaatataagcagacatcccagtgtctctctgtggcaatgcctcagggcactctcagcatctgagatgatcttgttcatttattcatccgctttattttctccttcttcacacaacactccctcattctccccttataatgtattcaacaggaagacagggaccttgcctgttcattgctgcagactcagaatgtaacacactagcaggcacagcacagaatgagtgagtaaatgaatgctatagctgtgtgcatagctccatagacctagaaaatcaactgcattcttgctaagaggcatatacacatccatatatctggatcacacgtttgcagtctttctcatcaaatcatggaccaatggagctgcacatcccaggccaatagagctctatagcccatttctttcaagagaagagtagctccctgcgaactttcattggacacctgagctcttgactcacaataattggtcacaagaaggtctctgtgcaaatcagagatggtgggactcaaaatgtctgtggtcacagatccaaatgcactactccattatttagaaggccctcaatacccacctaacaaaccctatgccagggtctaatcaaagaaccgggtactgcattgaaagttgggatttggactggtctattggaaaagaagggttttcagatagaggcttcactctgtatttcagcttcatcagctatgggctggaaaatggttatagtgtcctggagactaatgaacgtggatttgaatctctgcttctcctttattagctgtgtgaccttagctaagtgatatcacttctatgatcctcggtggcatttatataatgggaataacaataatgatatctaccttgtagatttgttgtgaaaattaaatgagatgatagaaataaatatttcatctagtgcctggcatagagcaaatgtaataaaatttatctattactactactgctgctgctactgctaccactatcttctgatcttggaagagtcacttaattcctccaattctcagtagactcttctctaagaagaaataacaatgtcctagatccacagaaagtctggtgcttctctcccttattttctttagttctctgctcagataccacttttgcaaagagagcttccctgaccagtgtccccctcccacataaaatagtccacactctctccatctcattactcagcttggtttttcctcctaggacatatccgcctgatttgtacttacctgtttaatgtctgtcttgtcttccttgtcagaaagtcagccccaagagagaagaggctttgtccattgtgttcaatgcttattcctggggcccagaacaatgtctggcatataaagacactcaatgaatatttcttgtggaatgaatgaatgaatgaatgaatgaatgaaattaggtaacttgggaccataactatccagtccctgcattgctgttcaatagatattagcttccttccttccctccttccttccttccttccatccttccaaggccagaaaaaagaacaataagtgagagaaaaacgcctatcggcctcttttttccctgcttctcctccaagcatcatgcaaacaatcaaaacaaaaatgcagcagcaggtgccaagaagtcaggtgcatccttcatccccagtcagtctttcctggctctgaaatgtttgcaggagcaaggtgcccccgaggcacactgctttaaatgagtccaggcaggatttagacagctgctctgtaaccccaataaacgatgtctgtctaactttacgcaggggcactgagggttagggttgtatggctcttggggtctctgaagtagaaaatcaatgggtttgatgtatggccccatttatggcacctgaaacagaacatccactaccaggtcggctaccatcaaacctctcctaatataacaatacaagccatctctgagccttgaaaacctctttacaaagccagtggtcaaagagtagaaccgtctttttcaacagcaatcagtgaagatgatcatgtcactctcctgtggccaaccctcccctggcttctgatcgcactaggaatgaagtgcaaactcttctcccaggatctcaccaggtcagcacagcctggcctcacgtgtctcttcaccatctcagaccattctcctgtcttgctccactccaactgcattcatctctgtgttcccaggcacgtgccaccacacctggctaatttttttttttttttcttggtggaaacagattctcaacatgctgctcaggctgatctcaaattcctggtctcaagtgatcctcctgcctcagcctcccaaagtgcaaggattaaaggcatgagccactgtgcccagctgcattttattttatttgattttattattattattatttttgagatggagtttcactcttgttgcccatgctgtggtacaatctcggctcaccacaacctccacctcccgagttcaagtgattctcctgcctcagcctcctgagtagctgggattacaggcatgcgccaccacacccggctaattttttatttttaatagagacagggtttctccatgttggtcaggctggtctcaaacttccaatctcaggtgatctgcccacctcggcctcccaaaatgctgagattataggcatgagccgccatgcccagcctgcatttcatttttctaagacaaaaatattctggagatggatggtggtgatggttgcccaacaatatgaatgcacttaataccactgaactgtacgcttaaaagtggttccaatggtaaatattatattatttgtgttttaccacaataaaaatgtgttttaaaaaaggaagaaattctgaaacatgttacaacatggatgaaacttaaagatattatgctgagtgaaataagccagttacaaaaagacaaatatcatatgattccacttatatgaggtatctagagcagctgaattcatagagaaagagaatagaacagtggttgcccagggatggggaaatggaggcatagggaattggtgtttaataaggacagagtttcagtttgagatgatgagaagcgtctgaagatggatggtggtgatggttgcccaacaatgtgaatgtacttaatgccacttaattgtacacttaaaattgtacacttcaaaatggttaaaatgggcctggcgcagtggctcacgcctgtaatgccagcactttgggaggccgaggtggacggatcatgaggtcaggagattgtgaccatcctggccaacatgctgaaaccccgtctctactaaaaatacaaaaattagctgggcatggtggcgcatgcctgtaatccaagctactcaggaggctgaggcaggagaattgcttgaaaccgggaggtggagtttgcagtgagtcaagatggcaccactgcactccagcctggcaacagagtgagactccatctcaaaaaaaaaaaaaaaaaaaaaggttaaaatggtaagttttatattaccctatatttttatcacgattaaaaaaaaaaatcacactatcccaggctggacacagtggctcatgcctgtaatcccagcactttgggaggtttgggaggtcaagacagatgggtcatttaaggccaggagttcaagaccagcctgaccaacataacaaaaccccatctctactaaaaatcttttaaaaagctagtcagatgtggtggtgcacacctgtagtcccagctattcaggaggatgaagcacgagaattgcttgaacctaggaggcagaggttacagtgagctgagattgtaccactgcactccaaccgggacaacacagcaagagactctgtctcaaaaaaaaatttttttaatcatgctacctagcccaggcaacacagtgagacctgtctctacagaaaaataaaacaattcgctaaatgtatgctactctcagctactcaggagtttgaagtgagaggattgctggagcatgggaggcagaggtggcagtgagccaagtacctctgcactccagcctgggcgacagagatcctacctcaaaaataaaaatcgcagtacaaaaacaattttaagaggaggggtgtagagtattttatccaaaggcatgagataaactagctcattgatccattttctttctttgtcctgggtgatctctgagcctcacctagtaagagttaatatttatgccaggcaccattataagcacttcgccagtgtttccttcatttaatcctctctaccgtcctacaagatggggagcctaatcatctccatttaaaggatgagaaaacagaggcccagagaggtttcgtgacttaacctacaaagtctgactccagagtctaggcaattttccagaccacttttcccacaagacttgacctcaccctttgatattcaaaataggctcctcagatctacataaaatattctaaagtatcaggaatgtataagtcaggttaaggagaataaacttttttttctgtattcaccccatctttgttgaaaaagtgctgttactggcttcaaggcctgcaggctacattgcttaacacaggtgtactaagttaaagttcagcaaacttctgtaaaactccataaaaattaatctttgaggctttaggggcagatggcgtatgttgcaactacttgactctgccgttgtcgcacagaagcagtcatagacgagaagtaaatgaatggccttgaccgtgtgccaataaaactttatttacaacaacaggcactgggtttggtggctcctgaaagggttaaacacagaattgccatatgacccggcaactcccctcttaggcatgggccgaaaataattacaaataggagttcaaacaaaaacttgtacacaaatgttcacagcagccctatttatagtagctaaaaggtggagacaatccaaagatcaatcaactgaaaaatggatgcacaaaatgtggcatatgcatccaatggaatagtattcagccatgaataggaagtatggacgcatactgccaggtggataaacctggagaacaatatgctaaatgaaagaagcagacacaaaaggcaacgtaggccgggcatggtggctcacgcctgtgatcccagcactttgggaggttgagtcgggtggatcacctgaggtcaggagttcaagaccagcctgaccaacatggcaaaaccctgcctctactaaaaatacaaaaattagctaggtgtggtggcgcatgcctgtaatccccactactggggaggctaaggcaggagaatcacttaacccaggaggcagaggttgcagtgagccgagatcgcaccactgcactccagcctgggcgacggagcgagactccgtctcaaaaaataaataaatgaataaaagaccatgcaatgcatgactctccattgatataaattgtccagaataggcaaatccacagacacagaaggtagcttggtggttgccgaggactgaggagaagaaaattgagaacacctgctcaacagttatgggctttctttttggagtgatgaaaatgttctggaactaagcagatgtgatggttacagaatattggaaatgtggccaggcatggtggcgcacacctacaatcccagcattttgggaggccgaagcaggtggattgcttgagcccaggagttcaagaccagcctgggccacatggtaaaaccctgactctacaaaatactctactaaaaggtggagacaatccacctttgttcaaaataaaataaaatataaattaataatacaaaaattagttgggagtggtgacacatgcctataggcccagctactcaggaggctaaggtgggaggatcgcttgagcccaggatgtcgaggctgtagtgagccaagatcacattactgcattccaatctgggcgacagagtcaaattgtctcaaaaaaaaaaaaaaagtgaatgtcctaaatgccactgaattgtatgtttttaaatggttaactttacgttgtgtgaattttctctcaattttaaaaaatgttttaaaaaaacaggtggctgattgcttttggcacacagaccaaagtttgttgccccctattctaagccaaacagccaagaaggggagaaacagaagcatactatgacctatatgcaaaatattcaaagccattcatttaccagtgcttggggaagaagcgcgtatcgtatgcagtcttatacctccctgaaattaacatcaggcaccacccttggacctgagaagataggaaagctcctaggactcggtgcccacactgaagcctgaatcagggaggagagggcatttcatttacagcacatgctatagcttgaggtgaggtggcacagtctctctgcaaaaccaaaacaagtttaatacgatcagactgcagaaggagatggagtgaggagagataaagccagatgaggaaataagggtcatggcattaagacatgataagaaatctggattttatcctgagcgcaatgggaagcctatcaaggtttttcagcaaaggaggtggaaagccagacttgctttttagaaacatgattctcagtgtatccagataatggattgggagagagagatgctagaaaccaggagaggttttgcagaaaatcttgagtggcttacggtgcacaaataaagcttcaagacaactcaggaaagttggcctaaggcaggaggctcgcttgaacccagaagtctgaggcagcagtgagccatgatagtaccaatgcactccagcctggatgtcagagcaagacgctgcctctaaaaaaactttaaaaattaaaaattaaaaaagttggcctattgaaggttttccacctctgacagactcctctttcaaacaggagaataaagaaacttctttatttttccaaaaaaaaaaaaaaaatccaataaggacctcataaggggtccagctgccaagcataggagttgagcagagcaaaaatgacagggaaataaaacataaaatgagaatctatttcgcacttttaaccgaggccaatagatagaaaagagcttgcagttttccatgaataacaactgatgcaggcaataatgctaattattattattacgtatgttaataatgatattcaattgaactgcttaaacagaggatgcctcggagggcaaagatagtctaaggaattccattatgaaaatttcattttcagcccatagcctccttaatatcactaattaatattctttccctaaacaaatgcgggtggaggaggttggcaaagtacagaagtagcacttatcacaggaaacggtagagaataaacaggataaaaggactgaggtcacatttgtgattattatcataataaaatgcttcggaggaacgacttggcaaagcttacctgcaccatatgcctggcagactagcagcttcaaaacaatcgcaaaattaaaacaagtcttagggtcagttgctgagtttaaacattaggaaaacacttattttcctccagtaaccaacacatggcaggtttttgtattctgggttttggggattcggttttggttttgttttttcattagcttggttttgattgtatgtttgctttacatgctggcatttaattctgtaaccaggtttcctctgtctcgttcacaatctttttcaaatatacacctgagagcagcggattcctggtgccgctgaggcagtgactcacaggagttaaaagtgtgagctctagagtctgtggaatgtgttcaacttctgattctgctctttaaccagctatggccttaatcgctccatgcttccatttcctcatctataaaatgggtatgacaggaccatctaaccttgtaggattttaaaggataattgtgctgagacaatttagcctggcacttgacatacatttcagtaagtggtagttattatggaattattatgctgcatcccttcccctgcccacattgacaaataacccacactaaatcagatcctacacctagaccactggctttcaacaaatgtgttttttgtatatgaaagaatacatgatcctggcaactattctggtcacttcaaatcctcacccagcttttggaaccatcttactttcactagtgtaaataataagtgggtggtcctgtgtgtcaatcatataagtcccatgtcacagagagagagagagagagagagagattaaatctctggaaagggacaaagatggaacagagcctcagaccattaacctagagagcaggggtcagagggaagggaaaatgtcaatcatttcttaagtgtgctctgggaagaaagtttaaaatatagatagtaaaggattctttggggctttagggcaacagtaaatgttgccattcattactaataataaccattataataaccaccacccatcacgtgtttactatgtgccaggtatttctttggcttagtgctttaaatacattatctcatttaatcgtcatgacagtactatcaggtctagatttattatattctctatcttattttaaggaaattggaagcctagagatgatgagtaattttcccagattatccgcctgggtgtctggttctaaaaacccaagtatttaaccactatgctatatcacctctcaagtaaatagagacctttagacaaacatcgtgagagtatcacctatattagtttcctaggacttctataaaaacaaagaccacaaattaggtgacttgaacaacagaaatgtattgtttcacagttctagaggctaggagtctgagatcaaagtactggcagggtaggttccttttttttttttttttttttttttttttgagacggagtctcattctgtcacccaggctggagtgcaatggtgtgatctcactgcaacctccacctcccaggttcaagcgattctcctgcctcagcctcccaagtagctgggattacaggtgcgtgccaccatgcccggctaattttgtatttttagtagagacatggtttcaccatgttggccaggctggtcttgagctgacctcaggtgatccgcccgccttggcctcccaaagtgctgagattacaggcgcgagccacagcgcccggccggatagtttccttctgtgggctgtgagaaagaatccgtcccgtgcctctctcatagctttggtggtttgttggcaatttggggcatttcttggcttctagacctctgccttaatctccatgtggagttcttttgtgtgcgtctgtctccaaattccctcttttaatgaagacaacaatcatattgaattagggccccagcctactccagtacaacctcatcttcactaattatatccccaagaaacctattttcaaagaaggtcacattctgaggtactgggggatagaatttccacatacaaatttgggtagatataattcaacccataacctcactcataagcatttgtctctgctgattattccttcatcttccaacccaggggcacaggggagggggcagggaggagcccagggtctccacacacgcacttgctgcaagacataactcttcatttcaaaccccacagtgccgtttgtcctacatgagaaaggagagttgaaaagggatacagtgcaaaagatgtcaaacccaagataaatgtttcctcagatgcaatgacttccagagatttggagtcgtaagtttttgaaaaatggacacatgaggaacaaaggttgagttttctgaaatcattgataacccccaagacaacacccagctttctcccatgattataaatggggggatttgaaatggaacttctattgtgtggctttcaaagcccacgatggcccaggagtagtgaatcatttctaaggtaaagcacttcctctgaactcaggggaagcagaagtaggcagataagaaatggtaatgcaggaggcagatttatgaacaacctgaaatgtgaacattttttttcatattccataagatggaccagtcctgtggcccatgtgggagtataagattaaacaccaaaaataaaatgtcttagcatttcccaaattcacacaggcaatgtcacataggcccctccccagtaaacaatagacatgatgtaaaatgcagattcttttgtctggcaatgaacataagcagatgaacatttgttcattctttcaacaattgcttcctgagtgactgtcatatgctgggctctgtcccaggtgctgaaaataaatatctcgagtagggtttacagattaggtggataccaaactctgaataattaaatcatagctctacaaaggaattcagggcagtcatttatgcagacagaagaatggaaagggagatagaggaaagtgcatcttgtgtatttctatcaggtgttatctaatgaattcctcacagcatcctttcaagatggtgtctttcctgcaaaccattattattaatctcattgttaccattctgtggcaaccctcagtgactgaatttctcctcttttggtctagcatatataccactaggaactatcattttgcttttgagctcctcctatctagctgaagacaaagttattcaaggaagaagctagctccctgccttggagaaacagtcttgaagaaaccatagatgtatgaaaagactatttccattaacaaagggaataagatcaggaaatatttttgatcttactatatgacctaagcatatatcccagagaaattttttaaaaagtactcaaacaaatacttgtacatgaatgatcctggtagctctattcacaatagccaaaagatggaaagagctcaaatgtccataaatggaagactggataaatacattgtggtataatacatacatacaattaactattacttagccataagaaactaatatatgctacaatggggatgaacctcaaaagtattataagtgtaagaagacataaaaggtgtataattccatgtatatgaaatatccagaataggtatatccacaaatgcagaaagcaggttggtagtacccctttctggggaaagagaaaaatgaagagtaactgtttaatgggtacaggtttttatttgggggtgatgaagctattttggaaaaaggcagaggtggtcatataacactgtgaaggtactaaatgccactaatttgttcaccttaaaatgatcaattttgtcatgtgaatttaacctctataacacagggtacttcaaaaaatagaccttcaataaatgtttgtagaatgaatgaacaataaacaaaggaatgtatgtggtcttggcaaacggctcatactgaaaggtggtctatgaaaagagactttgtaagtggagatggtgttgaccagcagagtctaaaatgattcttagtggccttggctcggttttattattctgttcatggagaacaggaatcagagcctagggttctatccaggaggaaaaaaatcttcctgtcttggaattttcagaacctagtgtcttcctacatagcaaaagacatttctggctgccaggagggagtaaagccagtgggagttagtcccatctgcctgcagagaggcagaaacattatctgtctaaattcttcttcatcagaaagtcttatggctgggggcgcttcccagctctcattgtgacctagccttaggaccacattaaagagcactaccatgccgcagagagggggttggagggaggagactggctgccagactgaaactaaattaaaaataaagctccccttattaaattcataattattgtgaagctgtgaaatcttattttaaacctctggctcctttctttgtccagagtagaggctgcctgcttctgaatccctattttgctttatggacaatttctttttagcattctgagcatttaaccttgaaaaatagtgttgttttgctgctgtattttctgattgttagtctccaggcatctccatggcatctttataaatctgcaggagctggtaaatatttcttgccgaccagccgctgaaatctgaaaataccagctcactttttagctgtcaggcaattaatgtaattcaaaggaaatgaaaggtgtgggcaactgggactgcttttaataacaggagggttcctggctcaggcttagaaacacaagagagaagaatcaataaaagactaacagaaagggtagaagagggcgtggagttctctagaaacattttgtcagcatcctggcaatgctgcaaatctgtgccaagagaaactgataaatgcagctactgatgatcgacttggagatgagtcaaacttcgaggcctgggccagggcatccactggcctaaagggtgcctttgtgtaaaatgggaaacgataccccatctgggtagctgaattaggagaaagtgctccctgagtatagatgcagccccacgccaaggcacacagcttggtgggcagagtgctactggatttcagccttcttcctccaaatttattcttatggccagcagccttcgtgcagcgtacaaactgaacatcgctatccagatcaattcccacttccctgtttcttggataatattggttttccattcttccctgctaagtcaggaatcaactacattggctttggaccccaaaggtgatttaagtgtagttggattcataggaggagatagactatggagaaggaggaggagctctcacatatggcaatgctattttgtttctcaaagacaacaggctagaagaggaaaaagtctttccttctagtgaggtatagactagtcactaaagaaatacaattttccaagcatgggaatgataattctatcaatatctgccacctttcatatacttctttttttttaatatacatggagtctcactctgtttcccaggctggagtgcactggcacaatcttggctcactgcaacctctgcctcctgagttcaagtgattctcctgcctcagcctcccaagtagctgggattacaggcgtgcgccaccatacccggctaatttttgtatttttagtagagacggggtttcaccatgttagccaggttggtctcaaacttctgaccttgggtgatccgcctgcctcagcctcccaaagtcctgggattgaaggcatgagccaccgtgcccagctcatatacttcttacatggcagtcaaggttacacaatgcatagagcacaaatcatattctactgtatataaataatgcctctcctgactacatggattacaatgtcattgctgcccccggagttgtgcaatatggcaaccttgagtcccataggcagtgcatcgggggaggcctacagagtatattagggtacatggatgaacctacttcccaagagaaagcaagatttcaaaacccagttgatcaaaataaatacaaaatcatcaaatgtattttgatatatcaataaatgtttagcaaacaaaaagtccatctataatcatatttttaaatcaaatatccaggagtaaatctagcaaaatatgtgcaagactgcttcatggaaaactctaagatatttttgataaaaatgtttaaacacctaagtaaatgaagggataaaccaaggtcctggactgggggactccgactccatgctgtagtagcactgtagtaatattaattgtctgcaaactgatctacagatttaatacaactccagtcaaattcccagcctgtgctgtttgtttgttttggaaattagaagccgatttttaaatttatatgtaaaggcagagtcaagactagccaagacaatcttagagaatgacaacgtagaaggaaacgctctaccaggtattaagacttattacaatgatagacattaagaaagtggtactggtggctgggcatggtggctcatgcctgtaatcccagcactttgggaagccgaggcaggcagatcacctgaggccaggagttcgagaccagcctggccaacatggtgagaccctgtctctactaaaaatgcaaaaattagctgggcgtggtggcgtgcgcctgtaatcccagctactcaggaggctgaagcaggggaatcacttgaacccaaaagacggaggttgcagtgagcggagatcgtgccactgcactctaacctgggcaacagggcgagattccgactcaaaaaaaaaaaaaagaaagaaagaaagaaaagaaaaagaaagtggtgttggcttgaaaacaaacaatggaagataattgagtccagaaatagacctttgcatctattaacatgtgatttatgataaaatggcagaacagtgaagaaataagtcttttcaataaaatggtgctgggtcaactggataaaacatggtaaaaaaacaaaacttgagcccttcttcacatcatacctaaaaacaaatcccaaatggtatgtaggtttagatgtagaaggtaaaacaagcttccagatgataacatcagagtgtatctatcttcattactttaaggaggaaaagatttcttggacaagccacagagagtactaatcataaagcaaacaactgataaacttttaattttaaaattaaacttttgaaattaagaacatttgtgtattaaaaaaaaaaaccacactattacaaaagtgaaaagggccgggcatggtgactcacgcctgtaatcccagctacttgggaggctgaagcaagagtattgtttgaggccaggagtttaaggccagcctaggaaacatagcaagacccccatctctacaaaaataaaaattaaaaactagccaggtgcggtggcacatacctgtagtcccagctactcaggaggctgagttgggaggattgcttgagcccaggagttcaaggttgcagtaagctataatcacaccactgcattctggcctagatgacaaagcaagacccccttctcttatttaaaaaaaaaaaaaaagtgaaaaggtaagccttatagtgggaagagataattgcaacatgtaaatgaaaagggattcataccagattacaaaataatttctaaatcaaaacaaaaaactacagaaaaatgaaaaaaagacttgaacagacaacagatacttcacaaaacaaggatacctaaattgccagtaggcagataaaaaggtgttcaacctcattagtctttggcaaatgcaagataaaatcattatcagatgccactacatacccactagaatggctaaaattttaaaaagactaacactatcaagcactgagagcaatgtagaggaactagaactcccattatgcttctagtgggagtttaacacaagcactttagaaaactgtttagcagcatctactacatttgaacatatgctaattctatgactcagaaatttatattctagatgtatgtccaactatatttacatatagccaaaaattaaatataaattttttcatagcaacactttaaataatagtcaaaacactggaaataacataaatatacaacaataaaatgaataaataaatggtagtatagtcacatgatggaatactacacagcaatgaaaactgactatggctacatgcaaatacctggacgaatctcataaccatgtacaaaataagcaaagacaagttgattcatatttcttgattccatttatattgtttttaaagtggtaaaaactagtatctgtgttaaaactcagcatagaagttactttttgagaaaagaggacactatggcatttttgagatgctggttatgcaagcatgttcacattgtgataatatattgagccatatccttatagcttgtgcacttttctttaaatagattatattttacttaagtattttttaaaaagatttttaaacccatttcaaaggccatatctgggaagccttcccagaacatgcagatagatttaattactccctcattgatatcttggacttatttaggttgttatacttcgaacagtctattataatttgtgttcttccatgcagttcttccctgttacacatgaaattcttgagttaagagcaatatggatatttattgggatgtttggttgccattgtttgtttgcattgttttttgcccacagcatcatatgttttcccattctaacagagccctagtttttctttgagaattcattcttctacatataaggtctgtgtgatttgagtgaggctccattcctagtcacacaggtagaggaggtgacccaggtccaagacaatcactgtgtatcacatgatatattagtctattctcacactgctacaaatgaatacctgagactagctaatttataaagaaaagaagtttaattggctcacagttctgcaggctgtacaggaagcatagcagcttctgcttcttgggaaacctcaggaaacattcaatcatggcggaaggggaaggggaagctggtatgtcttatgtggctagatatagagaaaagatgggaaggtgccacacaattttaaatgaccagatctcataataactcactcactctcatgagagaagcaccaaggagatggtactaaatgattatgaaggaccatccccatgatcccatccccttacacttggccccacctccaacattgggattacaattgaacatgagatttgggtggcgcacagatccaaaccatatcacatgacctaaactgatctaatcagactgaaattcattctggattagaatcaatttcaggatttttgtggaaaataccaagccacagatgctcatcttttactgagcatgaaactgaaaaatgaggtttcaggagctactgtcagacaccttgaaaccatgagaaagagtcttcctgaaaatggagccaacactgaggaaaagtcaggatagaaagccccgaaggaaacccatgcttgtttggtcaaccgtgtttcagaaatgtgtgaggtggccagacgcagtggttcacacctgtaatcccagcactttgggaggccaaggcaggcagatcacttgaggccaggagttcgataccagcctgaccaacaaggcaaaaccccatctctactaaaaatacaaaaatcagccaaatgtggtggtatgcacctgtagtcccagctatttgggaggctgaggtgggaggattgcttgaacctgggaggcggaggttgcagtgaactgaaacaatgccactgcactccagcctgggtgacagagcaagactctgtctcaaaacaaaaacaaatgtgtgaggcaatttagtagagaaaggattgtcttttcaaaaatggtgatgaattggataactatttgcaaaaaaaaataaagaactaaacctcaacaaacaccttatataaaaattaaactctaagtggattaaaaagctaaatgtaaaatctaaatctataaaatttctagaagaaaacatagaataaaatttttatgaccatgatttaggcaaagatttattagttagaacatgaaaagcatcatccataaaagagagaatggataagttggacttcatcaacattttacacttctgctcctcaaaagacactgttaacatattaaaaggcaagccacgttttaaaaatgcaagccactgggataaaagtatttgcaaaatacatatctgataaaggatttacatctggaatatatttttaaaactctcaaagcccaataatgaaacaataatacaatttttatctaatgttatgttattttatgtctctggagctctatgttcatttacatgttttagattttttttaacaagttcgacttttattttagattcagggggtatatgtgcaagtttgttacatgggtatcttgtttaatgctgaggtttagggtacagctgatcccgtcaccaaggtagtaagcatagtacccaatagtttttcaacactcaccttcctccctcccccacccagtagtccccagtgtttattgttgccatctttatgtccatgactacccaatgtttagttcttacatatgagtgagaacatgtggtatttggtcttctgttcctgcattaatttgcttagagtaatggccttcagccacatccacgttgttgcaaaggacatgatttcattcttttttatggctgtgtaggtttttttaaaataagcctcagtttctagttattgttgtttctacttgctcaaacaacttatgagggttctatctaagaataacatttatcccctgttagatttttcctgctttctcttgcgggcatttagtggtataaatttccctctacatgctgcttttaatgtgtcccagagattctggtacattgtgtctttgttctcattggtttcaaagaacatctttatttctgccttcatttagttatttacccagtagtcattcaggagcaggttgttcagtttccaggtagttgtgcggttctgagtgagtttcttaatcctaacttctaatttgattgcactgtgtccgagagatagtttgtggtgatttctgttcttttacatttgctgaggagtgctttacttccaattatgtggtcaattttagaataagtgggatgtgatactgagaaggatgtatattctgttgatttggggtggagagttctggagatgtctattaggtctgcttggtgcagagctgagttaaagtcctggatatccttgttaaccttctgtctcgttgatgtgtctaatattgacagcggggtgttaaagtctcccgtgacaccctaacatcacaactaaaagaactagagaagcaagagcaaacaaattcaaaagctagcagaaggcaagaaataactaagatcagagcagaactgaaagagatagagacacaaaaaaacccttcaaaaaaatcaatgattccaggagctggttttttgaaaagatcaacaaaattgatagaccactagcaagactaataaagaagaaaagagagaagaattaaatagacacaataaaaagtgataaaggggatatcaccaccgatcccacagaaatacaaactaccatcagagaatactataaacacccccacgcaaataaactagaaaatctagaagaaatggataaattcctggacacatacacccttccaaggctaaaccaggaagaagctgaatatctgaatagaccaataacaggttctgaaattgaggcaataattaatagcttaccaaccaaaaacagtccaggaccagacagattcacagccaatttctaccagaggtacaaagaggaactggtaccattccttctgaaactattccaatcaatagaaaaagagggaatcctccctaactcattttatgaagccagcatcaacctgataccaaagcctggcagagacacaacaaaaaaaagagaattttagaccaatatccctgatgaacattgatgcgaaaatcctcaataaaatactggcaaaccgaatccagcagcacatcaaaaagcttatccaccatgatcaagttggcttcaaccctgggacgcaaggctggttcaacatacgcaaatcaataaacgtaatccatcacataaacagaaccaatgacaaaaaccacatgattatctcaatagatgcagaaaaggcctttgacaaaattcaacagcgcttcatgctaaaacctctcaataaactaggtgttgatgggacatatctcaaaataatgagagctatttatgacaaacccacagccaatatcataatgaatgggcaaaaactggaagcattccctttgaaaactggcacaagacagggatgccctctctcaccactcctattcaacacagtattggaagttctggccagggcaatcaggcaacagaaagaaagaaagggtattcaattaggaaaagaggaagtcaaattgaccctgtttgcagatgacatgattgtatatttaaaaaaccccatcgtctcagcccaaaatctccttaagctgataagcaacttcagcaaaatctcaggatacaaagtcaatgtgcaaaaatcacaagcattcctgtacaccaagaacagaaagagagccaagtcatgagtgaactcccattcacaattgcttcaaagagaataaaatacctaggaatccaacttacaagggatgtgaaggacctcttcaaggagaactacaaaccactgctcaacgaaataaaagaggacacaaacaaatgaaagaacattccatgctcatggataggaagaatcaatatcgtgaaaatggccatactgccaaaggtaatttatagattcaatgccatccccatcaagctacaaatgactttcttcatagaagtggaaaaaactactttaaagttcatatggaaccaaaaaagagcctttagagccaagacaatcctaagcaaaaagaacaaagctgaaggcatcacacacctgactttacactacaaggttatagtaaccaaaacagcatggtactggtaccaaaacagagatacagaccaatggaacagaacagagtcctcagaaataacaccacacatctataaccatctgatctttgacaaacctgacaaaaacaagaaatggggaaaggattccctatttaatacatggtgctgggaaaactggctagccatgttcggaaagctgaaactggatcccttccttacgccttatacaaaaattaattcaagatggattaaagacttaaatgttagacctaaaaccatgaaaaccctagaagaaaacctagacaataccattcaggacataggcatgggcaaggactttatgactaaaacaccaaaagcaatggcaacaaaagccaaaatagacaaacgggatctaattaaagagcttctgcacagcaaaagaaactaccatcagagtgaacagacaacctacagagtgggagaaaatttttgccatctacccatctgacaaagggctaatatccagaatctacaaagaactcacacaaatttacaagaaaaaaacaaacaaccctatcaaaaagtaggcaaaggatatgaacagacacttctcaaaggaaaacatttatgcagccaacagacacatgaaaaaatgctcatcttcactggccatcagagaaatgtaaatcaaaaccacaatgaaataccatctcatgccagttaaaatggtgatcattaaaatgtcaggaaacaacagatgctggagaggatgtggaaaaataggaatgcttttacactgttggtgggagtgcaaactagttcaaccattgtggaagacagtgtggcgattcctcaaggatctagaactagaaataccatttgacccagcaatcccattacagggtatatacccaaaggactataaatcatgctgctataaagacacatgcacacgtatgtttattgcggcactactcacaatagcaaagacttggaaccaacccaaatgtccatcagtcttgactggattaagaaaatgtggcacatatacaccatggaacactttgcagccataaaaaaggatgagttcatgtcctttgcagggacatggatgaagctggaaaccatcattctcagcaaactatcacaaagacagaaaaccaaacactgcatgttctcactcataggtgggaaccagacaatgagaacacttggacacagggcgaggaacatcacacaccgggacctgtcggggggtgggggactgggggagggatagcattaggagaaatacctaatgtaaatgatgagttcatgggtgcagcaaaccaacatggcacatatatacctatgtatcaaacctgcacattgtgcacatgtaccctagaacttaaagtataataataattttaaaaaagaataacatttatcctcaaaataggtaagtacacaattattaaaatgggaaaagatttgcatggacacttccccaaggaggacatacagatagcacataaacacattaggatgactgacatcattagttatcaggaaaatgtaacttaaaagtaccttgagatagcactgcacacctattagaatagctaaaataaaccttaaaaggtgagtgagaacaagtactggtgagaataggaagtaacttttattttattttattttattttattatttttagtagagatggggtttcactgttttgaccaggctagtctcaaactcctggccacaggtgatccacccacctctacctcccaaagtgctgggattacaggggtgagccactgtgcccagcactggtacaacccattttggaaaacaaattggtagtttcttgtaaaattaaatacagatttactgtatcactaagcaacttccctactaggtgtttaccagaacaatgaaaacttacattcacacacacacaaataaaaaacatatgcacaaacgtttctagtagttttattcacagttgccaaaaatggtaacaaatcaaatgtcctgcaattggttaataggttttaaaaatcactgtacatctgtacaatgggctactcagtgataaaaagaaatcagaggtgtgattacacagatgactcctacacaaaggcaggatagtgagtaacagaggccagacacataatcttacgagtacatctagactacttaattccatttaaaagatattctgaaaaaggcaaaactataggtactgaaaagagatgagtggttgtcaggggctgagggtagcaggagaagttgactacaaagggacaagaaaaaaattagggaggggggattgtggaaatgttctatatcccgattatgttggtgagtacacaactgcacgtttatcaaaactcactaaactgtgtacgaaaagggtaccatacccaagttacgtctcaataaccttaaccaaaaaagtaaacaaataaaatattttgctgaagccctgaacccagctacacctgaagtgaaatttactcttggagttttcagctgtataagctaatacattctctctttccttaaccacttgagttggattttctgttgcttgtcactaaaagagacccaactgttacacgggctcggtttacccaatgttataggccagcatctagatttaatgaggataaatggtctccctacagtttaaacttctcagaaaccagagtttgtagttaggaatagcaacggtatgatatatgcacacgttatccctcctctttggcccatgatactcaatgatcacaacatccttcagagtaaattcagcttcagagatcttcttatcaagacagtgtactttctctcattactacttcactgaaatcattacttctctcttcctgtagcaggtagactctaagatgtcccccgatcatcctctcctcttcaccttcgtatctttgcatggttcctttttttttggtatggacaggacctgtgacctacttctaatcaatagaatatgtcaacaatgatgggctgtcacttctataattaagttatgtaagattgtaacttccagccgggcacagtgcctcacgcttgtaatcccagcactttgggaggccagggcgggtggatcatgaggtcaggagatggagaccatcctggctaacacgatgaaaccctgtctctactaaaaatacaaaaataaaattagctgggcgtggtggcgggcccctgtattcccagctacttgggaggctgaggcaggagaatggcatgaacccaggaagtggagcttgcactccacttgccgagattgggccactgcactccagcctgggcgacagagcaagactccgtctccagaggaaaaaaaaaagattgtaacttccatcttgctagcagactctattgtcttcttggcttgcatggtttgatgaagcaagctgacatactagagaggcctccatgccaaggaactgagggtagcctctagacaacagccagctaagaactgagggcctcagtacaacaacccttgaggaactgaaccctactaacagccatgggaacttggaagggagttcatccccagtagaaccttcaaattaaacctcagccaggttgacaaccttaattgcagccttatccaaagactcttgacacagaacacctaactaaattgtgcctacatttttgatcatggaaattgtgagacaacaaatgtgttttgtgttaagctgataagtttgggtgtgattatcgtgtagcaacagataactaatacacatccccatcataaacaattccaaaagatgtaggtaactatgcacctcacagagagaatgtttcatggtgttttcttgactgtacacttatctgacaatgattaaatctcactctgctaacctccctgcagcctctaagttttgccctaattaactgtggactgattttctcaaatgaaagcaagtcatcttcaagcacattttcttttctttctgcttattttttgataccctaataaagcaagctaatcttggaagctaagtggataattctcatcttatagattaaaattaattgagttgcagggagagataaaagcttgtccttttatttggatgttctggcaagttgtaccaggaatgccatggtaaccaaaactacattacagaattttttctcttaatcccactgtttaggtagaaaaatttccatctctattttccctcttttagaaaattataaataaaaagaaactgagttagctgggatggaaaagtaaagctggtttttgcctaatcatcctcattacttcacacaccacagctctttcctctggctacttcttcacattaagcatttggctaatggcttctgtttcatgtagaagagcatttattgctctggtatttccctttaacacttcagctggggatatcatagagcagagatttgcaaccacaacccatgggccaaatctggcccaccacatattttataaataaaattttattaaaacacagtcacatccattcatttgcacgctgtctatggctgctttcagactgtaatgggagagttgagtggtggtaacagacagatggccaacaaaacccagaataatttactatcaggccttttgcagaaagcatttgctgacccttatcattaaaaaaaaatttgagaagcttcagagagtgaacatcctttggctacagggcattgcaaggaacatgaacagggatcaggagaagtatattctaggtctagccctatataaccctgcattagtcagttctctgtgcttccgtttacccatcaaaatttcagtaagtggactagatcaagtttcttctggttttgagtaatatatcaactcaaacaacctggggtattttgttcatgtgaatagcccaactattttcatctgaaatcttattattttgtttttcttttcttggtttaccgtgctagacagcttaaacatgatattaccaacttagagtctaaattcaccatgtcttcaaagaaaataagaactaattcctatttgattgggctttgagactaaatgggacattaccatttagtacaaatgaaccagaagaaagaagggagtttgtgtagagtaactttaattatcacaatcatcatcgtcacatatattgcacgtaagatgttccaggtactgttctaagtgctttaaatattttaattcctttatactctcacaaaaaccttatgaaataggtactattattaatcccattttacagatagggaagctgaggtacagagatgttaagtaacttatccaaggtcaagaagctggtaagtagcagagccgggattcaaaccccatgcagtctggctccagagtcctttctattaactgacatcccatataaaagaaagaacattcctagccttgacaacatgtcttcagcaaaagcaaaagaaagagaacagtttctccatctgccccaccccttccagtctaaaacagtattccccaggtctatgggcaggagagcagatgagaaagagatccaagagttaggaattatggctgaactaaaagcaacttcccttagatttttgtttcttgagctcagacttccatctgctgggggcagttttcacataccccagagctgtgtagcctacagacggtctcagtcaagacactccatcagctgtctatccagcaattgtccatctatgtccaaaattttgctcagtctgtctgaaccaaatgtagaaacagtccctggacatttaaagggtagaagtgggggaggaagcctctgaactgtatttctgaaaggctgaatggagacagtttgagggcacactcttccaagttgggccacgggtctatgcaagccagaacctcagcaaaaatgagaatttactgaagaatactgaggaacacaagaaactcgggtcctgagttgaattacaagttttggggactttagcggcaggaatgcattcttacaatattcagtgagcatctactgtgtactgagcactgtgtgaacaccggaaatcctgagatgactaatacttttataattccctaaatagcaatgctccctcacccctaagcctttgcatagccttgtctctcttcctggagttccttcccctgactccttcatctggccaaatcctcacagtcatgacattgctgggccttgcctcctccaggggggccacgttgaggctggaattgtgaacacttggtagccttatgttctttcatgagttatagtttctccttagctcaggcttttcaatggtaaaatgggaatcctcacagatgcatctaaggtcatttggaagactaaacgaaagcattatgtaaggttttacctcagtgcctcgttctttaattgctcccacattgtcttgagatctcccttccagaccaggggctgtgtctaattcatttctgtatccacagatcctatcacagggtctgacgcttaatacatgtttgatgaaggaagagagggagagatgctactcttgactcaaagttttcccagtataaagggaaagacggatatgtacacaaagaatgagagcccagtatgaaaaatgctataaaagaaacattaaaaagagcctcacagaatcaaagaagaaagggccatcgaggctggtgatcttgagaaatactttgcaaaggtaatagctggttgaggactaagagcttgccaagcatagcagcaggcagattagagcattctaggcaaggagaattgtacacttcattcccaagcacaaggattaaattcttacagggaatggtaggttggaacaaaaataagtgaaagagatagaataaggaatatatatccttaacataaaaatgagttacaaggacaaagataatgtatgtaaatgtgtgactattttacctttagtaaataacagagaaaaaagtggagaacaaaaagaggccatcagtgatttttatatgtcttaaattagcagcaatcagtactatacaacccattttctatttactgcctcaagacggcaggaaatttttcaggctctccctctgcttcatctgcaataagaagctcacaaatttgttttgctttgttgcaaataacatgtatgctgagaggcatttttcctctctataactgtacagccatctaaatgggtcttttctggttttacaacttgaatatgttaacatgcacccctcagggtcccccttgtatcccagaaacagcacgcttgtaaaaccttattcatgtgatatccttaatagctgctgacatttattaagtgtttaagatgtgccaggcatggtgctaagtgtcttagaactcttccagcctgtaatccccgagcctccctgtgaaaatacaagcatcttaagaatgccccctactctggcatttaccttcagatgaccgatgaggaaagtgaggatcagaaacatgaacttatcctaggccagcccactagcaagtgatggaggcagcatttggactcagggctgcctgattccagacaaaaagcctccaaccataaagctatgctgccaattccacttggcccgggtgagtagctctgtctccagtctcctcaatactcagattctagagccttagctgtccaggtgataacttcaggccggttaatacctggggcactcagcacctgtgacacacagagttcaggaacctccttctatagacaggggtttcagtgccaaagctctctcaggcatcagtttgttttccgcctccaaggctcattgcagaaatatctgcttctgcttcactatcctccttaccactcttttccactcaaaacctccaatttcctcttctccaattacacccaacagagggggctcacatttacctagaaccaaaattcctcttcttccaagaaaatgttcagtgcctttgttattttacaacatggatattcatgtctgctgtggcctaagagaagcagagttgcaataatctctgggtggtgtcatgtagttgaccctcttaataacagcatttttaagcagttactgtgtctgaactgtgcttagtgctttgttggcattagcacctggaactctcccaactactgtaggctgtaggtattcttagagccccatcttacaggtgaggaaactaaggcacagtcatacagcaagcaaaaagcaaggagtgaaaagtagcagagtaattggagaatacgaataaaacaatgctattctcccctgcaagtcggtgctgagcagatagcctctacttgagcaggtcttcaaaacatgagccagccttggggaaacaggcactctcgtttattgctagtggaatcgcaaaaggctactatcaccatggaggataatttggcaacatctatcagaattacatatgcatgaaaagttgacccagaaattccatttctagaaatttatcctaaatatatgtaaaagtatatgcacgtgcctcatgcaagtacaagtttattccttacaatgtgtttggcctaagaaatagttggaaaaaatccaatgtccctctatagcagattggttaaataaagtatggtacaacctacaacaggtagtatggggctggaaataaagaatgagggagctctctatgtgctgatttggaataatctccaggatatattggaaaataagaaacaaaagcaaaagacccacggctcaaaactgtgtgaaatgagtcaaaattagtatttgctgatatatacaaagaaaccctgaacaggtacataaaaatgatcatgacgtcagtgattacttctggggacggagcactgtaggccaaaaaagacagagaaagaaggaagggttttcgctgtattttttttttttttactttttactttttgagccatatgaatgtattatctatattccaaaaatatagaccaggtgcagtggctcatgccttgtaatcccaacactttaggaggccaaggcaggagggttgcttcaggccaggagtttgagaccagcctgggcaatagagcaagaccccatctctacaaaaaaaattaaaaactagccagtcatggtggtatgtgtctgtcgtcctagctactcaggaggctgaggtgggagaattgcttgagctcaagagttcgaggctgcagtaagtgataattgcaccactaaactcctgcctggatcacgagcaagaccctggctcttttaaatgaatgaatgaatgaatgaatgaatgaatgaatgaatgaaaatgtgttcacaaaaggaagtcatcctgagtttcaccaattaaaaaaaggtatccagagatcagatatttctacatcagattttacacctctcccaatcacaacacccattcttaagtggaaaattagagctagatcctctaaaaaattttagcaaagggaacatggttaaattcctattttgtacatcagatgcttttaagtagctttacaaccccctccaaatgctgatattactgaaatgtaaatgattatgttaatagcagctgcatcttaataattgatgatctgtttgcttaacattcagttattacttgatgtaagaagtctctagtgcaaaatattctctgctaatggcccaaataaaattgatcacgtgaggtgaatggtttgtttttcacttttcctattcaaacaccaccgtgtgtgctgagttctttatctgtagataagaatatttcagaatatgtacctgtgacaatgcttttggcccacagatgaaaactgtctgttaggaaaataatgcttgcatcctcaaataaaatggaaaagcctatcaccacttaactcataaaagtttcaacccttaggattattcacagaatggtcaaatcagaagttgagaaaacaccatttagataagaaatatggagagaagtttccacaggcatccaaagggatggtttatgcattccgagatgctatccaggtgtttcagtcctgaagttcttctctgaacctctgtctccccacatacatctgcaaggccacccttagacctgagcaacaggggctcctgtcctgggccactcagtcacctgggacctggacctagccctgacaaaacgcattgattactccaaacacccaccctaatacataacaccattcaggccccagagaagcactgcctcccagatcttgatctctgtcctcaaaacaaaaggcaactgtgcccaaacaccttgaaggttcatgtgcagtactacagcctaaaggagagatgggtactgctctggtgtgcaggggtcacaaaagcacttaggaaagaaaaggacaaattaacttgtcaaatatttcctctcaaatagagtgggtaatagattcttgcagagcagaacataatttccccatagtgctgactgcctgtttcttgcttctctttgtgttctaatttgtggttctagaatcagtatggcatttttgacagttgcatattacggccacggaaaatgttgcagtagaaagaattcatggccaggtgcggtggctcacacctgtaatcccagcaatttgggaggccgaggctggaggattgtttgagcccaggagttcaagaacagtttgggcaacatgatgaaattccatctctacaaaaatgcaaaaattaaccaggcgtggtggtgcacacctgtagtctcagctactcaggaggctaaggcagaaggattgatagagctcagagggtcaaggctgcaacgagccatgattgtgccactgcacttcagccttggcaacagaatgatgccctgtttcaaaaaaaatgtactcttaattatgtatattcataaatctggccataatactgaatgactcttgaaactgacaactgaacagacatagaaaactagaattatgaatagtttttaaataaaaatatgtaataagatctaaatcaaatttcaaaaattaaatttcaactttcatttttttaattgtttaatatttaattgttaatactaacataattttcattgtaccttttaattgtaataaataatttcaaatacctaaagaaaaaataatgttttgaaaacatatacgaaaaataactttaatttttccattttatctttactatgatatactttcttggtgaaaatatatccaaatagttttaatccaataatattttattttgtaatgactaaatcattgctgtcaatagaagcaaattggtagaactcttgattataaaaacattattggctgggcacagtggctcatgcctgtagtcccagcaacttgggaggccaaggcgggtggatcactggaggtcaggagtttgagaccagcctggccaacatggcgaaatgccgtatctactcaaaatacaaaaactagccaggcatggtggcttgcacctgtaattccagctactctgaaggctgaggcaggagaatcacttgaacgcaagaggcagaggttgcagtgagccgagatcatgccagcctgggcgacagagtgagactcggtctcaaaagcaacattattagtgactttgataaaattaaagccagagaaagaaattttatgaaatatctaatttgtgaattatatgtgtcttttttcttttattcatccaaacattgccagccagtccaccaacagaatatccaaaaataacaggggtttaattgagtgatgtttgatattgtgtcaacttccagtaacattagagctaaaccttagctctattgtatgttttaatcttatcattatggagttttgccaaggtaagaggatatgacatatattggtttatgcttaaatgtgtaaacatacagtacacaagcctccattttttttgttgttgttgttgtttgtttctttgtttgtttgtttgagatagggtcccgctctgtcgtataggctggagtgcagtggtgcaattcggctcagtgtagcctcaacctcccaggctcaagagatcttcccacctcaacctcccaagtagctgggaccacgggcatgtgccacaacgcccagctaattttgtttattttttgtagagccaaggtctcactttgttgcccaggctggtcttgaactcctgggctcaagcaatcctcccacctcaacctcccaaagtgctgggattacgggcatgagacaccgtgcctggacagattgtacactttaaatgagtaaattgcatggtatgtgaattacatcgcaatgctgtaggaaaaaagagagagagagaaagaaacaaacatccgcaggagaagcaaggataatcaaatgattttgtctttgttgtaggtcggggggccgcccaactttgtccttggcctgattccccgctggctgtctgcctcctgatgtcagaactccccaccctgggaagaggggaaaaaactccactctaacctcaccacaatttaacagaaaattaaactgaaatatgtgtgtgagcattaaacctagcccagcacatcatctcccgcagattaaaaagagccagcgaaaatgaaatattgttctctaagctaatatgtaatcttcatagacaccatcttattaaagtttgagaagccatgccttgagggtaagcccacctatcgatttacgggcctggctggaattcctgctattaggtctctcatatttgttttgctccctgtcttgatgccagcactgtctacctccacctccccactcccaaagctggccccctgtaactctctaaaatctccctccttggactaggggtggggaccactttccctgccaacgtcaggcctgtgcgtattaacggggccgtgcgcttggatttgatggaagtggcagcttagacacataagctcctcatatacagatgaataatcacagataaaaactactttcaaatatgattaggctctaacagagacagacagaggccagagggaacgcagctctcaaagagcaaggagctaccggcatccgaagcccagaataggagattaaggcctctacaagaacccctgggactttcctagggaaaatattacagtgattcgcagcatcctctgctcctcctctctttcctcgggacaccgtctccccgtcctgaagctttgtgctatttctttccgtgggctgtcatttgcctctgggaacaggacagctcttcccgctgtgacttctcgactctttaatccaggccgcctgtcacggaaacgcacgtggaaatccagcagggtttttatttaccatgctttcttctcacagatgataacatgtttctttactgacaggcgtgcttgttgcctgtgtccccactgtatcccaaccccatgataacagctaaaacacgagaactatgtaccagctacttcaagccctttcaaaatattagcttagtaaaccttcatcataatgatatgagctacaaactatcattatcccattttacagatggggaaattaagccacagagagggtaaggaatttgcccagtgccacacagctagggagtagcaaagttgggatttgaacccagacatcctggcactaggaggcccaatccttaaccatgaagccatagagtctctcaataatgactatgtctcgtatgtcaactacatgttaggccctgttctgagagatttgttgcattaacacattgaatcctctcaaaaagttgatgaggtagatatatttattatccccatttcacagatgaggatactgaggctcccccagaagagcaggaattttgtattgtctgcctctattctgtttctggactgatgaatagcagttccttaaataccagagtgaatgtcctcccatcaaccactacccttttcccaggagcttctcaggacatttatttatagctaacctattttgggaaaagatttgaggcatgtagggttctaattctggctctgtcacttatgagctgtgtgactttgggcaagtcactcaacctctctgggcctcactttgctcagtttagaccagggataataataaagcccacatcaaggagctggagtgaggattcaatgagatagagcaggtaaggtgtttagcatctgtgtggcacagaacaggtataaatgctggctgcctttactgttactactgtcagagctattgtttaccactgctacaggccaaaatgagttttaaaggggtgaaaaaatacaataaggggaaataagggaactaagttcttgaaattctttctgaactggtgctagggttcccatcctcctggttttcctacctaaccagctgccccttctgtgtcccctaatgcctttcccaatcctaggtctcctctatctaagggatcttatcccctcttgtgatttaatcagctatagaccaataactctcaactatctccaggctcgtacctcctacacctgcctactccatgtcactgagatgtctaacaggcatctcacacagggcatgtatccatcataatacagttgttgaggcttctttcataaaccgaggcctctgagggtcttcccccaacatggctcccacccacagattattcagcctcgagaccttggagtcatcctcaactcctctctttccttcccatccacatataattcaaaccctgggagttctaccttcaaatgtatatgccagctgcaaccactcctcaccccttctgctgacaccacatcatttcttgcatcagatgactttggaagtccccttgctggtctccctcttccactgtgaccaccccattgccaacctactcctgccacagtagcaggcagaatcatgttaaaatagaaaccatcttacctcctttccattccaaagactgtcatggtttccccccacacttaggataaaatcctagctcctccttaggacctacaaagcccaacatgccctgggtctgtcatctctgaccattctcctcctctgtccagcaaccgagatcttcttgctgtctctgaagcaagccacagggactgcactgtcccctccctctgcctgcaacacccttccccacgctttcttcctggtggcttcatctcatcattcttctcttgctcaattgtactttcttggggaagatgattcttacatgaatcaattattattagtattagtatcatttgaaacaaagtcttaccctgtcacccaggctggagtacagcagcacgatcttggatcactgcaacctccaccacctgggcttgagcgatccttctgcctcagcctcctgagtagctggaaccacaggtgtgcaccaccatgcctacctaattttttttatttttagtaaagacgggtttcaccatgttgcccaggctggtcatgaatcaattattacaatggggcttgaaacatgatttttattttattatttttttttagagacagggtctctctctgttgcccaagccagaatgcagtagcacgatcacagctcactgcagcctcagcctccccaggttcaagcgatcctccctcctcagcctcccaaatagctgggactataggtgtgtgctactatgcctggataatattttttattagtagtagtaatgagggtctcactatgtttcctaggctggtcttgaacttctaggatcaagtgatccatccacttcagtctcccaaagtgctgggattacaggcacgagccaccactcctggccatgatttttaattctaccgatccttttacaaggattagttagctccctaactaagagctttcctccttcacttctccctttctctttagacacactattgactcatgggtttttatttctccagtgtgcgacattcagttacatcctttttaccaatgctcaaattgcccctaatttaacctgaccattctatttaaaagagcagcccctaggcttcaactcagtcattcagcattccagcacccagtttaattatttttcatggaacacatcatcatgtgtgaaatgatattattcatttacttctttattgtctgtctctagtcaaatattcattcatttatagtaagcttcatgtggccaaagatattgtcagtctcactcactgtgatattcccagaatccagaatcatgcctgttacagagcaggaattcaataaatatgaagcaaaattaagatgaaaccaggaataatgcccctagatcagggactggccaactccatcccacagccccaatctggctcgcctcctattgtaattttttttttttttttttgagatgaagtctcgctctgtcacccagactgggatgcagtggtgtgacctaagttcactgcaacctccatctcctggattcaagcgattctcctgcctccgccttctgaatagttgggattacaggtgcatgctaccatgcccggctaatttttgtattgttagtagagatggggtttcaccatgttggccaggctggtcttgaactcctgacctcaactgatctgccctcctcagcctcccaaagtgctgggattacaggcatgagccactgcacctggcctgttgtaaataaatttttattggaacaaagctctgtccattcacttaggtatttcccctggctgctttcactaccacaaccaacttgaataattccgtgagagaatgtatggcccacaaagctaaaaatatttactatctggccatttccagaaaaagcttgccaattcctggtctagatcattccaagtgctaaatagggctgacccttcaggatcctattagcatagggtcccattggagccattcaacaagtcattattcatacatttattcaacagatatttattgagcacctactatgtgctgggcactgtgctaggtgttttggatatttacagggatgaacaaaattaggcaggcttcttgcccttatggagctcagcttctagggagggtaggggagactaatataataaccacattaaaaatgaaaaatttccgttgtgatgagcccttacaaaaagaaccttatgtggtactttgagaacatttgacagcagtattttgtccaaactgggatggggaggacagtctaggaagacacccttcaggataggaccccctagtgaataccagaagtgtgagaaggggttagccgggtgaggcagagagtgatgtgctccaggcaaggataggacagagggagcacggtgcactccatgcagtgaaagatggccagcatggctgacctgcaacaggaaagaggagaatgtccaagatgactccagggaggtggccagggccacagcatgcagggccttgagagcacctaagagcagttgcataatgtcctgctctcagggcagctgatgcttgagtgggggctcaaatgatgagaaagagccacgcaaaggaagaccacagagaggcgtgttccagacagagggagaagcctgcatattatgcactaattccagaggggaaatgtacctttgcaatggagaggtctggtgttatgtccctagccaagggctcaaacttggcatcaccaagtggggagcaaagaaatacatgtttcctggcatgatgcaatgtgaaagatatggcatcaccttgaaggattcttgccagaaatgtttcaccccaatcaaatcaagcctctgaaactaatcttcaggacagaagaaatataggggagagaggaacaagttcaataacacccagaggaaacttcggacaaatccaaatgtgggacattctacaagacatctggctgagatttttcaaaagtcaatgccacatgctgcaactttaaaaggaaggattttaagccaatttcatttaaaaggggaagtgagtttggtgttatcctgtggaccaaatctggcccactacctgtttttgtaaataatgttttattggaatacagccatgttcacttgtttacttactgtccatggctgcttttgtatgaaaagagcagagttaagtgactgcaacagagatgatatggcctgcaaagccaaaaatatttgctacccggccctttctagaaaatgattaccaaactttgttatagatttagactaaaaacacctagtgaccaaatgcagtgtgtaagccttgattatatctgggttcaagaagaaagctataaaaatatttttgggccaatgaggaaagcatgaatatggactatatattaaataatatcaggctctattgttcattttctcaggtgtgaaatggtattatgattatgtagtagaagttcctgttcttagacaacgcacactattatttaagagtgaagtaccatgtaatctactttcaggtggttatatacatacacatgcatgcacacatggcaggtggcatcctcagttacccctcaactcatgccaatatttccaaaatatgacatgcacactgctggtacttcctgggctgtttttaggtggcagaagacaggttttattttatttttatttttttcatttactaaaaccaaagaaaactttaatattaggctgggcacgatggctcacacctgtaatcccagtactttgagaggccaaagcaggcagatcatttgaggtcaggtgttcgagactagcctggccaacatggtgaaaccccgtctctactaaaaacacgaaaaaaatagccaggcatggtggcacacacctgtaatcccagcactttaggaggccgaggcaggcggatcatgaggtcaggagttcaagaccagtctggccaacatagtgaaaccccatctctactaaaaatacaaaaaattagccaggtgtggtggtgtgggactgtaatcccagctactcgggaggctgaggcaggagaatcgcgtgaacccagaaggcagaggttgtagcgagccaagatcacactattgcacttcagcccaggcaacagtgtgagactccctctcaaaaaaaaaaaaaaaaacaaaaacaaaaacaaaaaaaaaacctttattattaattgctaaaagagtagattttaaatgtcttcaaccctccaaaactaagtatgtgaggtaatgaatttttttaacttttactttaaattcaggggtataagtgcaggtttgttacataggtaaacttgtgtcacgggtgtttgactatttcatcacccagtacctagtactcattagttatttctcctgatcctctccctcctcccaccctccaccctctgaaagggtgtgttgttcccttctatgtgtccatgtgttctcatcatttagctcccacgtataaatgagaacatgtgacagctttcattttaatagttatgtatttattcttctgattagtttccatttctgataagtgatactggcttcccacttattgtaggaatataaggtcttcatttcaaataaatatatttaagtttaaagcaatatgagccaactaaaaaggaaatatgaagcagacactattataaggcaaggcaacaaccaagaaaggctgaatttggataaccactttgccttcaaagcattgatcatagtccatgattactttgttttttgtttttttgtttcttagatacaggatctcactctgtcacccaggctggagtgcagtggcgtaatcatagttcactgcagcctcaacctcctgggctcaagctattttcccaccccagcctcccaaatagctgggacttcagggatatgccaccaccatgcctggctaattttttctgttaggtagagacggggtctctctatgtttcccaggctggtctcaaactcctggccttgagccatcctcccacctccacctcccaaagtgctgggattacaagcacgagccatcgcacccagccaaagattaccttgttttaataaacaaaaacaacacctgtttactgtccattcttctctcattggattgcaagctaaacaggctccttgatgctctcatgtgatgtcacataccagcatagtgcccagcatacaacaggcaatcaatacatgtctgaaggcagagtgatgaaagtaccatccccaaccagaatccctaccatctgaccaagaaacaactatttgcaggtagggtaagaattactcatttccctccaatcacaggatacataatgacagttgattcctgaaacacaagataatcctaataactatgcacattttaacatttctaaataaaagttcaagctggctgggtagggcggctcatgcctgtaatcctagcattttgggaggctgatcgcttgagctcaggagttcaagaccagcctggacaacatggtgaagcttcgtctttattaaaaatacaaaaaacttagcaggatatggtggcacatgcccgtagtaccagctactcaggaggctgaggtaggaggatcgcttcagcctgggaggctgaggttgcgatgagttgagattgcgccactgcactccagcctgggtgacggagttagaccctatctccaaaaaaaaaaaaaaaaaaaaaaaatctgacaaattactgaataagacatatgaggactctgtgagactttctacatagagacatttgcagatccaaaaaaagcattttgtctaaggctacctggctgcatttctgaatgagaggttaccattcctgcatttttctttcaggacatataatctctgcatatataaaggacccatccctggccccatgctcctggggcagccaagattccaggggggagctaaaacacatctactgctgacttcgaggtcaaactctcccaggtaaatgcagaccactaggaaagatgaggaccactaggaaatgcctctggatttcatttttttccggcatcatcatgagcctagagatccagactgcttccgacactccattcttttatgtttagtttcctcttctattttctttaccaatgcaaacttttgaagaagatattgctttggggaggtttataagagctgcaaagatctctattaaccatcctttaacagtgagataaagaccagctgtttcactaattgcccttaactgcttgggcttggttattaatgaatgccctcgccttgagttcaaacagcttaattagctaaagttaagtgtttccaataaatttactaacctatgataagctttcctttaataggaaatgtgcagttcttaattaaatagaataatttacaactccacgtctattataagtaatggttgcccagttaccatgttacctaattaggtgatagtgaagtttctccaaaggggaacggagggttacagttgaacatgcccttggacaaaccaatttgttagcagctcaacagtagcggagctatgggcagcctctggcactggcatctgggttggaatgtcctctctgccatgcagaagggtccggctgcctcatctgtaaaatggaaactaactccctgaggggcctctcgggagtagattggatagcatttgcaatcatttaaatgaagaataaaaagacaagttaatacccccatttaatacctctaggggctaggcctggtatatcatgcctgtaatcccagcactttggaaggctgaggcaggaggatcactcgaagccaggagtttcagcctgcacaacatagtgaaaccacacgtctagaaaaaaaaagaattatctagcagtggtggtgcacacctgtagtcctagctactcgggaggctgaggcaggaggattgcttgataccacgagatcaaggttgcagtgagctatgattgcaccactgtactccagcctggggacagagacagaccctgcctcttatacacacacacacacacacacacacacacactctctctctctctctctctctcactcacacacaactctagggtcacatttcttttattttatcttatttttttagagacagggtcttactctgtcactcaggctgaagtgcagtggcatgatctcagctcactgcagcctcaaactcccagagtcaagccatcctccacctcagccccccaagtagctgggactacaggtgtgcgccaccgcgcccagctaattttttgtattttcttagagacggggttttgccatgttgcccaggctggtctcgaactcctgagtccaggcaattaacctgcctcagcctcccaaagtgctgggatacaggtgtgatccaccacgcccggcgggtcacatttatataggcaaaattattccaagaggagattagtctggataacacacacaaaaacaaactgctccagcataatctggagaaggcatccagcaaacccagatcggggaactttctacaggatacctggccagcacatctcgaccatcaaagccataaaacgtaggccgggcgcggtggctcatgcctgtaatcccagcactttgggaggccaaagcaggcagatcacctgaggtcaggagttcaagactagcctggccaacatggcaaaaccctgtctctactaaaaaaatatataaaaattagccatgcatggtgatgcatgcctgtaatcccagctactcaggaggccaaggcaggagaattgcttgaacccgggaggcggaggttgcagcgagccgagatcacaccactgcactccagcctgggtgacagaacaagacaccatctcaaaaaaaaaaaaagctataaaaaataatgaaaaactgtcacagacaagaaatgactgaggattcatgccaacaaaatgcagtgtggcaccctggattggatcgtaaaacagaaacagaacatgaatggaaaagtgaaagccatataaactctggaggttagttacaagcaatgcgccagttcccatctctgagtttagacaaaagtaccatggcgatgtaaggtgttagcagaggggaaactgtggtgggggtcaggggaggatttagcagtcaggttaagcaggtcatactttgaattttgccatggttgaggactacatttaatccaggcagagtgatttcaatagttcatctgaaaggatatcagctattaatgaggttggttattattatctgtctaatggataaaaccttattagacctagaagaataaaaaattatttgctcaaagtcacatcactggccacgtgcagtggctcacatctgtaatcccagcactttgggaggctaagacaggaggatcacctgagcccatgaattcaagaccagcctggtcaacatggacccagtcactacaaaaaatacaaaaaaaaaaaaaaaatagccgggtgtgttggtgcatgcctgtagtcccagttgctcaagaggctgaggtgggaggatcaattgagcccaggaggttgagactgcagtgagctgtgatcgcaccactgcactccatcctgagagacagagtgagaccctgtctcaaaaaaaataaaaaaaaaataaataaataaaatcacatcactattataagtatcatttgcatatcataataaattccaccatcacatatttgggcagagccttgaacattttcaaaaaagctttcacatcatccagtgaaattatcacacaagctgtattagtccattttcatactgctataaagaatggcccgagactgggtaatttataaaggaaagaggtttaattgactcacagttcagcatggctggggaggcctcaggaaacttacaatcatgacggaaagcaaaaaggaagcaaagcaccttcttcacaaggtggcaggaaggagaagtcctgagcgaagaggggaaaagagccccttataaagccatcagatctcgtgagaactcactcactatcatgagaacagcaaggaggaaaccacccccatgattcaataacctccacctggtctctcccttgatatgtggggattatggggattacaattcaagatgagatttgatttaggtggggacacaaagcctaaccatattacaagccctggaacaacaataagatggaattttgatctccatttatctgatgaagcccaggtaatttgggtttttttcttcttctcttttggcttaatccattctccctccacatcagaccacccttcctctttctgttaatcctcattgacaatttagaatacatccttccaaatttgtctctatactcataaatcacacacaaatatatgtattcacacacagtatataatacataggcatttgtcattttatgcacgcttccgcagctcccatttcctcattctgcaatatgccatggaaatccctccaaggcatctggtattgctctaattcatcgttttttaatagctgcagaaaattccatggtgtggatgtcctgtaatttgttcaatcattaatgggcattcactcgtttctccctctttggctactacaaacagtgctgcaataaacatcctttctacaaacatccttatgtaccatggcctttatgtctacgagatagaggcccaggatggggattacggggtcaaagagtatatgtatttctctttaactatttttaaaagagcaaagcaagagaacagggtagtagatacctctagagaaaggcggagaaggcagagaaagtggactagagagaagcttgcaggtggcttcaacagtattggtgacgactgcattcttaggttggaaatgggttcattttatcattattctatataatttatgtgtcttattacctatattatttgctatatatccagtcctatataatttccaaaaatctatatattttatgttaataaatgtggccaaaacacagctgaaataattctcattcccatcaacaatataggtgagattggtcttttccattttttttcccagcctgagagggatatctcactgttactttaatttacatatctctgacactggtgagtttgaacatctttaataaatgtatcattcatttcaatgaaataagtgacattttaaatcatctacaaaccctttcccattaagtaaaaaggggaaggctgatcttcactccttttcatcttacccctctaaaagataaagctcagagtttttaaatgccacaacaacaaaaaatcaacatgaattggttctcttttatctaaagttcaagatgccatgacgtcaaaatgcatgatgacatgcgctctcctcagggaaatccccaactggaacctcaaatcccctaaaactctgggcacaaatgtttctttcctatgagaatcaatgagactagcaggtcatggccgttggcaaggtgactgtgtctttttcagaataagaggctacctggacgcattgtgggagaacatgcaaccttgtccctatctagcctggctggtctcctaccctcccgttttctcttccctcccttacaggtccttaccctgacctgtaagttgacattttgacaaaactagaatcaagctcaactcctgtctctgctccttccttttctcactttacagcccaccacagacatgtctttggaaaaatagccagagatctaatttgtttttaatagccacataacatcacatagtatagctatatcaaattttatccagtcatttgctgttgacagacagtcaggtcgcttccaaaatgctctggttttcatttttgcaaacagcgtggtaatatattttcttgtatgtgcatcttttatcattctagaccagattcttcccccttcaactatatatatttaaccttttcaccataccttcttcgataccaaatgtatcgactttttttttagttggttggttggttggttgagtttctttggaccaaatttaaggggttgagaatgaaagggggaacttcactgtagtactagcttccctatctatcctctacataacagtcacttgtaattttatagccagaacataatttgtatagtttcccctccttctgatcaactgatttagttgttctttttcctccattctgaaattagctattacagagccataatataattttttaaatttcaaatcctctttaaacaattgatttcttgttgctatttgtaggcaagaagttgaatctgatatgagccctgccagaaattaatttacagtgttagagaaggattatgacatatataaatgagtacaattttaaaaaggtaaatatcacagtgtaaatacaaactcatgggattcagagataagggagatctcattttagacagagagatataaaggcaactggaaagacttggctttggagttagttaggccttgggacactggtccaattttgacatatggaaatagatggaaggaaaagaattagaaaagaacagagcaacaatgtatctttatgtgacattatgatttataataagaaatatatatatctttatctccagttcctggcagatagtgcctaaatcccttgcaatttcctgggcaatagagatgttaggagcatcttttgttccaatatttggtctttaaccctggttcctgccacagagttcctaatcccttgcaattttctgagtgatgggagcatctcttgttctaatatgggaactctcaatggggcttctgggtgggggctggtcaccagaaagaccaagccaagaatagaagcttggaactttcatccccactcccatcctctgagaaggatggagagaggctggaaattgacttaataatcaatcatacctatgtgataaagcctccataaaaatcaaggggtttgaggagcttctaggtttctgaacacatggagggtgtcttacccatacaggatgtattagttcatttttacactgctaataaagacatacccaaaactgggtaatttataaaggaaagaggtttagttgattcacaattccacatggctggggaggcatcacactcatgacggaaggcaaaggaagagcaaaggcacattcttacatggcggcaggcaagaaagcaggtgcgggggaactgtcttttacaaaaccatcagatctcatgagacttattccctatcacaaaaacagcatgggaaaaacctgcccccatggttcaattacctcccaccaggtccttcccacaacacgtggggattacgggagctacaattcatgatgagatttgggtggggacacaaccacactatatcagaagacatggaatctccacagcccctctccccataccttgccctgtgcctcatctttttcatctggctgttcatctgtatcctttgtaatatcccttataataaatgggtaaacattaagtatggtgatttcctgagttctgtgagccactctagcaaatcattagggagagggtggtgggaacccctaatttatagccagttggtcagttccagaggcccagacttgctattggcatctgaggtggaagcagacttgtgggactgagtccttatcttgtgggatctgactccaagtatataatgtcagaattgaactgaattagaggatacccagttggtacccatgggagtactgacatgtaaggaaaaccccacccatatggtcacagaagtgcatggagttgagtaagtgtagtaggaaaaaacagtcaatttgcttttttttttttttcctactacacactttcctttttaaatttctggccaggaataaaatcaaataaccaagaattacaaatattcattgattatgggtgactactgttgaaatgcatgcagggtaggacatactccatgaatacattacaaatgcattcatgtcttcattttctgagatatcagtcatttcataatgacagggagataaaataaggcatgactctgctgggtgtggtggctcatacctgtaatcccagcactttgggaggctgaggcaggaggatcacttgagtccgagagttcaagaccagccttagcaacatggcgaaaccctgtctctacaaaaacacaaaaattagtcaggcgtggtggcacacgcctgtagtctcaactactctggaggctgtggtgggagaatcgcttgagctcgggaggtggaggttgtagtgagccaagattgcgccactgcactccagcctgggtgacagagtgagaccccacatcaaacaataataataataataaggcatgactcattttcttggtctagctagattacggcgttacacaaaagtaaaattagtgtaatattaaaagaatcaagaaaaaagctaaaacttgtttcaatgaacttcattcattcaataaatactagatattgtatgtacaagaggcaacatggtgagagagacagcaaaaccaccacgcagaatgaggtttatagcccaatggggagcttgggaaagcttacagagcaataaaattaaagtttgtcaccacatcccagtcttcatttctcactattattctccaggaaccatggctccttggagaaatggctgtttgtggtctgggacagagaaaatacaagatgagcctgcagcatcttgtagtgatgaaaagtaaagacgtgctttaaaaaaacaaggggacgggccaggcacagtggctcacgcccatcatcccagcactttaggaggccaaggcaggtggatcacttgaggtcaggagttcaagaccagcctagtctctttagtagagatggtgaaaccctgtctctactaaaaatacaaaaattagctgggtgtggtggcagacacctgtaacccagctacccgggaaactgaggcaggagaattgcttgaacctgggaggcagagtttgcagtgagccgagatcgcaccactgcactccagcctgggtgacagagcaagactctgtctcaaacaaacaaacaaacaaacaaaaaaaggaagggacagcttatcacaggaatgcaaggcccaaaactcactatgattaaagctggaacaatttgagcaacaaaataaataacacagtgtaaggttaaaacccaaagtataaaataaatgattgattgaataaattaatgtactggggtaaaagaggcaagtcttcctaacaaagaactttaaataatatctgtagacaccccacacttaccgattccactccttttgagtgtaagcgggtcttagtaactggcttccaataaatatggagtatagcttgagtctagaaaagggaaataggaccaggtgcagtggctcatgcctgtaatcccagcattttgggaggctgaggcagaggacagcttgaggccaggagtttcagaccagcttgggcaacatagcaagaccttgtctctacaaaaagtaaaaataaaaaaattagctgggcatcctagtgcacacctatagtcctaactactgaggaggctgaggagagaggattgcttgagcccaaaggtcaaggctgcagcccagaagggcttccagccaaggccttcctggctcttttttccttgggatgggaggccagggaaggtaaaaataactggataatgttgctagaatcacaccactgcactccagcctgggtgacagagtgagaccatgtcaaagaaaagaaaaggaaaagaaagagagaaggggagagagagagagaaagagagacagaaatgaagaaagaaagaaagagagagggagagacagagggagagagagaaggaaagaagacagaaaagaaagaaagaaagaaggaaagaaagaaagaggaaagaaagaaagaaagaaaggaagaaaagaaagaaagaaagtaaggaaggaagaaggaaagaaagaaagagaaagaaagaaagaaaagagaaagaaagagaaagaaagaaagaaaaagaaaggaaagaaagtgggaaggagggagggagggaagaagggaaggaaagaaagaaggaaagaaggaaagaaggaaggaaggaaggaaggaaggaaggaaggaaggaaggaaggaaggaaggaaggaaggggacagtggagaggcctggcagacactgctttaattccacaatcaaggtcagcatcagtgataggccatgttgatagcatgtacctctgtgcaattcctcctaaaaatccattattccagtctaaatcactaggaaaaactttatacaacccaaactgagcaacattcaacaaaatacctgaccagtcctcctcagaatggtcaagttcatgaaaaacaaggaaagactgaaaagctgtcacagaccagaggaggctaaggaggcctgagactaaatgcaacggaatctcttgcacagggtcccagaacagaaaaggagcattcgtggaaaaactagaaaaataaggtccggagttttgtataaaaaaaaacacataaaaaataaagttgagtagatgctatttttaaaaagtacaaggtgcaatgtgtctgctaaaaattcaaataataaaagttaattgacttttattattattttatatttattgtgtttttaatcaaaaaatgagctttgtactatatgcacattaaggctgggcgcagtggctcacacctgtaatcccagcactttgggaggccaaggcacgcagatcacttgagatcaggagctcaagatcagcctggacaacatgacaaaaccctgtctctactaaaaatacaaaaattagctgggcgtggtggcgtggtggcatggtggcatggtggcatggtggtggtggtgcactgcagcctgggtaacagagcaagactgtctcacgacaaaaaaggaccagttaaacaatacaggaagatacagagacaaacttaacccttcccctgcccaccattattctccagccagtcctcttctagataagcagtttgtgttgttttctacaatctctttgtgtttacgtgagaaacacagaatatatataggagcttttcctcttttttcacgttttaactacaaaagtattatcttactactcattgctctgcaactggcttctttcatgcaaaaatatattttaacactgtatcataaatatcttcccagcacaatgtatataaattgaacctgctctttctttaaatcaactttgctgggataaaatttatacagaataaaatgcacccatttgaagcatacacttattatgtatgcacagatgtgtagacctggataaccaccagcacataacttattatttttaaaatcaaagtcatcaatcatcttgccaaatctagtgaaatttcctggctcttctttctttggggtaggaagccagggaaggtagaaataactggataatgttggagaatgaccattgcaagactttgctcctcacatcccaggtgcatattccaagaaaattctgattccccgggaaaattctccatgcttggcatagtgctggagccatgtgactttggaaaggtctgagggaggcatttaggcagagactcagctggggaaatcactggggggccctgcaccaacagacaggcgcccagagctgaggaggaatggcagcggggcctgctgagttaagcagaggccacagacatcaccttctggaggctccctctaccactgctccatgggcaagcctgctagatacccagaaacaagacaaaagtgctacactgcccaggatttacttttaaagatgccaaggagggggctgggcatggtggttcatgcctgtaatcccagcactctgggaggtcaaggcaggtagatcacttgaggtcaggagttcgagactagcctggccaacatagcgaaaccctatctctactaaaaatactaaaattagccaggcatgatggtgcacacctgtagtcccagctactcaggagcctgaggcacgagaattgcttgaacctgggaggtggatgttgccatgagccgaggttttgccactgcactccagcctgggcaacacagcgagaccttgtctcaatcaatcaatcaataaaatgaaataaaaataaagatgccaaggagaaagtgtgaaccacagacttcctcccaagctgtcccttgaacctaggcaccatctgtagaagcaagacagaaaaggaaggaatagccccaaaagagagttgaatgtttaaaccagctgaatatttacctgaaaaaaagattgttttatgggagggtaaaatgggaccactcaaaactttaagagaccgagacatctctaattggcaagtttagctgttttccttgttccttggcaggacagggacctctcaggaaatttgatttggttagattgggactttgcaatagaattataatgcaagccacacatatactttcaaattttctagttgccacatttaaaaaaccaaaagctggccagtggctcgtctgtaattccagcactttgggaggccaaggtaggtggatcacttgaggtcagaagtttcagaacagcctggccaacatggtgaaaccctgtctctactaaaaatacaaaaattagctaggcatggtggtgcacacctgtaatcccagctactcgggaggctgaggcaggagaatcacttaaacccgggaggcggaggttgcactgagctgagattgtgccattgcactccagcctgggcgacagagtgagacccgtctcaaaataaataaataaattaattaattaattaaatagcaaaaactataggacccagaaatcccactcctagatatatacccaagagaaatcaaaacacatgtccacactaaaacttgtacatgcatgtttacatcaggattattccccagagccaaaaagagaaaacaaaccaaatgttcatcaacaaaatgtagcatataatagaacattattcagcagtcaaaaagaacaaagtacctatatatgctacaacagagatgaaccttgaacacattatgctaagtgagagaagacaaatgtaaaaaaccaaatattacagtatatgattccatttctgtgaagtgttcagaataggcaaatccaagaagacaaagattagtgtttgcttaaggctggaagggttggagaataattagaactgagaagagtatggggcttttttgggagatgataaaaatattctaaaattgattgcagagataatcacacaactctttgaatatactaaaaatgatcaaattgtacattttcaatgttacgtgaatatctcaatggagctgtaattttaaaaagcaaaaagatacatacagcattaatttataatattttaagtcaatgtattcaaaacgttgtttcgacatagtatcaagaatttaaaattatttttgagatagttacattcttttcttaaaatctagtgtgcattttacatttgcaacacatctccatacagatgctaaattttcattggaaatactatatagttagatttcataaaatttaccattgaaagagtaaattcatacgcacaagttgttccaaaaatattttaaagtcttccaacagctgaattgagtagtgttagtgaggtagtttctagatatagctgtagatataaatgggtaaatatagttattcagcacagatacatactcagagtatggtatgttaaaatttaactcctactgtgaaaatggaggtcattacgttaagtgaaataagccaggcacagaaagacaaatatcacatgttcttactcatatctgggagctgaaaagttgatctcatggaggtagagggtagaatgatagataccgaaggctgggaagagtgtgtgggtgggggtaatgaagagagtctggttaatggggacagacatacagttagatggaaaaaatcagtactgcagttcaacagcatggcagggtgactgcagttaacaacgatgtgttctatacttcaaaatggctggaagagaggatttgagatgttcccaaaacaaaggaatgataaatgctcaagataatggatatcctaaataccctgatttggtcattacacatgtgagacatgtaacaaaatatctcatgtgtcccataaatatgtaaaaatattatgtatccatttaaaaattaatctctactatatacaccaaaaacaaaactaaattcctcatatggcctcaaaaccctacaacatctgccctcacctcgctctctaatctcacatcatatcactctccttttcttccacaatgctctagccatactggtctttctactcctcattcactccttccccagggcctttgcacttgctattccctcttcccagaacaccttccaccaagatcttctcatacttggctccttcccatcattctggtctctgctcaggagtcatcatcctcagagagttccctgtcttgttcagtgtggtctccatccatcactctttaacccattattctctttttttgttgcatgtatcaccaatggattgtctccttgtggttacatttttggcaagaatattgtacaggcattgtatgaggaagcatatgatgatcagcttgattactcagctaagatggtgcccacatatttctccactctgaaggtgccttactatgaaataataagttatctgtggggaaatatttcaagactggtaccatacccttcccagcaatattccatattccatcttactctgtcacccaggcaggggtgcagtggcataatcatagctcactgcagcctcaaactcctgggcttaagagattcttttgcctcagcccccaaggacatgggactataggtacacaccatcgtgcccagctaattcttttttttaaattttttgtagagacaagctcaggctggtctcaaactcctggcctccaatgatcctcctgcctcagcctcccaaagcgctgggattacaggcataagccactgcacccaacaagagtttgagtttctaagtctaattccttctacatttattagttgacattcttcagtaaataagctcattcccttctctctcccttgtctttttttttaatatcagtataaattcagggattccatgtgttgttttccatttctgtcattattaatttccatgcttagattaccccagatttggaaagcccaatctgaatattttgaccctgattttcaagttggactcccttcaagctggctcctatatcattgcgacatgcccctgtcattttttcttaccactccatacattctgatgagaaaaaaaaatttaggtgtaccttgtagttttcctgccccagccctggaatcagccatttctccaatggctaactattaatgcacaatggtatttaagaaccaagatttgtcacacctgtaatcccagcactttgggaggccaaggcaggcagatcacgaggtcaagagatcaagatcatcctggccaacatggtgaaaccccgtctctactaaaaatacaaaaattagctgggcatggtggtgggcacctgtagtcccagctactcgggaggctgaggcaagagaatcacttgaacccagaaggcagaggttgcagtgagccgagatcacaccactgcactccagcctggcaacagagtgaaactccacctcaaaaaaaaaaaaaaaaaaaaaaaaaaaaaaaaaaaaaaaagaaccaatatctgagcattaggcgtgcccattcctactggtatgccatgcaccaaggaaacaaatgcactcataacaaacagggcctgggaagtcaggtccaggcaactgtgacatcaacaggattcaatattgaaattaagtcttattctccaagtggagaagacatttgttggttttagttgcccagcatcgaatcattcttctggtaacagcaccccttttttccttttggagaattacctctcccttctgtgaagagacatggcgaactgtaaattaaggtatcctaaccctctccccatatccaaaagggaggcactatttttctaaatcagacaggtccctgatttagggatggagtgagacaggtatgaggataagggggtttgaccacatatccagaattgacaaagccaagtgcccttcaaggtgaaactgaacgcccctttccaaggtctgttggcctctcatttggtgcaaggctttatctcacacagctaaaacttccctgtctttgtagaaaaattctaacacaacagagcccatcttgaatttctttccccaggattggttgtttcattcatcctttccaattcatagaattcagttgttttgacaaatgtctagatagctagcaatatattttcatctccttcgaaatcctcacaacagatatgctgcttgtaaatctgcgagggttttttttctgaggaaaatcttctaaaactttgctcatcttgtgtcaatccctgcagggtttctttatttgcctgcttgctggtttagtggggagaaaaaaaaaaaggctgaaatcctaattttcacaccttcaaaatgcataagctctgtctacctttcatttttctttctttgaattttttccctctttaagtccttgttttctttcttctccagcacatggtgttaggcaaaatggcagatatagatgaaaagatggaagagagggaagagaagggaagggaagggaagggaagggaagggaagggaagggaaggggaaaggaaaggaggggaagggaagggagggaagaggaggggaggcaagggaagggaaggatgaaggaaaggagaaaggggaggagggcaggagaaagggagggaaaggaaggaaggaaaggatgaaggaaaggagaaaggggaggagggcaggagaaagggagggagggagggagggagagaaaaatcaaagaaaaatgcttaacactccccaatgcttcataatgcaagaacacaataaaatattttgcatctttcaatgcctgggttttctgagtcatccaacactctgccattggacttgtttatatcaaaaggagttaatcgtcatgtaatgccattgttctgggggagaggaagacacagagaggcaaaaatgatgaatgccacttgtctctctaaatgagtaacaggggatttgaactcaatatgagctttgggaataaacgtggtaaacgtggttatttcagggttacaggagagaccaacaagcaaagtctaagggcttctttgcctgccctgcccttataaatctgaacttataggacaagatgggtggaagttgagtctcaggtgatgagttcagctatgtatggaaagaaataaagcagcatagggaggagatgttctgtaaaagttataattggtttttctgaagtttggagcaatagatgtacaatcaagggccttgcttaatttcccactcactaaaggcacttttagctcatcaaacatttactgagggtcagtgctatctgggaaggcaaaaataatgcagctctcaagtttttgctcataaacaagcaagggaaatggcaacctatcccctcacaaatgtaatagtttaggtttgtgttgtacaatgtttataaccaatggtatgctacaaactcttctaggtgcactgccaagtttgggtccttgtgcaaacgttattgtttgggttttttcatttgtttgtttgtttctacagctgcgggtacttactgctagtgattgttgtatgacttccgttgagttgcatgggtcatgtgagactgcaggaggtggagtctagttgagacaagtaaatacaagtgtagcaaaacatcaagagagccaccagaaaagaccatgtttcctacattcttgctactaaatgtgatacctgcagcatgggtatgacctgggagtttgaggaaaatgcagaatcaatctccagtcctgcgtcagacccagtgaatcagaaactgcactttagcaaggtccttgcatgtaaaaagagaggcagtatcttccagtatagaaaccctttctcatatggatgtataagagatcttcgtcagggcattaaacagcccaattgacatccaaggctcagccaaatgatttgtagataaaatgtaatatttgtattacattaatatataataatataatttacatttataatgtattttgtataacattaatatataataatataaaaaataatatatatataaaatataacctcttctagtgccttgctacggttcctaacgtgagagagaacaggcgcacattcagatagctgagagttacagtttacccaacgctccccttatatcaccacctttgagacttgccacatccctacaaggcaagtggtacaggctctagtgccacatccattttacaggtggagaaactgaggttctcagaggtgaagaaccggcccaaagtcacatgactcgaatgagatcccactgggacttgaacactgattgcctggcccaggaaaagagaattcttttccagctgactctgaaccagtgtaataaagaccaggctggttgtctgactgaaaagaaacggggttgggaggatgaggtgggaggatcacttgaggccaggagttcaagaccaatctgggcaatatgacgagaccccatctctacagaaaattaaaatacaaaaaatagccaggcacgatggctcacgcctggagtctcagctacgtgcaggttgaggtaggaggattacttgagtccaggagttagagggtgcagtgaggtaggattgcaccactgtgctccggcctggacaacagggcaagaccacatctctggaggggaaaaaaaaggaaaagaaatgttcttagtagcgcagtgacctatgctggtaagaaagcaggatttctctaatggggagctggacaaagtagataagctgacataatgcaggaagcttcagataccagatcctgagtgtggagctccatgaagaatccaccttcacattcatcaccttcctaggtacctggggggtgagacgaagtcatcagaccatcccactgaggcctagaaaccatccaggataacgcacctcccttaaatctaggacaggtgccttcttttgacaataatggccttttctctcctcagcagggtgactgaactctttcttcatctccaggagggactggaaaaaaaaaaaaaaacagatttagggcttcttgctgatataaaccaacttgacggaaaacccattgttcagccttgtttactcagccacctgctaacctgattgtggtcacttagggagaagttccccacagagaaactgaagagctttgcttaaagtaatcaacagagaccttgggggctcctacagacctcaggagcacagttttagcaactgtgcctaggaacctttttcctttggtcctaatcactcctcctgacatcatctataaaaccgcggagcctgacgggcttcagtaaaagggtccatgtggattctgtcatctggggcaagactggaggattcagggcactgtgtaggtaggtcaccgttttgtggtgacttgaacactgactgcaagtgtaatgcagcttcacccttttctcaccttcctcctggggccactaacttcatggggaagtccagggtaggacagcaagaagcagaattcctgggttgatgcccaattaactcaatatgtcactagcttattttggcctatcctcagggcaaattagaaagcaaaagtctcaagggacgtcttggtgttgattacctgacacccaagcattgacaagctatgttcaatgcattatgctactactactaataataacaggccaggcacagtggctcatgcctgtaatcccagaactttgggaggccgaggtgggtggatcacctgaggtcaggggttcgaaaccagcctggccaacatggcgaaaccctgtttctactaaaaatacaaaattagccggacgtggtggcacatgcctgtaatcccagctactcaggaggttgaggcaggagaatcacttgaacctgggaggtggagtttgcagtgaaccaaaattgtgccattgcactccagcctggtcaacaagagtgaaactctgtctcaaaaataataataataataaatataatttaagagccctcctgggcttgcagaattaagattggccagtgtctttctcatacacagaagcagacaattttgcatcattctgttcctcccattcaccccaatatcaattatgtcctatgctcatgtttcagaaaccagtggtatcagcaaagcagaaaccactctagatatttcaaaccaaggagttaggtataaggtttggagatggatggaagagcaattggaaaagtgggtgggtctgaggagcaaaaagaagacgtgataaccgtagatcaaaaactgctaatgggctgggtgctgtggctcatgcctataatcccagcactttggggggccaaggcaggatcgcttaagcccaggagttcaagaccagcctgggcaacatggggcaaccccatttctataaaaataataataataatttgtttaaaaaaataaaaataataaatttttagaagctgctaatgctcctaggctggaacccatcagcctccatctaacattgtgccattgaagacactgctgataaatcagctctgaatttatcagagggccacctccaccagggctagttctgctaagtgccgcctctgcctagaatactggaatctggaatcaccccacctctgttcctgctgtaactacagaaatttccctcaaatatccagaaaggatcacggctgggattcaagcccagtattgtgattctagaactcacatgcttaatcactacaataggacaaacaaacaaaagattttaatgtaagtataactgatagcttcaaagagctaagagcagatcatgtattctataaacaagaccaatctgacatggaaaagaaccacacctagttgcaacagggtgcaatttcagtgagaacagagtattctaaaaagttcctaagagaaaaaaaaaaaaaaaaacctcactaagggatgaagtagcagatcggtagcatattcctcgttggtaacactggatgctagaaggccacacaggcgttttcaactcggagactttctgaaagagcgtacgttgttgttgttgtggttgttgtcgttgttgttgttgttgttgttgtggttgtggttgtggttttggttttggttttgagatggagtatcgctctgtcatccaggctggagtgcagtggtgtgatctcagctcactgcagcatccgcctcccaggttcaagcgattttcctgcctcagcctcccgaagagctgggagtacaggcgtgcaccaccatgcccggctattttttgtatttttagtagagacggggttttgccatgttggccaggctgatctcaaactcctgacctcgggtgatctgccagcctcagcctcccaaagtgctgggattacagacgtgagtcaccgcacctggccagaaagagtatactttggaaaaacagacaaaatctaaaattgttttcagtaatattctgcgaggggagtagggaaggtgggaaagggttgaaattacctgttgtgtactatattcattgtttgggtgatggattcaatagaagctaaaactccagcattatgtaatatgcccacgtaataaacctgcacatgtaccccctgaatccacaataaaaataaataagtacataaataacattctgaaactaaagttccagatcatttcaacgtaggaaatagcagcagatggctaaggtagagaagtgaaaacatgctgcttgttcttttgctccggatgaaatcctaattaactctatactttgaaagaatagtatgtttcataatgtgtttaaaatgtcaaagataattgccaaagagacagaactagcgtgcattacttccaaaccactgaagaaaaaaaaatgcatcaaggaaaacataaccaatgtaacagggggaaaaaaaaaagcaggaaagaaaaagaacaaactttaaaacagggtaaatgaacatttctcaaaagaaaacatacaaatggacaacagggatatgaaaaaaatattcaatgtcactaatcataagggaaatgcaaagcaaaaccattacgagatatttcaccccagttaaaatggctagtatcaatgagacaaaaaataacatgctggtgagaatgtggagaaaggggaacactagtgcattgctggtgggaatgacaattagtacagccattatggaaaacagtacagagatttctcagaaaactaaaaatagatctaccatataatccagcaattccatgctgggtatatatccaaaaaaaggaaatcaatatgtagaaaagatacctgcacacccatgtttattgtagcactaatcataatagccagcatatggaatcaaactaagtgttcgtcaatggatgaagaaagaaaatgtagtatatgccgggcgtggtggctcatgcctgtaatcccagcactttgggaggctgaagtgtgcagatcacctgaggtcaggagttcgagatcagcctgaacaacatggagaaaccccgtctgtactaaaaatacaaaattagctgggcatgatggcgcatgcctgtaatcccagctactcaggaggctgggacaagagaatcacttcaacccgggaggcggaggttgcagtaagccgagattgcgccattgcactccagcctgggcagcaagagcgaaaatctgtctcaaaaaaaaaaaaaaaagaaaacaaaacaaaatataatatatatacacaatggaatatccagttagccataaaaaggaatgaaattctgtcatttgcagtaacaccaatgaaactggaggacgttaagggaaataagccaggcatagaaagataaatattgcatgttctcactaatatgtaggaccttaaaaagttcatctcataaaagtagagtagaagtatggttaccagagggtgggggggtgagtgaggggtgaagagaggttggttaacgggtacaaaaatacagttagaaggaaaagttctagagttcaacagcacagtagggtgactatagttaacaataatttattgtacatacacaaatagccagaagagaatatttgaaatgctcccaacacaaagaaatgataaatgtctgaggtgatgaatatcctaattgccctgatttgaaaagtacacattgtatgtacgtatcaaaatatcatatgtacctcatacatgtgatattttgcataattgatgcataataatatataattattatgcatcaatttttaaaacatggtaaattggaatttgaaatatcaggagtaaattcaaacttatcaataggcataataaacataaatgggttaaatttctctaataaaagacaatgcctttcagtttggagtgcttcttttaaaaaaaatccagttaaatactgtagacaagactatgcaatacaataaacaacaaataaaaacaagacaacatagaaacattgaaaacaaaaatgtatatcacaaaaattctaacaaaaagaaagcagcagacgcaaaacaaaagtaaaaacaaatttccctataatcattatctagttgtcactccagagaagtaggcataaaactggttaatgggagttggcaagataagtcagttaagtatttaagagactcatttttaaattcgatatggtggtggtggtggtgagtctgtgggtggtggaacacgtccatgaccagatctagacagtagcaacagccatcaatgtctgtcactaatctcctgtggattttagatctaacataaagattgcatacggctcattctggagggatgaccagaagtgacaagctaaaggtcctcaccctgaaagtggatgcatctctgtcttctgagaaacttagatcacaggacatgagccatagataggcataaaacctggaggtataaaactttcaggccttcgcttatgctgttttctttgcttagatgacctcccactgcactcatttccacctgtcaaaatcctccttatcctttaagaccacctttttcatgaagctgaattttacccttaccaccagagtggtttcccacagtactcattttgtgtctctctccagacattcactgtactctctattatagattgctttatatttctgtgtatctctttatataggctctttaaagatgcattagtcagctattgccgcataacaaacaactaatatttcagttgtttacaatgacaaacacttctgaaaactctcagtgatcagtaggatgactgcaatttaactgatctaggcagggatcagatgggcaggtctacctcatgctgtgggaaacctgcgcttagctttaggctgtgtgttaaattcaggtctgcctcacatatttttgctgtgactctcagactaaaggagaaaccgctatgcagagtgtgttcttctcatagtggatcaggagaacacaagaacatgaactacagcacaaaaagcacatgtgaggcatctgtttgcatcatatctgattcatgttccttggccacaagtcacatgggcaaacccaacaccatggggtggtgctatagtttggatatttgtccccagccaaatctcatgttgaattgcaatccccagtgctgaaggtggagcctggtggagttagtttgggtcacggggacagatccctcatgatttggtgctgtcttcacgatagtgagtgagttttcatgagatctggtcatttaaaagtgtgtgggctacgcacggtggctcacgcctgtaatcccagcactttgggaggccgaggcgggcagatcacaaggtcaggagatcgagaccagcctgaccaacatggtgaaaccctgtctctactaaaaatacaaaattagctgggcgtggcagtgcgcacctgtaatcccagctactcgggaggctgaggcaggagaatggcttgaacccagaaagcggaggttgcagtgagccaagatcgcaccactgcactccagcctggtgctggagcgagactctgtctcaaaaaaaaaaaaaaaaaaaaaaggtgtagaatcttacccacactctctctctcactcctgcttttgccatgtgacgtgcctgctccctcttcacttctgccatgagtaaaagctccctgcggcttccccagaagccaagcagatgccagctccatgcttgtacagcctgcacaactgtgagccaattaaacctcttttctttataaattatccagtctctagtatttctttttttttgagatggagtcttgctctgtcacccaggctagagtgcagtggcgcagtctcggttcactgcaagctctgcctcccgggttcacgccattctcctgcctcagcctcccaagtagctgggactacaggcgcctgcaaccatgcctggctaattttttgtatttttagtagagacagggtttcaccctgttagccaggatggtctcgatctcctgacctcgtgatccgcctgcctcagcctcccaaagtgccgagattacaggtgtgagccaccatgcgtggcctctggtatttctttatagcaatgcaagaacagcctaatatgggtggggaaatatgctctgtccatctggtacactgaaaggtcatatggtagaaaaattgtgatcactaaccaatctaaccaggctaggtggctcaagcctgtaaccccagcactttggtagcctgaggcaggaagattgcttgagcccagcagtttgagaccagtctttgcaacacagtgagaccttgtctctacaaagaaaaaaaaaagtgtaagttagccaggcatggtggcacatgccatgatcccagctactcaggaggctgagataggaggatcacttgagcccagaatgttgaggctgcagtgagccatgatcgcaccactgcactccagcctgggcaacagagtgagactctgtctcaaaaataataacaataataataataataataacccaatctaccataaaaggcagaaaacaagccatatcctttcatttctctattcctaccatttagtaccacgaccagcatagaataaacatcaagcaataattgtcaaaatgaattgattattcatggcatggagtaacatgagacatacacataatgcagtggttaagaacttggacgtcagagtcacaaagacctgagttcaatgtaaaatgacaaaggctctttgaaaagtttcgcagtttcttacaaagtttaacatgagcttaccataaaacccagcaattccacttctaggaaactacccagatgaaatgaaaacatccgaccatacagaaacctacacatgaatgtgcatagcagaactctttatagcagccaagaaatagaaataatccaaatgctcatcaactggtaaaatgaataaataaaatggggtatacccaaacattggaataatattcaggaataaaaaggaatgaactatgttgttgtcgttgctgtttttattgaggcagagtcttactctgtcacccaggctggagtgcagtggcataatcttggcttactgtaacctctgcctcctgggttcaagtgattctcctgcctcagccccctgagtagctgggattacaggtgcgttccccacacccggctactttttgaatttttagtagagacagggttttcccatgttgtccaggctggtcttgaactcctgacctcaagtgatccactcacctcagcctcccaaagggctgagattacaggcgtgaaccgccacgcccagccaggaatgaactgttaatatacaaaacaacatagttatctcaccataagcaaaagaagtcaaatgaaaagactacatattgtgtgattctatttatatgaaatgtccggaataggtaaatttatagagacacacaggcccaggcacagttgtcaactgaagctacagatgggaatgaggattgacggcaaatcagcaccaggggtcattctggacaccatggaaaggttctaagactgtattgtcatgataattacacaacttttaaaatttactaaaaatattagctgggcatggtagcccatgcctgtagtcttaactactcaggacgctgaggtaggaggatggcttaagcccaggagttcaagactacagtgagctacggttatgccactgtcctccagcctggccaacagagcaagaccctgtctctttacaaaataataagtgggccaggcatggtggctcaagcctgtaatcttggcactttgagaagctgaggctggcggatcacctgaggtagggagttcgagtccagcctgaccaacatggagaaaccccgtctctactaaaaatacaaaaattagccaggcgtggtggtgcatgcctgtaatccagctactcaggaggctgaggcaggagaatcacttgaacccgggaggcggaggttgcagtgagccaagttcatgccattgcactccagcctgggcaacaaaagtgaaactccatctcaaaagaataaaataaaataaaataagtggctcatgcctgttatcccagcactttgggaggccaaggtgggtgggtcacctgaggtcaggagctcaagaccagcctggccaacatggtgaaaccccatctctactaaaaatacaaacattagccaggcaaggtggcatgtgcctatagtcccagctactcaggaggctgaagcaggagaatcgcttgaacctgggaggcagaggttgcagggagccgagactgcaccactgcagtcaagcctgggccacagaatgagactccatctcaaataaataaataaatgaaataaaatgaaacgaaataaatttactaaaaattattgacatgcacatccaaatgggtgaattttaataaattaaagaagaatctgtgttcagaacttggctctaccatttagtatccatgtgatctagagcaacttatacagtgacataacctctgtgagcctcaatttctccatctgcgaaatggagatgaaacagaggcctgctgaagagtagatgagataatgcaggttgtttccccagcacagggcttgagaggtgtctgaggagttcttagggactctctagcaccctgtgcttttagggaaatcatttccacccaagtccctcctacgtccaaggtccaacccttgtttttatttaagttgctggttcccatattcccttaggaatatgttgttctctgccttgtccccaaatccctagtgcaagaatatatatatatatatacacatatttttttttttgagatggggtctcgctctgtcacccaggctggagtgcagtggcacaatcttggctcactgcaacctctacctcccaggttcaagggattctcctgcctcagattcccaagtagctgggattacaggcttctgccaccacacgcagctaatattttctatttttagtagagatggggtttcaccatgttggccaggctggtcttgagctcctgacctcaggtgatccacccgcctcggcgtcccagagtgctggattacagatatgagccgacatgcctggcctccctgatgcaagaattactcagactttttctaggccagaataagagtaggtcaacctcgtccaatccacagctccagaaattgaggcatttccagaatactgtacagagatgagaggccctggccaaacaaacacattacctttccactttgtattttacttctctttcttaacaacaacaacaacaaaaaaaaaaacaaaaacagaaacagaaacaaaaaaaccttggcttggcagttctaagctagggctgacagattctataagaagtcccagaaaacatctcagcctttgcaatgaaccttcagggaacaagtggccagtgagaaggtgattcactttgatgatagcttcctgatgagggctggaaccagctggagggttggtcagtttacgacttcatagaagactcaataaaagtcataaataaaagggcacgtgggtgtgagtgcacttcacagtgttgggaggccccatacgacagaacacaagaccgataattctgacttggctcaaggtttatcacctacgcagtgaaaggtgcagaccccatatgcctgggctgcttctctcccagtggaaatagattgagcctatggactaggggggccatttctcagattcctcaggccttggatctgtgggtagtgcggggtgaggaatggctgccttctctaataaaataaatcttggtgcctccaaggttgaccctggataaggacactcctgggagtacacaagggatgcctccccttccaaactgcctgcccctccaccattcaatcccagagctgagcgcttagtcttctaatcaccttagaataggtctcatgttgtgctttcattcattcatttaataacactactattattatcaatattaataaagctgattctgagttcacctcctctcctgcagtaatacaaacttcaaggcattctgtgatagtgagagttaaatgagacagagttgaaaaaaaaaaaaacaacttagcacctgcggggcacatagttaagctccataaatggtagctatataatttctgactatcaaaaccgtttcttggtcttgcatggcagctcaatcctgtaatcccaggactttgagaggccgagggaggaggattgcttgaagccaggagtttgagaccagcctaggcaatatagcaaaactacagctctacaaaaaaaaaaaaaaaaaaaacagggccaggctcggtggctcacgcctgtaatcccagcactttgggaggccaaggggaacagatcatgaggtcaggagtttgagaccagcctgaccaacatggtgaaaccccgtctctactaaaaatacaaaaattagccaggtgtggtggcgcatgcctgtaatcccagctactcaggaggctgagacagaggaattgcttgaacctgggaggcagaggctgcagtgagctgagaccatgccgctgcactccagtctgggcaacagagcaagactctgtctcacaaaaaagaaaaaaggaaagaaagccccaagactgtgtaatttataaaggaaagaagtttaattgactcacagttctgcatggctggggaggcctcaggaaacttacaatcatgggggaaggggaagtaggcacgtcttacatggtggcaggccagagagaatgagcaggagcagggaaactgccctataatatcatcacatttcatgagcactcaatcagtatcacgagaacagcatgggggaaactgcccccatgattcaatgacctccacttggtccctccctccatacttagggattatggggattccaatttgagataagacttgggtggggacacagggccaaaacatactgtcatgctaccaggaattttgtctgtctcatttgcccatatcagcagcaaagggcctagcacctaggaggtgctcagaaaacatttggtgaattaattaataaggaagctaagaatcacagatgtatggtacatagtttcagtaaagaacaagacattggaattggggtgacctgggttgcagccccagctttgttatttacctgctgtgtaacctctaaacttcatccacaaagtggatgtaactatggtacctatctcctgaagtctgagggaggatgaagtgagataacactaacaaaagcatttggcaaccaagacctcaataaatgctagctatctttattatagtttcaacacatagccaagtccacatttgaatttaattcatggaagaagaggaagaagaggaaaaagaagaagaaggaggaggaagaggaggaggagaggagatggggagggggaggggggagggagagggggaggaggtagaggaagaagagaagattgcggtgatctcaggagtaagtatcaatggaaaaaaagatcctggcttgaaagcatgtagaagacttgcgagcagatggaaacaacccagtcagggccggaagtgatggcttacacctgtagtcccagcactttgggaggccgaggcaggtggattgcttgaggccaggagtttgagaccaccctggccaacataacaaaaccccatctatactaaaaatacaaaaaattaaagttaaaattaactgggtgtggtggcacacacctgtagtctcagctacttaggaggctgaggcacgagaatcgcttgaacccgggaggcagaggttgcaatgagccaagattgcactactgcactccagcctgggtgacaagagagagactctgtcaaaaaagaaaggaagggaaggggaggggagggaagggcagggaagggaagggagaaagagaaagaaagaaagagagagaagagaagggaagagaagagaagagaagagaagaaggaaggaaacaacccagttggtgcccaatatattcttactgaattatatcagtctctataaatgccgccaactgtcttaaacattccagacttctccttttcctactccggctaaggggagttagatgttatattcttccctccactctacactttgggagtggcttttcaagttttgcattcaatctctttaaggacactccacattgatcatatccaaaatgtctggattgaatgttcctcagatccagtggttctcaaagtgtagttcccagaccagcagcaccagcatcagaatcatccaggtacttattacacacgcaaatcttattttggatatggtggctcatgcctgtaatcccaacactttgagaggccaaggcaggtggattgcttgagcccaggagtttgagaccagcctgggcaacatagagagactcatctctacaaaaaatacaaaaattagctaggcgtggtggcacatgcctgtagtcccagctactagggaggctgagtggggaggatggcttgagcccaagaggtcgaggatgcagtgagccgagattgcaccactgcactccagcctgggtgacagagcaagaccctgtcaaaaaaaaaaaaaaaaaaaaaagcagatccctagaccttaccctcgacctcctgaacaagaaattctggggggatggatcccagcgatttgcattttaacacgccctccacgtggctctgaggtatgggaaagttttgagaactgcagttctaacaaaaaggcaaacagggcaatcaaaagctgttttctctgcttagtccctgagtggtttcctggttggttggttgatttgagctggagtcttgctctgtcacccaggctggaatgtagtggggcgatctcagctcacagcaacctctgcctcccaggttcaagtgattctcctgtctctgcctcccaagtagctgggactacaggcgcgtgccaccacacccggctaatttttgtatttttagtagagatgggttttcaccatattggccaggctggtctcgaactcctgacctcgtgatccacctgccttggcctcccaaagtgctgagattacaggagtgagccactgcgcctggcccggtttcctggttttgaattgggaagagtgagatgaaaacaggactccctgcagaacaaatggcttctccaacaaattgtaatggaattttacatgagaggagccagaaaactgctgctcaattagtcagccaaaaaatatggagtacctactatatttcaggtgctgcgcaaagtgctgggggaaccatggtgaacaagacctatgcatccagctcttcaggattgaacactgggtgccagcagactgcatttcacacacatcaaactggcaaagataaaaagtctgacaaaaccaaatgtcggagaaactggaattctcatgtactgcaggtaagagtgtaaattggtacaactgttctgcagagcaacttggtgaaattgagtaaagttgaagaagtataacccccacagcccagcaattccactcctaggtacataccctagaccaggagaagctctatcagtttgcacaaggagaaatgtacaggaatgtatatatctgagatggagttttgctcttgttgcccaggctggagtgcagtggtgtgatcttagcttatcgcaacctccacctcccaggttcaagcgattctcctgcctcagtctcccaagtagctgggattacaggcatgcgccaccacacccggctaattttgtatttttagtagagatggggtttctccatgttgattaggttgtctcaaactcccaacctcaggtgaggtgcccacctcggcctcccaaagtgctgggattacaggcatgagccgccgtgcctggcctgtacaggaatatttactacagcactgtttgtaatagaaaaatagaaacaggtcaggtgcggtggctcaggcctataatcccagcagtttgggaggccaaggtgggtggattgcttgagctcaggagttgaagcccagcctcgacaatatggtgaaaccccatctctacaaaaaatacaaatattagccaggcatagcggtgcaagcctgttataatcccagctactcaggaaggctggcgtgggaagatcgcttgagcctggggggtcgaggctgcagtgagccatgatcataccactgcactccagcctgggtgacaaagtaagaccctgtctccaaaaaaaagaaagaagaaaaaaagaaaaagagggagagaaagaaagagagaaaaagagaaagaggaaggaaggaaggaaggaaagaaggaaggggaggagagggagatggaggggaggggaggggagggaagggaagggaagggaagggaagggaagggaagggaagggaagggaagggaagggaagggaagggaaggaagacggccaggctcagtggctcacgactgtaatcccagcactttgggaggccaaggtgggcggatcaccagaggtcaggagttcaagaccaccctggccagcatggcaaaaccccatctctactaaatatacaaaaattagccaagtgtggtggtgggtgctgtagtcacggctactcgggaggctgaggcacgagaatcacttgaacccaggaggtggagtttgcagtgagccgagatggcgccattgcactccagccgggcaaaagagcgagactctgtctcaagaaaaaaaaaaaaaaaaaggaacctaaatgtccatctgcagaatagatagcttaattatgattgagttctaccatggatgctagtactaacagattaacactaacaatagtagaaaataaatgaaacataacctgtatcaacattaacactttgcaaaatcggccaggcccagtggctcacgcctgtaatcccagcactttgggaagccaaggcgggcggatcacctgaggtcgggagttcgagaccagcctaaccaacgtggagaaaccccatctctaccaaaaatacaaaattagctgggcatggtggcgcctgcctgtaatcccagctactcaggaggttgaggcaggagaatcacttgaacctgggaggcggaggttgcagtgagctgaaatcacaccattgcactccagcctgggcaacaagagtgaatgaaactctgtctcaaaaataaataaataaataaaaataaaaataaattgcaaaatcataacaatgaaccaaaaagcaagccatgagaacaatacatacagtggtagtctatttaaagtgtttaaatatgcaacataatgttatatgttgataatggataacatatattcaataagaatacaaaataggcatgaaatataagacacaactgcaggatagagatcccattgggaaggaaggaagagagaaaggagcacgagattaagaggggtccacagaaggacttgattgtctttgttatattttttaaactgagtgacgggtaaatggttgttcactgtactggtctttatagttttttgtgtgcctgaaatagttcagaataaaattattttaggtcactttttttctgggttttttttctta

SEQ ID NO: 722 - DNA, 111120 bp, Homo sapiens
ggcattcaataaatatgcaaagtttcctaatctattactttggttcccaaatacttactgttatctcaaactctgtgaaagaggacatgtcaatgacacacacagcttccttacagcacttgacttcagactccacgatgtcaaaccaatctggcttatagaaagtcttgctctgctccaatgccaggaggtctacggaatggaaaaatcacaaggccctgtagagtttagtgtagtccacgtggttctttttcttctgtgaacacattctagcctatgcatttgaaaatacgttttattaattcccaggacaaaaaaaaaaaggagcaaaaatgagaatgtgacttcttacccttgtcagggggaacaaagtactttggcctctcaaatccatgtttctccatccacctggctccctgtgcatccagccggtcgtagagaggagaggtgcgtaactgcctaccggtctggaagtcccagtggggaaccttcagatcatacatcaaagctagaaaagacacgagtagtctatcaaagcccaagacacagattctagacctgagtagccaatatccactagactctggagttgtttctattcaaaagagctttccaggctaacgtagtttgtttttttttttttttaagacggagttttgctcttgttgtccaggctggagtgcagtggcacaatcttggcttactgcaacctccgcctcctgggtttaagcgattctcctgcctcagcttcccgagtagctgggattacaggcacgtgccaccgtgccacactgatttttgtatttttagtagagacagggtttctccatgttggtcaggctggtctcaaactcctgacctcaggtgatctgcccgccccggcctcccgaagtgctgggattacaggcgtgagccactctgctcggcccaatttccaggctaatgtagtctaattttcaaaattacccagtgtatcaggcatgctccagaaggaaagacaatcctgccaagctgctatcgtccctccctggagctacgtgtcacggcatgactcggcctgtattcacattcagcattccacattagtaggtagaaatgatggcagaaaggtcagggtcctaaaccttactaagcttcatagcagagaacaaggttactaagtgggacacaggtggtaacaaaatgtgaaaaaatggcattcgattcttcattgtgcctgtgttaggatctcagacctgttacagacatttcctccctgataattaactcacttctgaagtgaaagggtacatattgtagcttgattaggtggctctgaaatctgagaagttacattgtattgtaccaatgacattattcacacaacaaagctagggtcagaattcatttctcttaggctgggtgtggtggctcacgtctgtaaacccagcactttgagaggtcaaggtgggcggatcacgaggtcaggagttcgagatcagcctgaccaatgtggtgaaaccctgtctctactaaaaatacataaattagccaggcatggtggcaggcacctgtaatcccagctacacgggaggctgaggcaggagaattgcttgaacccaggaggcagaggttgcagtgagccgaaatcacgccacggcactccagcctgggcaatagagcaagactatctcggaaaaaaaaaaaaatttcatttcccttaatgtctaatcttcaacagcaataagtaaaaaaagccagaagagtgggatctgtggtcccttgcaaagagaagacctgatctcacaccgtcccaaacaaaaggcacatcaaggcttggggaggttgggagacaggagaaggaagccaggtggggttctctgcatggtgacaatctctccatctcctggtactttaggttctatcttccccttccccattttcttttctattttttttttttattttttgttgagatggaatccctctctatcacccaggctagagcgcagtggtgcgatcttggctcactgcaacctccgtctcccgggttcaagtgattgtcctgcctcagcctgccaaggagctgggatcacaggcacataccaccacgtggctaaatttttgtatttttagtagagacagggtttcgccatgttggtcaggccagacctcctgacctcaagtgatccgcctgcctcagcctcccaacatgctgggattacaggcttgagccactgcgcctggcgccttccccattttctatgtgcctgccacttctatttcatgagaattggctaccaaaagtgtcatatcaccaagcagaagctcaagctcaattatgatttgtacaggttccaaagtaactatgggtggggaaatttaggcttataatagttcaactttaaaacaaaaaactttgatttttttattttatttttttgagacagggtctcagtcccactgcccaggctggagtacacagtggcaccatcatggctcactgcagcctcaacttccccagctcaggtgattcgcctacctcagcctcccaagtagctgggacttcaggtgtgtgccactaaggcatggctaattttttggttttggttttagtagagacagggtttcgctacgttgcctaggctggtctcaaactcctgacctcaagtgacctacctccctcagcgtcccaaagtgctgggattacagacatgagccagcacacccagccaagttcaacattttaaccaaaatatttgctaaaattaaagaaccttagcagttaaacatattgctgttaggtccttcatctccatggatgtacatcctcttcccaggccaaaagtgagcactcaggcattaaaggccatccagagtcctcaccaacaatgttgttcaactaccaaactaacagtttacttgtaaccaagaatggtggtcagagccaacacagaaacttagtcctgagcataagtatgcccaaaatatttagataccatttggcaaagtctgagaacagctcctcagtacaggaaaatgaaattacaacttgaacccacgtggtttggttcaattcctgatacaaaagctttctaagggcttcctagaaaataaatcagagatcaaggtagaataacaaattaagatgaagtggccagtccttcaaagttgaagcagggcgagaacacgggagtgagagcaggaatgtatgttttgtatttatatgggaagtggctcccaatcttgctgctgtagggtggattaatggtgaaagtcactcacggaagcctgaagctctgagaataacttggcaaattctctgacttggaaagaaaaaactaagtggggagtgagaaagcattttctcaaaaactaagtgggagtgagaaagcattcacttcgacacagggtctctcaaggcagactgcagaaagcacgcacttcgacatacggtctctcaaggcagaccgggaagaaggcattgcttagaatatttatgaagctgctatgtaccaactgtaactcctattctactttcttgttcccagaaggaaaaaaggtccgatgcactaaagaaaatgttacatatatatcatgaggagcataaagccccttaactcaggcctgaaacagtcaaatcaaatgtccaactcaaagcacttgttaaagaactgaggaaaactttgctccttctgaatgacaacacgggccaccgagaagatacctgcaactaggagcaactgcgataaagcttcacttacgcatgacttccatgacccggtggcgcagaaaggtgcggctgctctggagggctccaaaacgtttcaggtccaattcccaaacgttttctgagggataaccatgtaccatccattcggcaaggtacctatatagacagagggcacttgttggggctcaggtgtgagatttgagaaaattaatattctacaaatcgagaactaacagaatcaaaagatcctaaattgccatagaccagctgaatagttttgggcactttccttaacttttctggaagcaacgaacatgggtctgtgtactgctctcaaaagactactatgaggattttaccccagatgataagattccctaggaggcatttaacatagaagccagccagacacattggctgatgcctgtaatcccagaactttgggaggctgaggcaggggattgcttgaagtcaggagtttgagaccagcctggacaacaaagtaagaccccgtctctaccaaaaaaagaaaagtttcaaagtgagccaggtggctcacacctgtaatcccagcactttgggaggctgaggcatacggatcacctgaggtcaggagttcgaaacaagcctgaccaatgtggagaaaccctgtctctattaaaaatacaaaattagccagtgtggtggcacacgcctgtaatcccagctactacggaggctgaggaaggagaactgcttgaacctgggaggcagaggttgcagtaagcctagatcacgccattgcactccagccagggcaacaagagcgaaactccatctcaaaaaacaaaaacaaacaaacaacaacaaaaaaaaaaattagccggcgtggtggcacatgcctgtaatcccagctactcgggaggctgaggcaggagaatcacttgaacccgggaggcagaggttgcggtgagccgagattgtgccattgcactccagcctgggcaacaagagcaaaacttcgtttcaaaaaaaaaaaaaaaaaaagagctgggtatggtggcacatgcctgtagttagttctaactcttctggagtctgatgcgggatgatcccttgagcccaggaacttgcggctgcagtgagctatgatggtgccactgcactccagcctgggtgagagtaagatcttgtttcaaaaaaagttataagcctcatctatgaagaaataagactaaaacacatataaatatactctaaatatccaatgggtttttttctctcacctcaagattatacagttatgtgaccccatctcctttgctccaaacatttttgtaactcctcttctgtaattgtttttagagccattctacaaatcactcaagagaactggtctcataaatttaaaataagcttttcatcgtggctaccatcttacccatttgtaagtattcagttcagtggcagtgggtacattcacactgcggtgtaaccttcactaccatccatcctagaactcttttcctcttgcatttgtggaactctgtgctcattcaagaatagctcccctcccccgcctctggcaaacaccattgtactttctgtctctatgatctgacaactctagcaacttcatataagtggaaccacacagtatttgtccttttgtgactggcttatttaatgttcattagtgtcttattttattttattattattatttttattgagatagagtctcgctctgtcgcccaggctggagtgcagtggcgcaatctcggctcactgcaacctctgcctcccgggttcacgccattctcctgtctcaacctcccaagtagctgggaccacaggcgcccgccacaacggccggctaattttgttcttgtatttttagtagagacgcggtttcactgtgttagccagagtggtctcgatctcgtgaccttgtgatccgcccacctaggcctcccaaagtgctgggattacaagcgtgagccaccgcgcccggcctagtgtctaatttttaaacaaaaacttgtggccgggcacggtggctcatgcctgtaatcctagcactttgggaggccaaggtgggtggatcacttgaagtcaggagttcaagaccagcctggctaacatggtgaaaccctgtctctactaaaaatagaaaaattagccaggtgtgctggcacacgcctctaatcccagctactcgggaggctgaggtaggagaacagcctgaacccaggaggtggaggttacagtgagctgagatcatgtcactgcattccagcctgggtgacagagcaagactgtctaaaaaaacaaacaaaacgtgtattacctagttcaaatacctacctcaatcaacacacttggctaccaaactcaaatacacactcaaatgaccaatatttgttacaattgaaaaaatataaaagaatatcccacaggatctgtggctaactccaaaagatgagttgcaaaaacattttgcctgatgacatttctggaacatggggagcctctcatacttagaaggggacaactccaaaattacatgtatcttcttattagtcttaacatactagattaaatataccacacgccatgttaataacaagtaattctagaagggaagagacccagcaagttgacttatgttcacagctgactttgagtgagaaagacttactttccggctcctccaccaaatgaaaggccagcagagttcattcctgccaggacaaagtagccctacactgcaggagactcgcccatgatgcacctcatgtctgatgcgaaggtctctgggcagttcaccaacttcatgatctccagagtctctaattctggcatcctcctcagaagggaactcaacagaggctctgagcaatgacaacaaaaccaaatagagttctcacctttaaggaattaaaccactttcaacccctctacttttttacactctcccctttcagaaaacctcttgaattttttttttttttttttgagatggagtctcactctgttgccccggctggagtgcggtggcacgatctcaactctctgcaaactctgcctcccaggttcaagcgatcctctcgcctcagcctgccaattagctcagattacaggcgtgcaccaccacgccagctaattttttgtatttttagtagagatggggtttcaccatgatggccacactagtttcgaactcttgacctcaagtgatctgcctgccttggcctcccaaagtgctaggattataggtgtgaaccactgcgcccggctggaagagatttttttaaagacaagccaactgggccatttattacaaagcagaaaccttggtagaattacaggatatagctgcaaaatacttggtataaagactgaggaaaaaagatattggttagaaaggaaagcagcagagaacagcaagtaaaacgtatctacagataataatcttgaagggaccagtgtgagtggacaagctcttaaatggcggccacagagattttaataaaaggtgatgttctgagctgggcatggtggcttgcgtctgtaaccccagcactttgggaggccaaggtgggcggatcacctgaggtcaggagttcaagagcattatggccaaaatggtgaagcctcgcctctactaaaaatacaaaaattagccagtcatgatggtggaagcctgtaatcccagctactcgggaagctgaggcagaaaaatcacttgaatctgagaggtggaggttgaagtgagcagagatcgtgacactgcactccagcctgggcaatagagtgaaactccatctcaggaaaaaaaaaaaaaaggcaatgttctgcattggaatagctgcaaaagacagaccctgctttaaaggaaatctaccatcagggcataatccagtggacagcagaaaaagatgaaaccagaccagagctggataatgggtacatgggggctcatcacactactctcgccaggtttgtttagtagacacatagtctccagtctcgccatgttgcccaggctggtcttcacttcctgggctccagtgatcctcccatcttggcctcccaaaatgatggaattacaggtgtaagccactgtgcccagcttctatccagttttaaaagtttgaaattttccataagaatttattaaaaaacgaaagcccatcaagggtcagagggaaattcttcattagagactctttcacctttttaaacttggaactaggtaactacattattattattattattctttttgagatggagtctcgctctgtcacccaggctggagtgcagtggtgcgatctcagcccactgcagcctctgcctcccgggttccagcaattctcctgcctcagcctcccaggtagctggcattacaggtgcgcgccaccacatccagctaatttttatatttttagtagagacgggtttttgccatgttggccaggctggtcttgaactcctgaccacaggcgatccgcccgccttggcttcccaaagtgctgggattacaggccttaaaggccaggtgcagtggctcatgcctgtaatcccagcactttgggaggccgaggcaggtggatcgcttgaggtcaggagttcaagaccagcctggccaaatagtgaaaccccatctctactaaaaacacaaaaattggctctgcgttgtggtgggcgcctgtaattccagctacctgggaggctgaggcaggagaattgcttgaatccaggaggtggaggatgcagtgagctaagatcgcaccactgcactccagcctgggcaacagagcaagactccatctcaaaatgaatgaatggatacataaataaacaaataaaattattttaaaatttaataaaatactacactaacaaaacaattctgaaaaacaaaacaaaacaattctgttttctaaagaactcctcaattttatatgaagtcctactgaaagaagtctcctcctaaaacctaaaatctgagcaataattttaggtgaataaagaataagcaggggccgggcgtggtggctcatgtctgtaatcccagcactttaggaggccgaggcgggcagatctcctgaggtcaggagttcgagaccagcctgaccaacatggagaaaccctgtctctactaaaaatacaaaattagccaggcgtggtggcgcatgtctgtaatcccagctactcaggaggctgaggcaggagaatcacttgaacccaggaggcagaggttgcggtgagccgagatcgcaccattgcactcgagcctgggcaacaagagtgaaactccatctcagaaaaaaaaaaacacacaaaaaaagaagcagagctgggcacagtggctcacacctttactcccagcactttgggagaccaaggcaggcagatcacttgaggccaggatttcaagaccagcctggccaacgtggtaaaaccctgtctctactaaaaatacataaactagctggacatgttggtgcacgactgtaatcccagctactcaggaggctgaggcatgagaatcacttgaacctaggaggtggaggttggagtgagccgagattgtgccactgcactccagtctgggcgacagagcaagactcttatctcaaaaaaaaaaaaaaaaaaaggccagacgcagtggctcatgcttgtaatcccagcactttgggaggctgagggaggtggatcacctgaggtcaggagttcaagaccagcctgatcaacatggtgaaaccctgtctctactaaaaatacaaaaattagtcaggagtggtggcaggcgcttgtaatcccacctaccacctactctggaggctgaggcaggagaatcacttgaaccggggagtcagaggttgcagtgagccgagatcacaccactgcactccagcctgggcaacagagcgagacttcatctcaaaaaaaaaaaaaaaaaaaaagcagctgggtatcatggctcatgcccgtaatcacagcactttgggaagctgaggcaggaggactgactgagcccaagagttcgagaccagcctgggcaacacagtgagaccccatctcaacaaaaaatttaaacattagctaggcatggtggcaagcacctgtagtcccagctacttgggaggctgatgttgcaggatcacttgagctcacgaatttgaggctacagtgagctatgatcatgccactgcactccagcctaggtgacagggcaagacgccatcttacacacacacaaaatgatagagatgactaaacacacacacacaaagggctaggcaaagtggctcacgtctgtaatcttagcactttgggagtccaaggtggaagggatcacttgagcctcggagttcgagatcaacctgggcaacatagcgagaccatgtctctatcaaaaacaaaaaaaaaaagctatgagaccaggagttcggggctgcagtgagctataattgtgcaactgcactccagtctgagcacagagcaaggctccgtctcaagaaataaaagaaaaaagtaaaactaagaataaaattaaaaaagaataaggcaaatgtccattaactaagattttagtcccctgaatctgctacctagtaactccatcctcagaccaggcaaactcaccctctgtaaccactgttgtacctcatggcgatgttataaacattaaacaaggaactattcttcaaaagactttgaaaaatataacatcttaaacaaatataaggcactactgttataatgcagttcacataccaaagtgatcccagtcccctgtagattctgaatctccagctggttcttgccctcagtgaaaattggttttgggttcttctcaaagcccccagacaggatgccaccctgccagttccgaatataaattcttccatcagcatccacaatagctgaggtggagaaatgacatggagtggggagtggaagaaaaaacaagggtttagaggcaagtcagctttctaaatggacagaacaaccaaacaaaaacacccattaatggctttattaatgaaagaacattcaatgaacgcaggcattcattagctttaaaataccttttgaggtcacgggggaagatcctcccatttagcctttcagtggagactgtttctctgattatcccttacctagaagctttgactagtccccaccacgtaactcccactgtgccaagcgaaagtttaacggaaagggggattgcagagcccattctaggcatgaagaccgtcaaaaggatgtgagaaccctctcctatagtgcttggaaccacgaacccacctaagtctatcgtttacctatgacatttctactatccatagtattcaagttaaaaagtcaacaagacagtccaaatattctcaatgacctctgtttaagactaaaattagcttgcaaaacaaaaaacaaaaacaaaaaaatgtattaatggaaattttggccatcctttcataaagagttaataaagaaaagtcagaattgggtccacctccctgtaacatgctctagaaatgaaagactctttcagacacagtctgtccttagcagaaagttttccttttcagaggacaggacactggcaaagaaacaagattttttaaaaaagtgcaagtcctcacttggtgtgctgctctgcagaggggtctccaaggggcgagtcaggaggtagaagtgttcgcaggcatgtagcgggatactaaccggctcctcgttggacagacccagctcgtatgcccactacaaatggacaggttgatttgtgggtgggaaggggaacagaaataaaaatgagcaagttcagcctcttgagattaattccaagtggcttatgtgtgctcttgctacagtgtcaggtgtgggaagtcagcctgctttagttcaattatttggatggggagcaatactacattttttaagacataaaaattactttgagatcaaaggaagagatatttaccagctagtcaaaggagctcatgggaaccaaaggaggtccttttgataaaacgcctgggctcagctacaaaccccaaatagcaatcactaaatgaacttcacgtggcaaaagtatttcttagttcacttcgggatcatagcatggaaggcaagagccaatctgctttaaaagaagcagtgtcccggaaattagtgtccacattcctgacacaataaaatagcctaatatgttatttgctaggttgtagaatgaaatgtaacaccaagacccagcgccaaggattcacgtcaatgcctgaccatttgctggccttcctgaccaggatagcacccatcaacccagtgtggaggaaggacaaggtcacacaggcttctatttgcagactaagtgtaggtttctgatttagaataccctacaagaaacagcatagttactgatatctgtgtaatgaatcacaatactaaccttacttctctacaccaaaaaaatcttggagacatacgttaaataagaaaatcagtgttggtgctgacctacctggccagcacagttgacaaaatactggcattcaatctgtcctttatcggtctccactccagtaacttgaccttttttgcccattacttgaagaacagatgtccggtcatagatctgaacacctgttccaaggtaaagaaagagttggtgcttcatctgatgttccagaatgaaggcatgtgcagcaggttctccacccagaagaaacactgacaaagtcaagtcaatgctttaatttatttttttattttatttttgagacggagtcttgctttgtcgccaagggtggagggtagtggtgtgatcttggctcgctctctgcctcctgggttcaagcaattctcctgcctcagcctctcaagtagctgggattacaggcatgcaccaccatgtcctgctaatttttgtatttttaatagagatggggttttaccatgctggtcagcctggtcttgaactcctggcctcaggtgatccgcctgccttggcctcccaaagtgctgggattacaggcatgagacaccacgcccggctcaatgctttcatttaaaaaaaaacacaaaaccctagaatcacatcctgagactatgtaaatgggccttgttcgagattgaaaatagcaagtcagtttaaaaacagactttggaacacaataattaaattcctggaatcataaactatggagcaaagaggagaggatgtaaatagtgcgccttaagtgctaacctgctcataccatggatatgataccctggacactagttaagtcttcccctcattcaatgcaactgggcttatgatttcaggtgtggattaaacttccaaggtgtgttttcaccttgagcttctcaagtcctgtgggggaaaatattaccttaagtccaaagggcattaattggcagggcacagtggctcacgcctgtaatcccagcacttagggaggccgaggcaggtggatcatctgaggtcaggagttcaagaccagcctggccaatacggcgaaaccccgtctctactaaaaatacacaaaaaaattacctgggtgtagtggcgcacgcctgtagtcccacctactcgggaggctgaagcaggaggatcacatgaacccaggaggcgaacgttgcagtgagccaagattgtgccactgcactccagcctgggcgaaaagagtgaagctccgtctccaaaaaacgggcattaattagcactaaaagcagttctttagaactttaaaaatgtggccctgagggaaaacactcattaacagataaataaaattataagtgttcaaaatggaggctgagtaccccaaagaggataatctttccaaacttgagttggtgtcacttcctactgtgagacacttccttaggtaatgtcttccctgctaacctatcttaagaaaatgcaaaaacctgctcaccattttgggaggcagcacttgccagggcaagagccacgtcagcggaagacaccactgcatcctcaggaacatgcatggcccccaccaggtcgtgcacgttgaggagatggtgaagctcggccactttcttgggggagatgatctcagaagggatacctataacactgccacagaacacaagggacaatgacattcacaggctctttggcagaggccagtgtggtaaagtcaggacacgcttctagactcttacgtacttcagccctgcgttgatgcgcttcagggagatcagtcggtcctgagtttgggccagaaagattgagcctgtccttgtgtaacctgtaagaaaaatgagcccaaatgagacagatcagaccaaatgtaggacgggagagtggaaaatccactagattataagttagaaggcctgtgatgaatcctgggactgccactcaatatccttgggcaggtaaatcagcttctctgagcttctttgcaaaattttaagaacttcagatgcactaaggctccatgccctgaccaaacattctcagctcacagttttgtgaagttgtgaggatcaaatgagattctaggccaggtgtagtggctcatgcttgtaatcgcagcactttgggaggctgaggggggcggatcatctgaggtcagtagtttgagaccagcctggccagcatggtgaaaccctgtctctactaaaaatacaaaattagccaggcacggtggtgtgcacatgtaattccagctaccggggaggctgaggcaggagaattgcttgaacccaggaggtggaggttgcagtgggtcaaaattgcaccactgcactctagcctgggcaacagagtgagacttcgtctttaaaaaaaagaaaaaaaaagaaaaagacagttttgggcagggattcgaccatccctattcttcccaccttttaggcagtttcaccctttctcctcctagtcttgggggagtgtaatccttagcaaaggccactcacaataacatcagctaccaagggtcggattctcccttcttcttccccagtatagccaaacagtgggcatgcgacctaagcttatccaatcagaccctcctggaacagtcagtcttgagcacgtaggtgaatggctagaggtcaccatctcaagggcagcatcagccaggccaggctgctcctgttctggctgagggactgcctgcggtgcagtccccacatcctggcttccaggctgcctccagctggcagcctcctgccaactccacaggcccaagctcctcccaacaagctccaagttggccagagtcaattcctgttgtctgtaatcaacacacctgatatagaaccataattacacttgggccaatgacaattctcctaaaatacaatgactcttaattcttatgaagaaagagttgaagcaatttggtatcttattttcaaaagaagtacagtaaggataatttacatattttcttaatttcttagtagagacggggtttcaccatgttagccaggatggtctcgatctcctgacctcgtgatccgcctgcctcggcctcccaaagtgctgggattacaggcatgaaccaccatgtttaaaaccggccaacccaagttttaattaccaaagcagtaggcacacctggcagaggaccaaatacagaaatgaatataacaatctcagggacaggcaaagcaataaatggaagacacttgcttacctgttcggatccctgtttcttgctctaactgatggtagagtttgtttgagtagtctgccatcttctgctcaatggtcaagtgcctggcagtgctcaggatgccagcacagaacctggtagagccagcagccagcctgcaggatggatgcaaaatgctattaggtagattgacgtcatctgtgaatacgaggtcagggtttctcatttaatactgtttctaataccaaaagatggaaacaagctgggcacagtggctcacacttataatcccagcacttgaggaggccaaggtaggaggattgaggactgcttgaggacaggggtttatgaccagcctggtcaacacagggagaacccatctctaccaacaacaacaacaaaattagccaggcatggtagcacatgcctgcagacccagctacttgggaggctaaggccagaggagcccttgagttcaaaaggtagaggctgcagtgagctgtgatcacatctctgcactccagcttgggcaacagggtgagaaaaatgttcaatgacatgggatagatttaaaattttgtatagtttaggccaggcacagtggctcatgcctgtaatcccagcactttgacgggctgaggtaggaggttcacttgaggccaggagttcaagactggcctgggcaacatagccagaccatgtctctaccaaaaaaaaaataaataaaaataaataaataaataaaaataaaggctgagtgcggtggcttacgcctgtaatcccaccactttgggaggctgagatgggcggatcacaaggtcaggagatcaaaaccatcttggctaacacagtgaaaccccgtctctacaaaaaatacaaaaaattagtcgggcatcatggcgggcacctgtactcccagctactcgggaggctgaggaaggagaatggcgtgaacccgggaggcagagcttgcagtgagtcaacactgtgccactgcgttccggcctgggtgacagagcgagactccacctcaaaaaaaagtaaaaaaaataaagataaaagttagccaggctacttgggaagctgaggcaggaagatcccttgatcccaaaagtttgcggctgcagtgagctaccattgtgccactgcacttcagactaagcaatagagcaagaccccatctctaaaataaaataaaattttggaattcatctatacaatggaatattatgcagctataaaaaagaatgaaaaggtctttatgtaccaatatggaacaatcataatgaaaaagtaaggtgaagaacagtgtgtaaggtatgctcccacttatataaaaaagggaaaaaatataataaatgaatacccatacacatatacacaaacctaccaacacataattgcttatagaagtagagaatataactagaacttaacttccctccagagaggaaagctttttgttagaagtgaagattgagggctgggtgcagtggctcacatctataatcccagcactttgggaggctgaggcaggcagatcacttgaggtcaggcgttcgagaccagcctggccaacatggcgaaaccccatctctactaaaaacacaaaaatcagctgggcatggtggcaggcgtctgtaatcccagctattcagaaggctgaggcaggaggatcgcctgaacccaggaggcagaggttgcaggagttgaggctgcaccactgcacttcagcctcggtgacagaacaagactccatcttaaaaaaaaaaaaaaaaaaaagaaaaggaaagaacattgaggagtctttttcctgtatactcttttacatatatatatgtgtatgtgtgtgtgtgtgtgtgtgtgtgtgtgtgtgtgtggtgtgtgtatatatgtgtatgtgtatatatatacatgtgtgtatatatatatgtgtatatatatatatatgtttgtgtatatatatatgtgtgtgtgtatatatatatatatatatatttttttttttttttttagacgcagtttcactcgtcacccaggctggagtgcaatggcacaatctcggcttactgcaacctctgcctcctgggttcaagctattctcctgcctcagtctcccgagtagcagggattacaggtgtgtgccaccatgcccagctaatttttgtgtttttttttttgttttttgtttttttagagacggagttttgctcatcactcagattggagtgcaatggcacaatctcggctcaccgcaacctccacctcccaggttcaagcaattctcttgcctcaacctcccaagtagctaggattacaggtgtacaccaccatgcctggctaaatttgtatttttagcagagatggggttttgccatgttggccaggctggtttcgaattcctgaccttagatgatccacccgcctcagcctcccaaagtgctgggattacaggcataagccactgcacccagcttcttttacatattttcaattttgaatcatataaatacattgcctattcaaaagtacataaactttacattgaaaaaaatgttctctaatttgtggtagcaacagaatataaaggctacagtaatgctagggcccaaagacccagttttgcaagggacccatatgtgaagaaagcaggtgggggggttctaaggtcattttccccaaattatttatcactcagtaaataaactaacatctgtgtcagcatgcctgtcacttgagtttactgtatttactctaataattatattttccacataagattgtcagctccctaaagagatttttctatcatctttgtaactgtgtggagctccaccccaggtgggagttccattaactggctggtggtcagcacctatagctctggtgacgtctctgctgggatagcactccttgagcagctttgacagtggctctcgcccttggaggtacatcagagtcccccgggaagcttttaaaaatactgatgcctggcctcacccctagagattctcgtttgttctggggagagatctgggcactggtaattgttaaaagctccccagctgattctaatgtgcagacagatttaagacccattgatctatgagaacaatagtgaagatagagaagaggaataattatagataaagggcagtataaaaccatttcacaagccacggataaggcataagaataacttttattttttgagacagtctcactctgttgcccaggctggagggcagtggcacaaacttggctcactacaatctccgcctcccaggttcaagcaattctcctgcctcagcctcctgagtagctacaattacaggctcataccaccacacccagctaatttttgcatttttagtagagacggggtttcgccatgttgggcaggctggtcttgaactcctgacctcaggtgatccacccaccttggcctcccaaagtcgtgggataacaggcatgagccactgcacttggccgagccataattttttttttttttgagactgagtcttggtctgttgcccaggctggggtgcaatggcgcgatcttggctcactgcatcctccgcctcctggattcaagcgattttcctacctcagcctcccgagtagctgagattaacagatgcgcataaccactcccggttaatttctgtatttttagtagagacggcgtttcaccatgttggccaagctggtctcaaactcctgatctctggtgatccactcgccttggcctcccaaagtgctgggattacaggcgtgagcgatcgtgcctggctggcataattatttttaagtgtgaggtttaaatagtctgccttatatcaattctaaggtattatataatcttgaagcaacaaattaaaccacaaatgaacctccctaggttctcccacttagaaacatttacactgagattagtttatcactttttgtggaaatacctgataattaaatttaaaaggatttcaaaaaataggagaacgactttgacatcaaggaagcattatgaggccaagtgcagtggcccacacctgtaaccccagcactttgggaggttgaggtggtccgatcacttgagcccaggagtttgaggccagcctggacaacaaggtgaaatcacgtctctaccaaaaaaacaaaaaattagccaggcatggtagtgcatgcctgtagtcccagctactcaggaggctgtggtgggaggatcacttgagcccaggaggcagaggttgtagtgagctgagattgaaccactgcactccagcctgagtgacagcgtgagaccctgtctcaaaaacattaacaaaaacaaaacccacttttgctcttaaaagtatccactgcaggccaggcacggtggctcatgcctgtaatcccagcactttgggaggctgaggcgggtggatcagctgaggtcaggagttcaagacctgcctggccaacatggtgaaaccccatctatactaaaaatacaagaattagccaggtgtggtggcatgcaactattaatcccagctacttgggagcctggggcaggagaatcactggaatccgggaggcacaggttgcagtgagctgagatcacgtcaccgcactccagcctgggtgacaaagcaagactctgtctcaaaaaaaaaaaactatccactgcataaaatagaaatccatgagtctaaactggggtgtgtgtgtgtgtgtgtgtgtgtgtatacagatatataactgagtaaataaatgggggagaaggaaatctcttcctgacagtaatatgccaactataataaatgtagaagtataatcaaaaaatcaccatttgtcaaccatcatggtggtggctgactcaggcaacagttgtcaacggatgctaagcccggtaggtggaggtctgatatgaacaggatattggcataatctcagaatccatctctcctcaaagggcactggccagttacaaggggagaaaacagggtctctgtgctagagatgcttggaggacaccaatgtaactgggtgaccagggttatcaccaccagaagtgagacaggacagccatacacctcctgatgtggtgcactgctgagagtccagcctaatttctgtggtcttactgccaaaaatgtatgacctggttatgatgatggatgcacaactctgtacaaacagatttcagcacttaacaaggatgagtggcatggtatgcaaattgtatctcaatacagtgatggttataaaagtctctaacccaagtctgatcataagacaacagcctaggccaggtgtggtggctcatgcctgtaatcccagtactttgggaggccaaggtgggtggatcacctgaggtcaggagtccaagaccagcctggctaacacggtgaaatcctgtctctactaaaaaaacagaaattagctgggcatggtggtgggtgcctgtaatcccagctacttgggaggctgaggcaggagaattgcttgaacccaggaggcggaggttgcagtgagcggaaattgcaccactgcactccagcctgggtgacagagagagactccatttcaaaaaaaaaaaaaaaaaaagaaagaaaagaaaacatcctaggcaacacagggagatcccatctctacagaaaaatacaacaatcagccagatgtgatggtgcatgtcagtagtcccagctacttgggaggctatggcagaaggactgcttgaatccacgaggtcaaggctacagtcagctgtgatagtgtgactgcactccagcttgggtgacacagcaagaccccatcttaaaaaaaaaaaaaaagagaagaagaaaacattagctaaacacaggctgagaattatcagagtgaaaggcctgtattcttttttttttttttttttgagacagtcttgctgtgtcacccaggctagcgtgcagtggcatgatctccactcactgccacctccgcctcacagattcaagcgattctcctgcctcagcctgccgagtagctgggattacaggtgcacaccaccacgcccagctaatttttgtatgtttagcagagacaggttttcaccatgttggccaggctggtatcgaactcctgacctgaggtgatctgcccacctcagcctcccagagtgctgggattacaggtgtgagccaccatgcccggccaatattgttgtatgaatctaacattacttgtatagtggtataatattaattaatgatggattataagaatccattctgtaatctctgtaactattacaaattaatataaagggacttagcttacaagccaatagagcagaaaatacttgacctaaaagaaggtgagcacagagaaactaagcctatagagcatatttctcttggagaatgagaacaatattaagaacctagcaattaagcaaacacaagcagttgtctgctttgcttaaatgcagtccacattatttacaaacacaaatttttgtcaaagtctaaaatgttgctgggtacagtgggtcatgcctgtagtcccagcactttgggaggccaaggtgggaggactgcttgaggccaggaattcaagctcagcctgggtaagaaagcgagatcctgtctaccaaaacaccaccaccaaaaaaaaaaaaaaaaaaaaaaaaaaaaaaaggaaaacgacgaaatttgccaactctctaaaaaccagagaacatgagcattattagtcatccttaaacaaaattcaggagattccaccttgcttcttctcatgctacttagcaacatttagattagctactggtggggcagtatctctgaaaggagagggaatctgatacgattagtgcagcacagccatgagccaaatgcagtctgatccttacctgccctgctccaaaaggacaatatccttccaccccattttggattggtgatgggccacagaagtgcccgtgattccacctccacagacgaccacctgtgcctgggtgggcagggccatggaacgcgcctcggcagctgatgcgctgtttcttgcagaggaccagttctgccatcctgggctggctctttgtcttccaacaatcgacagcaaccagtagaacatcatgtctctcaccaactagatctcaggaactcaaactagacagagaaaccaaacatatttcatgccattcaactcagtgcatgggattaatgagaaagggatttgacaaagaacgatagccattcattcagcaaatatttgagggtggccgggcgcggtgcctcacacctgtaatcccagcactctgggaggccgaggcgggcggatcacgaggtcaggagatcgagaccatcctggctaacacagtgaaaccccgtctctactaaaaacacaaaaaattaggctgggcgcagtggctcacatctataatcccagcactttgggaggccgcggcgagtggataacgaggtcaggtgttcgagaccagcctgaccaacatggtgaaaccctgtctctactaaaaatacaaaaattagctgggcatggtggcgggtgcctgtaatcccagctactcaggaggctgaggcaggagaattgcttgaacccgggaggcggaggttgcagtgagcagagatcgcgccaccgcactccagcctgggcgacagagcgagactccgtctcaaaaaacaaaaacaaaaacaaaaaaagaaatatttgagggcattctgagtttcagatattctgctagcagtgaacaagaatggggaagtccctgtctttatgaaatttacatttgagagtttgcgtgtgtgaatgaggagagcaccaatcaatatacaagtaaacatacaaataaaacagtaaataaagctaatgtgatagagtaactaggggcatatttaaaacaggatggtcagaaacagcctccaaggaagtgacatttggaaacagacctgaaggataaggaacgagctatacatttggcagacactgagacgagcatgtgcaaaagccctgaggtaagacagaccaagaacaaaaaggaggccggcatgtacacgacacggggagtgtggggagatgatctaagacaatgctggagaggcaggcggaagccagttacacacagcccttgggtgccatcagcaggagttggaattttattcaaagtacaaaggaaaatcactcatgcgggagtatcactagcaggggaatgaaatgatctgggatgtttttcttttctttgttttttttggcggtgaggggtggggggatgttttccaaaggtcagtctggctccatggtggagagcggatggtagaattataaaaacagagtcgacttcctaggctcaagtgatcctcccaccttggtctcccaaagtgctgagattacaggcatgaaccactgcccttggacaaggcagggttttaacaaacttaatctatcagcaaaacagatgactgttcaagtttcaagaaactgaagaagaaagcacctactggctgtccatgcagtcatgtgtacaggaggatgaggactttgagacgagaggcggtagacaagggggcctcagggcagctcactgctagtcatctccttaccgcctccactgccagccacaggacccacagatgctccacagtcagcccaaattgtccaaggccaaggtatctatgtccatccatcagaattgcaaccaatgcaagcacagactatgtccagacagacatcccatccaactggagacaaattgtcttggccaccttgtggttgccaccatgcctctcatccctggtccctgttaagcaccatctcaaaacagaagcttctctacccggctagtctttacataatctcatctctacgtgaccaatttatttcccgtggcccaagctctctttgctttcctctccttcaagctcctctactgcaccctctagaatacctttcccaaaggtaaacacccacccctttgctgacatcctctctaccctctgtcccaatggcaacacagctctcctggggaactgctgctgccaaatggccagccccatcccattgacctcactgtcaacctcctggcttctgacccgtgaccactcggttatacttgaaaactgtcctgctccttggtggcttaggctagcacatgttaagccacaggtagacctctgtctgtattcaggttcagagcccagctattcctctctcaaccttcaacttcacctcctttcttccctcattctaagcagataacctggctcatctcattccctgaaacccttcctatagacccacttacatctgcaaccatctcttccttcttttatccactggaaagttaatctcccccaagggccctggatcccacttcctcctctcttctcttgaccctagctccatcaactgctgtctctctttcctgtacctgcaatgtttccctccgtttttgctccttttcctcagcaatttttttttttttgagacggagtctcgctctgtcgcccagttgggagtgcagcggtgtgatctcggctcactgcaacctctacattccaggttcaagcaattctcctgcctcggcctcctgaacagctggcactataagtacgcgccaccacgcccagctactttttgtatttttagtagagatagggtttcgccatgttaattaggctggttttgaactcctcacctcgggtgatccactggccttggcctcccaaagtgctgggattacaggtgtaagccaccacacccaccttaatgactttctgatgccctcaggaaaaaggcaaaactcttttcatatcaagtgcaagatccttcacagtctggttcttatctgtggtctcatttctcctttcctcacactctgaccaagccagactgaacaacctgtaattcgtcaaacatatcaggtgaggtgtgaatgttctattcggctccaggttctgtgcatgctgttccctcctggcaggttcctgccacccctcccgcaaatacaggtaatctcctcaggtcacagcctctttgacatcttatttatttattttttttgagatggagtctcgctctgtcgcccacgctggagtgcagtggtgcgatctcagctcactgcaagctctgcctcctggattgatgccattctcctgcctcagcctcctgagtagctgggactacaggcacccgccaccatgcctggctaatttttttttttaatttttaggagagacggggtttcaccatgttagccaggatggtctcaatctcccgacctcgtgatccgcctgccttggcctcccaaagtgctgggattacaggtatgagccaccgtgcccagccctgtctttgacatcttatctgacaatctccccctccttctccaacacttggttaggtggcttttctatgttctcctataacacactacacttctcccagcacagaacttaccacactgcacaatggtctgtttgccaatcagagaagcaacatgccagcatggcagggaatccaggctttgggggcggacagttctgggtttgaaaatatccccacctctcactagctgtatgactatcagcaagttactaaatctctaggctttgaactcctcatctgtaacacgggctagaaacacctacctcacatggttgctgcaaagactaaatcagacaaggcaggaagaacatggtacaagcacctaagaagcactcagtaagtggtagttattttttattattttttgagacgaggtctgtcatgcaggctggagtacagcggcatgatcatggctcactgcagtctcaaccacccagactcaagcgatcctcccacctcagcctccagagtagctgggaccacagatgtgtaccatcacactcagctaattttaaaattatgaatatttgtagaggtgaggtctcactacgttgcccaggatggtctcgagctcctgacctcaagtgatctgcccacattggcctcccaaagtgctggaattacaggctaagccaccacacccggcctattatttccctattataatggaactaagagcagaaaccttataaattgctcaattttcccagcgttcagcataggtacctaggaaatatatgttgatgcatgaatgagaacagagaacaaagaagatggggggaaaaaatcaaaggtaggacccccagatttgaggagatatctaaatacctgagagaattatttttatttttatttattgtgaaacagagtctcactctgtcgcccaggctgaagtgcagaggcgtgatctcagctcactgcaacctctgccttccaggttcaagtgtttctcccgcctcagcctcccgagtagctgggattacaggcgcacgccactgtgcccgactaattttttgtatttttagtagagatggagtttcaccatgttggccaggctggtctcgaactcctgacctcaggtgatccacccaccttggcctcccaaagtgctgggattacaggcatgagccactgtgaccggccaataatttttaaagctaatatttttataagtagttacaatgcaccagatactgcctatgtatataactaatttaatcctcacaaccttatgaggtagatactagcatttctattctacacttgaggaaacaggcacagataagtggaagtgactcacccaaggtcctaccaaactgttgagtagcagaaccctgccaatttggcattagtggccggctatttaatcatgactccacgctacctttcaaataaaagcagatggtaaggaaaggacagctgtgaggactgaaccattaagcacattcccctaacagagaaagggaattgcaaaggtggcagaacaaacacagtaacagatgagttttaaggaggaattaaaaaaaaactttaggccgggcgccatgtctcacgcctgtaatctcagcactttgggaggccgaggcgggtagatcatttgaggtcggaaattggagaccagcctggcaaacatggtgaaactccgtctctaccaaagatacaaaaaattagctgggtgtggtggcacgcacctgtggtcccaggtactcatggtgcggccaccattgcatcttgggcctcactaaccagttcccgtttgttggattcaatactgtctcaccacacaggccaatcttgtgttttattaattttttaaatttttttttttttttttgtagagatgggctcactatgttgcccaggctggtcctgaactcctgaggtaggaggatcgcttgagcctgggagacagaggttgcagtgagccgagattatgctactgcactcctgcctgggtgacacagtgagactctgtcttaaacaaaacaaaacaaaaaaaggccaggcgcaggggctcacacctgtaatcctagcactttgggaggccaaggtgggtggatcatttgaggtcaggagtttgagaccagcctgatcagcatggtgaaaccccgtctctactaaaaacagaaaaattagccaggtgtcgtggcttgcacctgtagtcccagctactcaggaggctgagacaggaaaattgcttcaaccagggagatggaggctgcagtgcgcagagtcgcgccactgcctgggtgacacagtgagactccatctcaaaaaagcccagggtgcttggcgccaaaaaagggatctctgaccttgtgttcattatgaccttcaaaagagtgaagtggtgagggcatgagggcagaggaaaagaagggcttaagacaacgaaggaaaagaaggcaccagagtctagtgcctttgccgccaaacctaagcctataaggttggcagcaaaaccaaagcacaaactgatagcaaaggaggtaaagccaggggagaagaaactgaagacgtcaaagacagaaatgaagcacatcatctggtttaaaacaaatgatagagtttttacagttctggaaaatgaccgtataatattctctgctaagaagaataacttctgctaaacaaccataagactgcagctggctctactcagatctgcttattccaacaagaccaaggtgctagttctaacttcgagtagtccctctgtatggctgcagcgttgcgcacagtggactgccggtcacaaggaagactggatgagcgtgggttcacacatttcccacacttgcctcagcaaaagaaccacctgggacacttgtttaaaaatgacagattcccacggtccacctcggcagattctgatcctgccacgccagggagctgtatttttcaacaagtacaccaggtgatcacgcaagtttaagaaattagcacaagttggccgggcgcagtggctcacgcctgtaatcccagcactttgggaggctgaggcgggcgaatcacgaggtcaggagttccagaccagcctggccaacatagtgaaaccccgtctctactaaaaacacaaaaattagccgggcgtggtggcgcacacctgtattcccagctacttgggaggctgaggcaggagaattgcttgaacccaggaggcagaggttgcagtgagccgagatcgcgccactgcactcccgcctgggcgacagagtgagactccgtctcggaaaaaagaaaaaaaaagaaaaaagaaaaaagaaattaacacaagtccctgccactggaaacgcatatccgttgggctggctcctcctccaccaccagcccccatcccggtacatcacgtttacatgcatgcggaaaatgggcttggagattcttgattcaaatccgaggtatcacacatcggcccccaaaggtcaaacattaagaaggaagcttactgccctgtcccagacttttctaggtgacttcttcctccggactctgcagcagtcttactagttctgaaagcacaagcggaccgcacgtctcaacgcgggaaaacagttccatctgcagggatggaggaccgggctagacaagctggagttggctctgcgccgcaggggtgtgcaagcccaagactggggagcccgaggtcaccccggccgccctggcatcggggctgaggtgcaggctcctggaggagcggtgcgcaggcccaggggtagccgaggacacaagccaaggcacgagcggacaaccttacggggacgagtactaccgcccggacgcgacttcgcgagaggccaggcggaacccactggaagcgtgagctagcggggaccacccccgggcgaaaccaaaggagaaagaggggaacccaggggtcccggggcgcttaggcccgcgcggacggggaggccagagttgccccgaagctatctccttacctcaccggcccccacgggctccgcgctcagctacagcccggcgggagcaatgcggcagccacaacagttgccggcggtcgccgcgggccggaaagcggggttcggggatgggaagggggcggggcgaagcgagcaaaaagttccggggaagccgagaccgcgaccttccgcgctttacggcccccgggcacgggtaccgccggcgcgtgacctcagccgcgcccgagcgcgccgtgacgccctcgcggagccccgcccctgccacgtgggcttgtttgggtctcgcgaggcaccgcccccgcggcctctttgccaccctcagaggcgagctgtggaagccttgactcttagggccgttttagaacccgggcctcggaccggcggggtttctgcacgtggaaccggaacatctgagatgatcgcaggccctgtggagtgtggggagcgcgggggttctttcttccctcgaggcccgtgccagggcttactccaaagccagtgggtccccagtcctaagccaagcagtcccgggggaaaacgcttctcatcgccgtgggagcgcggatcttggaagtggctctgggctttcttgggcgaggctctcacagagtagatcggaaatccattctgctggcccgccccacctcggaggacggactaacggacctgagttcccggccctatcttactcttctcagcttctcagcttggctcagctcagaggaagaggaatcactgaagtctcagagaagtctccactcatcccttcctcaccgtcacatcagccttttctttccttctagaagtcatcactgactcaaggatataagtttgatgactgtcttttccactggtgtgacacgatctctgtcgacagaaccttagtcttatgcatagctttattctcagcacccagaacagtgcctggcacctcttccactgaatattatatgcataagggtctcatgctgcagccaccattgcatcttgggccacactatccagttcccgtttgttggattcaatactgtctcaccacacaaaccaatcttgtgttttattaattaaaaaaaattttttttttttttgtagagataggctcactgtgttgcccaggctgggcctgaactcctggcttcaagtgatccttccatctcagcctcccaaagtcctgggattacaggcgtgagccactgtgcctgccccaatcttgtgttttattgctggccacctgtagccaggcactgtgcaggatgatgggatccagcagtgtacaagaaagaggcggtttctgctcttagggagtggcagtcaagttccagggacccctctgtcacaaggccaggccacagcctacatagtttataccccatttactggccagtcaaatcacacaaagacagcccagatgaggtctgccagacagtggactgaaactatgccataggctcctgtgctagataaatacttccatattttagctaggattgaatgcttggggacacctacctgtctaaaaaaagagaaaacggctgaccaatttgagacattctcggggaaggctttcctgatgcccagatgtggcaatttcatgaaaaatatcacaggttttcctcatgaaccatttggttcaagccatttccaggcacatgaatttgggagaaacctggttgtctgcaggagatggtggatgaaatcaagtgaaatacttaatgtgttgatttcattctgtttacgtgcagtaaatagcaaacaaatggtatagatctgtccctgatttccttctccatcaccatgatcggcctccactccaaaatgctaagtcaggctgggtgcggtggctcatgcctataatgccagcactttgggaggccaaggcagttggatcacgtgaggtcagaagttcgagaccagcctgatcaatatggtgaaaccccatctctactaaaaaatacaaaaattagctgggcgtggtgacacatgcctgtaatcccagctacttgggaggctgggacaggagaattgcttaaacccaggaggcggaggttgcagtgagctaagattgtgtcactgcactctagcctaggtgacagagcgagactgtctcaaaaaaaaaaaaaaaaaaaaaggaaggaagtcctaaggcccctttcattgtcaaagatgggtcttgtccttagtaggttctcataaccactgatgcactattttttctagggggttgagtgtttttattttattattattttttagatggaggctcactctgttgcccaggctggagtgcaatggcgtggtctcggttcactgcaacctctgcctcccaggttcaggcgattctcctacctcagcctccccagtagctgggactgtacaggcgtgcgccaccacgctgggctaatttttgtatttttattagagacagggtttcactatgttggccaggctggtcccaaactcctgacctcatgatccgcccacctaggcctcccaaagtgctggaattacaggtgtgagccaccgcgtccagcctatttttattttttgagattagctctcactctgtcacccaggctggagcacagtggtgcaatcacggctcactgcagtcttaacttcctgggctctagcgattctcccacctcagcctcccgaatagctgagacctcaggcgtgttccaccgtccccagctaacttttgtattttttggtagaggtggggtttcactatgttgctgaggctggcattaaactcctgacctcaagagatccacctgccttggcctcccaatgtgctgggattagaggcatgagccaccacgtcctgccctaaacagacgttttaattacgcttgtcaagtcctcttgtgaaatattcatctgcagtgacttggtaaatgtgtttgctaccacacaggataaacagtgtacagacaaacatttgacatacctatgttaccacagtgtaagaatgaatttggatctgaggtcgctaagatgcaggcgtttatcttacctccctccagcaccggcatggctgtggggaaggcctccctcctccctctgaagttcttgtcgccatcagtagactggacatctgcctacaaccgacttcacagaaaggacctgacacctggcatgcttctcgtgtgcttgagagcctgtgtttgtgtggaaagcagggatgttctcattcacaccatgggaagagaagaatgttgcgagtaacaatcagtactttttttttttttttttttttttgtgagacagagtcttgctttgtcacccaggctggagtacggtggcgcgatcttggctcactgcaagctctgcctcccgggttcacgccattctcctgcatcagcctcccgagcagctgggactacaggcgcatgccaccatgcccagctaatttttgtatttttagtagagacagggtttcaccatgttggccaggatggtctcgatctcttgatccactgcgcccagccaggaacttcttttttttttttgagacggagtctcactgtgtcgccaggctagactgctgtagtgcgatctcggctcactgcaacctccaactccctggttcaagggattctcctgcctctgcctcctgagtagctgggattacaggcgtgtgccaccacacccagctaaattttgtatttttaatagagatggggtttcactatgttggccaggatggtctcgatctcctgaccttgtgatccgctcgcctcggcctcccagagtgttgggattacaggcatgagccactacacccggcctggaacttctctctctttttttttttttgagacggagtctcgctcagtcacccaggctggagtgcagtggcaccatctcggctcgctgcaagctccgtctcctgggttcatgccattctcctgcctcagcctcccgagtagctgggactacaggcgcccaccactatgcccggctaatttttttgtatttttagtagagatggggtttcaccgtgttagccaggatggtctcgatctcctgacctcgtgatctgcctgcctcagcctcccaaagtgctgggattacaggcgtgggccgcggcacccggcccaggaacttctcttatatctagaagccaccggatgttaactaagagtcctgggaagaaatggtagtcatttaaagcttttttaagagggaagacttgcactgggtcttaatgaaaatacataggacaaaatttttccttctgtatcagctcacgtaatctttctggcaatctcatgaagtaaattttagcagatagagtagacacagatgtaacatgacttttccaagatcacacacctaggaggaaggaccagaaatggagctcttcccatgttgaatatctgaatctaatgatctttgcactatgccataggacaggtggccaggaaagcatctgagactgggtgatgtaagggctggatacagagacagaaaaaagcaggcagtgtaacaggaaggaacgcagctagctatggtagatgggatgttgttttcaattcctcattccctattgccatgtgaccttgcagtgcacgaaatggggggagtaggattcctgtcccactgatgttggttggcttcagtcaaacattattattattattttgagatggagtcttgctctgtcgctaggctggagtgcagtggcacgatctcggctcactgcaacctctgcctcctgggttcaagcaattcttctgcctcagcctcccgattagctggtactacaggagcacgccaccacacccagctaatttttgtatatataaattttttttagttgagacagggtttcaccatgttggccaggatggcctcaatctcttgaccttgtgatccgcccgccttggcctcccaacgtgctgggattacaggcgtgagccattgcacctggccaaccaaacttattttttaaggtgggtagaagccatagtgtacagatctggagattggccttaagaggtgttgagcatgtcatcagcccttgtcacaagtttatgccctgagtagctgttggatcatggaaagtgaaaggcacttgaaacagacctgaactcagcctgaagccaagcctgctgaccctcagcctgaaacaaagctgtccaagcctgctgaccctcagtttgaaacaaagctgtccaagcctactgactctcagtttgaaacacagctgtccagctagaccatagtcacctacagtctcatgagcatggcactgaatgctttgttgtaaggcactgagttttgggctggtttactaggtagccttttttgcagctcaaataaaggctgtctgatagtgcaattatataagaatggtgaaatcagggcctacgccttcttaaggaaatcttcactcactgcagtcttgcaagtcaatggtcttattctgcttatccaactaattctggagcagctacatctgggaaccccgtaggctcacgtctacaacagtgtcttcatcctgtcttctcaatcagccccttctatttccagttccaggaatggccaaccacaccagaaacctgggactcacctggtctccccactcgcctctccctccacctcctgctcatcacccagcctcaaagggtctgtctcctcagtgcctctcctctgttcggacctctctgtccctaccaccgctgctgtggttgagagggttgtcagccctgacttcgagaacaatctttttttttttttgagatggagcctcagtctgtcgcccaggctggagtgcagtggtgcgatcttggctcactgcaacctccgcctcccgggttgaagtgattctcctgcctcagcctcctgagtagctgggattacaggcatgcaccaccatgccccgctaatttttgtatgtttagtagagactgggtttcaccatattggtcaggctggtctcgaactccaaaccttgtgatccgcccgcctctgagatcagaactgagatcacgccactgcattccaacctgggcaacaagagctaactctgtctcaaaaaaaaaaaaaaaagtttttaaagacagggtctcgctatgttgcccatgctggtcttgaattcctggggtcaagtgatgcttctgctttagcctcccaaggagctggaatcatgggtgcccaccaccatgctcggctactattttcttcaaaattcaaatattctagcttaacagtacctattagataaataaatggcaattttctggaacattctttttttggttttgttttggttttttttttttttttttttttttgaaacggagtctccctctgtcgcccaggctggagtgcagtggcgcaatctcggctcactgccagctccgcttcccgagttcacgccattctcctgcctcagcctgccgagtagctacgactacaggtgcctgctaccacgcccggctaatttttctgtagttttagtagagacggggtttcaccgtgttagccaggatggtctcgatctcctgacctcgtgatccacccgcctcggcctcccaaagtgctgggattacaggcttgagccgtggcacccggcccaggaacttctcttatatctagaagccaggcttggtgactctacttgctcaccagatgatcctacacctgccacctccgatggatccactgcctctgtgcctgcctgtactgctgatgctccagtggataactcagcatcccagcctaggcccaatgccactgaagatggacctgccccctggagacccaggagttctaccactcagctgtccccagaagtgcccagaccctcattcttatccaggacctaggagccctaccccctggccttccgtcatcagccgtaaatgatgatttactgctgttaccatcatcactgcatttagtaaccaagggccttccaaggtgccagctctggaacgaaggatgcctttgggaggtgatgacactcaggtacacgggtgctcaacagattgcttcctcctatcctcagatggtctttgcatgcatgcagccattggcactcccattgtacgcaaggaaaccagcccagggtcacacagctggtcagcagcaacacagctggtctcaaatctaaggtgcctggccatgcctccatgagggaccgcctgcaagggaggttgatcctggctttggggagcctttcctgggctgcacgagtaacctccaatgtttgaggccccaaactctgctcacatcttcctttccctgtctctgcttgggctatgatcacggtgactctagcaacccttcatggacattatagtactctctgccattcacttttggtctaatctgacttcaacccccacttacttggtctctccttttacaaccaacacaaccgaaatccgagggcttctttttttttgagacagagtctcattccattctgtcacccaggctggagtgcaatggcacgatctcggctcactgcaacctccacctcctgggttcaagggattgtcctgcctcagcctcctgagtagctgggattacaggcgggtgccaccgtgcctggctaatttttgtatttttagtagagacggggtttcaccatgttggtcaggctgatctcgaactcctaacctcgtgatccgcctgcctcagcctcccaaagtgctgggattacaggcgtgagccaccatgcccagccaaatctagggctggaacatggctgcagcatataaatagaattgaattccatagttttgttaaccctgttttttgtttgtttgtagttgttgctgtttttgagactgagtctcgctctgtcgcctaggctggagtgcagtggtgcaatctcggctcactgcagactctgcctcccgggttcaaactattctcctgcctcagcctcccaagtaggtgggactaaggcgcccaccaccacacccggctaatttttgtattttattagagacagggtttcaccatattggccaggctggtctggaactcctgaccttgtgatccacccacctcggcctcccaaagtgctgggattacaggcgtgagccaccacacccagcccctgttttgtttttgttttgcttgtttcttagggttgtttttctatttatggtaaaggcattggctttccatttgtagcatcaatagaatatttcctgtttacaataaccttatgtcatagtaaatggtaaagggatttaaagcagtggttttcagctgccagaggcctgagtgagtttgggcacactctgtgtgatcgggcagaaggcctgtgggaagttcagctgaggacagggccaggaaaggtgatggacagtgggggtctgtcctggtcaccagacccctgggtcctgcccacctgcttggagctccccacccatcacacatgatgctgccaagccctctgggtattgtgggcaaataccttaggagagaagctgatgaactttgtttcttgaaatgcacagattccttggacgtccctgagaggtcaatgatgaaggtcaacttggttttctccccctcatttgggttcagaatttaaagtccacacacacaggcagtaagatgattatagataaggacatcatcactcggtttcagatgttaaaatgtctaggtgggttaggggtgatttgagatcacacaaccttgtgccacaaagaggaattcccaggccagggggagacattttattgccatgttatgatctcatcattgagttgaaaggcaatcttgtttcattttggattctttcttatgtttatgtcttataagggcactttgaatttccaagcaaataataattttgaattagcttttaatcattgacttctagcacagttatatgatcagaaacatgctgtgtgatttgattgctctcaaatatattgagatttgctggaacaaaataagtcaggttaatttttgtaaatgtaccatgcatgcttaaaatgaatgtatctacatttgttcctgagatacaggttgatggacggatggctacatggatgtgatggagatggtttactatcgggaccttccgcatcctgctgatgttttgttgcttaggatatgaatggctgagcggaggctgtaaaacctggcactctgcttgggtatgaagttcttcctgccatcctgccatcatttgttttttatgttttgtcgccaaaagtgaccttgaggaaccctgggagctcaggaaggaaggagagcccagaagcagggacagggagctggttggggaggaccagaaatcaggtttgtgaaggttccagagaggacctgtccttgcgaggagtgtgggagactgagatgggggaggggtcattggaatgatgcgggcgctacttggcattgtccattgtgaggcaccaccggggtcatcagggattggtggagagggagtataaagccccagggttgctaagggagggcccagaccgaagaaggtttggtggatagcagaacctttttgtctccctctaattgctcctaagcctcacgctcccttgccccacgtgtcctgttgcttccctgatcttctccgtgacctgtagctaaaccttccaccagcgcttgagaacttaatttgaaccggatcctttcccagacccctttcttctcctcctcctcctcctccacctcctccaggtgcccaacagcccccttctcctcctttcccttcccttacttccccccttcccctcccctccccctccccctcccctccccctcccctccccctcccctccccctcccctccccctcccctccccctccccaacttagatccggccccggtccccgtccccttccctcccccctgccctaagccacctccacctctgtcctggccgcctcagggcgccctgaaaggaccaggacatgcggctgcgcttttggctcctcatttggctcctgctgggatttatcagccatcagcccacccctgtgagtagacgctggacccgccgggtttcttcctttttactgggctgtgtcacgcggcatgaaattacacagctcaggcctgtaatcccagcactttagggggccgaggtgggcagatcacttgagtccaggagttgaagactagccagggcatcatggcgaaaccccatctctacaaaaaattccaaaaaagattagtcgggcctggtggtgcgtacctgttatcacagttactggagaggctgaggtgggaggatcgcttgggcccaggagctggacgttgcagtgagctgagatggccccgctgcactcttgtctctaacaaacaaaatggaccaaaacaaagtgaaatgtcatttgatttgtgtcacctggtttgatgcctttttttttttttttttttttttgacagagtctcactctgtcgcccaggctggagtgcagtggcaagatctcggctcactgcaacctccgcttccggggttcaagcaattgtcctgcctcagcctcctgagtagctcagattacaacgcctggctaatttttgtatttttagtagagacggggttttaccatgttcgccaggatagtctccatctcttgacctcgtgatccgcctgcctcggcctcccagtgctgggattacaggcgtgaaccaccgcgcctggccaaaatatataaccttaagtgtaagtttactaactttggaaagtacatacaccagcataaaccgaccccctttcaagatctacattattttatttatttatttatttatttgagacagtttctcccttgttgtccaggctggagtgcaatggggcaatatcagctcaccgcaaccgctgcttcccaggttcgagcgattctcctgcctcagcctcccgagtggctgggattacagacatgtgccaccactcccagctaattttgtatttttagtagagatagggtttctccatgttggtcaggctggttttgaactcccgacctcaggtgatccgcccgccttggcctcccaaagtgttgggattacaggcgtgaaccaccgtgcccagccaagatctacactattatgtcaccccagaaagtgaactcccactcttcccagccagtctctttcttatcataggttagcttgcttattctggaatttcgcgtatacagatgcatgccatgccataggtactcttttgtgtctgctttattctgctcaacaccatgtttctgaaatcattaccgttgttgtatggttctctaactccatcatttccatttcagactcagcatatgctgagttccacctgttgaagggctatctctgtttaattcaccatcttgaaagaaacatttaaaattgagatgttttcaagaatatatagttaaatcctgaggaatcgatgtagaaatgttatcacaagctgtctgaacttactcaggggaagtcttcgtcttcactcacataagagtctaatggaattaatatcaacaatcttagagaaatcccacactattcatgccattttcatgatctccaccttggtaattttttttttttttttttttttgagacagagtctcgctctgtcacccaggctgaagtgcagtggtgcgatctcggctcactgcaacctctgcctcctgggttcaagtgattcttctgcctcagcctcccaagtagctggaactataggcacgtgccaccatgccctgctaattttttgtaattttagtagagatgggtttcaccgtgttagctaggatggtctcaatctcctgatctcgtggtccacccacctcggcttcccaaagtgctgggattgcaggcgtgagccaccacacccggcccaccttgttaatttttaagcactaaaatttgatacttatttgtgaatgaagtaatctcttcattgtatttttttttttttttttacttatgctgagctttaaatgacaaagattcatataatccaagagagaagtattatttagagggattcttttaccatgtgatatataataaatgcatccaatgttatacatcaatttaaaaaacaagtaaataactttaaagaaaagataactactggccaggtgcagtggctcacacctgtattcccagcactttgggaggccgaggcaggtggatcaagaggtcacgagttggagaccagcctggccaagatggtgaaaccctgtttctactaaaaatacaaaaattagccgagtgcggtggcaggcgcctgtaatcccagttactcagtagctgaggcaggagaatcgcttgaacccgggaggcggaggttgcagtgagctgagatcatgccactgcaatctagcctgggtgacagagcaagactttgtctccaaacaaaaagaaaagataattactttatacttagcttgtcttagccatgagtgacgggctgcatgtggcccaggacagttttgaatgcagttcaacacaaatttgtaaactttcttaaaacattaggagattttggccaggtacagtggctcatgcctgtaatcccagcactttgggaggttgaggcgggcagattacctgaggtcaggagttcgagaccaccctggccaacatggcaaaaccccatctccacaaaaaatacaaaaatttgctgagtgcattgtcaggcacctgtactcccagctactcaggaggctgaggcaggagaatcacttgaacctgagaggcagaggttgcagtgagccgagagcacgccactgcactccagcctgggtgacagagtgagaccccatctcaaaaacaaaacaccaaacaaaaacaaaaacaaaaaaaaatggctgggcacggtggctcacacctgtaatcccagtactttcagaggccgaggcaggcagatcgcctgccaggagttcaaggccagactggccaacatggtgaaacctcatctctactaaaaatacaaaaatgagtcgggcatggtggcagagacctgtaatctcagctactcgggaggctgagggaggagaatggcttgagcccaggagctggaggttgcagtgagccgagattgcaccactgcactccagcctgggcgactgagtggagcggaactctgtctccaaaaaaaaaaaaaaagagtttttttttagatcatcagctattgttagtgttagtgtatgttatgtgtggctcaagacaactttgcttcttttaatataggcagggaagtgaaaagattggatatccctgctttataccaagaaagacaacaccccacatttgcaatgcctaaaaacactaccagccatctgaaaaacatgagacttctaacttctgttcttttttgtagcagtggaatcccacggtgatatctgagggatgtggttaccttttggaggaggttgacggtttctaaggatgattctttctgagtgaaatattgtcggtgtcattgaccttttcattctttcaactattattattccaggtcatcaatagtctggctgtctatcgtcatcgtgagactgactttggtgtaggagttcgagaccaccctggccaacatggcaaaaccccatctccacaaaaattggataatttgataattatcattattgggtttctgagacgtgacacatttaccattctcttctgcacaagttacctttgtgtgagtatactaactttctgtagaggtatacttgtaatcacaaataagaataaattatataaaacaattcacgtttctggacttcattatgaatatgtggttttacccaaaaaatcagggaaatgatttattagcataagaattatgaaaatgtctgccatttacattatgaaaattaaataggtcggtgtttgtttaatagaatgtcaacagagcttttggtcaaaaataagtttttttagcctttgtgctatttatcacaaatggagtatgaggtttcgtcacttaaataggaaattctttctaaactcttctgctttatagttctatcgtatgggtggaaggaaagcttccaatctcctctctgaagattcactgcagaaatgagctgacaacagacagcttaacaggaaaagaaaaacatagaacaggcataaacatgggaaccagctgaaaaatgagactgctagaagggccggatggttgatgcttaaagagcaccctcttctgaggggagagggagatagatggagatgtaggccatttagaggggcagcaaatgatttttaggggaaatgaaagaggccaaggaacaaacaattggcctgagacaaagttcctctgaggtcatagggacgaggtgacaaactgccggaaggtgaagggcagaactgcactgcgtctcatgatgcagagaaagccccagagaatctcttagaactgccctccaagagaatcaatgaaaagtgtgtctgggcagggtaattttgaatgacatcattcaaagtgcatgttcccacttgcaactggaaagagatcagtatgtcaaaagtctgtacttggtaagaatttggctgctaagttgtgccataatttgtcttttgagccttttttcctttgggtaagttgagctctacattttgtcttaccattcatgacagtaaaaatgtggttttctgggggctgaacctccttctgaacaatgatccaagataaaagtactaataccacaatgcttttttatattcaagggaagaggaagtatgtttcagttttaccacctagataattacaagtcatttggcactgcctttcaagatatgtagaaaacagaaaatatatgagttatgaagatatctaggcacatttaacattctctatgccacttagtcctgaacagagaatttttggtataaattggaggaagctttttttttttttttttttttcttttctcacccccgaaacgagtctccctctgttgcccaggctggagtataatggtgtgatctcggctcactgcaacctccacctcctggcttcaagcgattcccctgcctcagcctctcaagtagctgggattacaggtgcccaccaccatgcccagcaaatttttgtatttttagtagagtcggggttttaccatgttggccaggctagtctcaaaacccgacctcaaatgatccacccgcctcagcctcccaaagtgctgggattacaagcgtgagccaccacgtgagccaggggaagtttttaaatttaccactttttaacagttccatttaggaaagttcagttgagctgctggacttggacaacttcgcacctctcatctttgtccttgtcatctagtcatctataccattacctcctaagcagggacatcatgggtgccatgaagcattcatgcgtgatggcatttctttgcttctcatttcttcatgtgtttgacatttctcctagctccaaactgggccagctacctttcctatgaaatctagtagtagctgtgggattgacgtggttgctcttttcatctttttagattacccattgcttctctcgaaatcctagtatatgattttttttttttatcctatgtgcagaaatcaggaaaaaacaaattctacaaagaatttgaaagatattatttcaggccaggtgtggtggctcatgcctgtaatcccagcactttgggaggctgaggcaggtggatgacttgaggtcaggagttcaagaccagatgggccaacatggtgaaaccccatctctactaaaaagacaaaaattagccaggcatggtagcaggcacctataatcccagctacttgggaggccgaggcacaagaatcgcttgaatctgggaggtggaggttgccgtgagccaaggtagcgccactgcacttcagcatggttgagagtgacactccatctcaagaaaaaagtcatttcaatgactacctcaggagattcataggtatctgacccacatctgagatgggatttgcattgcattttcgctatgatgagaacaaatatttaatatcttagaagattaaaagcatactgtgataatatggaaatcttggtgggaattcagtcattagtgagaatgttttgcgttaagttcaaaccagcctcaatgaagctgatgtgagggaagggaaagtgaactctgagtagagcagggacagaaggaagatgctccagtgcagatcaggaaggagcagggggtgaaatgttacaaattctagaactcagagagctgaaggtaattacttccttttcaagttgtgaaacatgttaacctgtggtaaaatacttataagatgataattaccatctaaccgtgttgaagtgtacagttcagttgtgtgaagtatattcatgtcattttttttttttttttgagacggagtctcactctgtcaccaggctggagtgcagtggtgggatcttggctcactgcaacctctgcctcctgggttcaagcagttctcctgcctcagcctcccgagtagctgggactacaggcgtgcatcaccatgctcagctaatttttgtatttttagtagagacggggtttcaccatgttgcccaggatggtctccatctcttgaccttgtgattcacccgcctcagcctcccaaagtgctgggattacaggcgtgagctaccgcacctggcctatttttttttttttttttttttttttttttgagacagagtttcaattttgttgcccaggtttggagtgcaatggcacaatctcagctcaccacaaccttttcctgctgggttcaagtgattctcctgcctcagcctcccgactagctgggattacaggcatgcaccaccatgcctggctaattttgtatttttagcagagacagcatttctccatgttggtgaggctggtctcaaactcccgacctcaggtgatccacctgcctcggcctcccaaagtgctgggattacaggagtgagtcaccgtgccagcctcatgtcattcttgtgtgtgtgtgtgtgtgtgtgtgtgtgtgtgtgtgtgtgtgtgacagagtctcattctgtcgctcaggctggagtacagtggtgtgatctcggctcactgcaacctccgcctcccagcttcaaacggttctctgcctcagcctcccgagtagcttggattacaggcgcccgctgccatgcctggctaatttttgtatttttagtagagacagggtttcaccatcttggccaggctggtcttgaactcctgaccccgtgatccacctgcctcggcctcccaaagtactgggattatttatacgcatgagccaccgtgcccagccgtcattcttatattattatttcctaggtgtctttcctgaagactatcttctggtctcgaaatggacatgatggatccacggatgtacagcagagagcctggaggtccaaccgcagtagacagaaaggtatggctctgttggagtccccatagtgtggaaatgagtttgccctggaaagggaaagaacagcttcttgacctcaggtttctcaccttctcctctcctcactctcaccaagggctgaggtccatttgtatgcacacaaagaaaagagtttcttcctttcgaggaaataaaattggcctgaaagacgtcattactctacggaggcatgtggaaacaaaagttagagctaaaatccgtaagaggaaggtgacaacgaaaatcaaccgtcatgacaaaatcaatggaaagaggaagaccgccagaaaacagtaagatgtgccttgacacaaatactgttgtatgaaccatgtgccaatcaaagtagacaactgtaaagtccttgagaatattttctacaatatttgtggcaaattcagtgggctcaaaattgagtttgtcctttctgcttcattagtttaagctgtataattcctttcccttcctacattcttgtttgtaattttttcgggggaagaggagttgctagtactggcattggttttcctttctctcttttttttttttttcctgagatggagctttgctgttgttgcccaggctgtagtgcaatggcacaatctcagctcactgccttttggcttcaagcaattctcctgcctcagcctcccaagtagctgggattacaggtgcccaccaccacgcccagctaatttttgtatttttactagagatggggtttcaccatgttgtccaggctggtctcgaacttctgacctcaggtaatccacctgcctcagcctcccaaagtgctgggattagaggtgtgagccaccacacccagccttttttttttttttttttttaaattttgagatagaatctcgctctgtcgcccaggctggagtgctatggtgcaatcttggctcactgcaacctctgcctcccagtttgaagcaattctgcctcagcttcctgagtagcttggattacaggtgtgtgccaccacattcggccaatttttttttttttttttttgagacagagtctcactctgtcacccaggctagagtgcagtggcatgatcttggctcactgcaacctccgcctcccaggttcaagcgattcttatccctcagcctcttgagtagctgggactacaggcatatgccaccatgcccggataatttttgtattcttagtagaggcggggtttcaccatattggccaagctggtctagaactctggacatcatgatccacatacctcggcctcccaatgtgctgggattacaggcgtgagccaccgtgcccggcccaatttttgtatttttagtagagacaggggttcaccatgttggccaggctagtcttgaactcctgacctcaggtgatctgcctacctcagcctcccagtgtgagccaccgcacccagcctggattgttgaattcaatgcttgggtcacctccagattcattttcacagtctttcatgttttggtcatattacattgtattttgctgccatatgactgatctctttttgttaaatgtgagatacttgttaaaaaatatttagcaatgaattgaggcctagtggcatgttatcttgctgcagaagagatgggagtctacttctgggggatggtcacgggtcctccatacaggctgcaattgaggtcgtcggtgcaggctcagtccctagaaaggccagggtatttcctgtccacctctattctgatgcatgactcttctgggtctcaaccagagccagtggacttcagtacgggtcgctttcattggcagaccctcaatccacttgttttccatctaatcccacgcatgtgtgcaaaagctgctgtgcttctttgcatctcagtagttccttctggaattcagcaatgaaactcagggaaatggattccaaatgcgaggctgactttcgtcctgggtttccttcttctccatcttcacctcatgtctgtttactgccatgttagctatttgatgtattcaatcatgggttttatattctgtttggtgtcccccattgttctcatcggagatcagaagcttcagatgcacttatgtcaactcaagagtagaatgcttccttagcttccctccagagtcaggttttgtgtttctagttcccaagtgcacagcaggagtagtgatgtcctcactggcttctcatttgcattaaactgtgagcttctttagcgtggggacaggaccctgctcccattgcattctcagcaccacaccacacactccttgttggaggccactccagacagcatgtgctgaaggatgccctgtggtcagaaacaagttcattaactttccctttgaagtgttttcgcccctgtttcctagcgttctgggaattttacacatccttcctataaaaccaagtatcaggtgagatccttaggatcaggaccatgaatcaagtggtgtgagggcaacacagcaaacttaccctttttaggccatttcctttttctgccctcaaactctgtgaactgaaccttgttaaagtcagtcaacaccagggtggatggtttgccgttgtcacctattttcaggacataacaccctgacttaggagccattccgatcatttctaattcaatagatgcacccagcattcagattgccttttctctcaaccaggatctttaaagtcgatgacaagagttccagtcctgaatcatggcaaagtgcagtagtgaactgcggggttaatgacaccatattctggaaggatctctctatggctgatggtctcagttctggcatcagcctctgactgagaagcaggtctcacacaggaagagtcagatgaggagcaatcctctgcttccgatggagttagttgtgatgagttggtgaggtctggtttttcacactgaactaaaatgatctttcgctgtgtcaaacacaagactgaccccagacacacacatagtgcacctcatagaagcttttaatagtctttatatttactaaagaataggactaactatggaactatgaagatgagctggaaatgacaggtgacttgccagcaggccagagtgtgattttttttggtccctcaatgggaggtgtccattctcccttcggttgtgagaatcagttggttcatttgtgggaaggttgcaggggggatctttgaatcacagccttcagatgccagaagggcagagggaatcccacatggactggtggatcatgtgtgtgcatttctctcccttctaacctgaggaaactaagcatgaaagaatgtgagcacacagaaaaggagaggcaggtatcagaggcagaggaaaatgggaaattggatatgaaagaaatacacacctacaagtgagttcagaaactgaaccccaccctcctgggaaacgcccattggagtgttgtttataacctctgtacaatgtttagacccagtaaatgcagaaatagaaacaaatggtcagaagacctatcgtgagagagagagagagttcacaaaacagaaaacaaagtacctgaatatttaccagtgaccaaaagatgtgaagtagcaaaacgtctcctgaccccattgccagctagactgtgtggaaactcggttcataccagccattctaggggtggggtgagttgttgtcatccttaggaaagtgtgttgttgtaggatcaaccacatccttcaaaaggactatgcctgtttataagcccagctctttctgccctgtgaaacacggtaaggatattaatacaaagagaatacagctttatgataaaagatgctcaatgaaggatgaattagggatatactgagaatggggaaggaaactatcatctcagaagtcagcaggcagtaagcaagaggaggaatcaatatagcaacagtttggatcagaccgtacagtttttttgtttttgtttttgtttttctgagatggagtctcactgtgtcacccaggctggagtgcaatgacgtgatcttggctcactgcaacctccgcctcccaggttcaagtgattcccctgcctcagcctcccgagtagctgggattacaggtgcctgccaccacgcccggctaatcttttgtatttttagtagagacggggtttcaccgtattagccaggatggtctcaatctcctgacctcgtgatccatccgcctcgccctcccggagtgctgggactacaggcatcagccaccgtgaccggctcagactgtactcttatagccatctgaaatacgttttctaggtagagatagattgtgtaagggtacagttgtgaggataacagaaacatggcagattatttaaaatcatcctgaacatggtgctttatctgatgaaagtgattgtaatccataggaaaatgtttcaacgtgcgcaagagttgcggcggcgggcagaggactaccacaaatgcaaagtaaggagcttcctccccgcagttgcaggatagttcagtgctgatgcagatgatgccacggctcttagactctctcaacattcaatttctcatgtgttggctttttcagatccccccttctgcaagaaagcctctttgcaactgggtaagtttgcttgttttccttgcttttgaacatagtctgccaggtcaggacatggatacatttttctccctacagctctgtgctcaagccctgcagagggagatggcagagaggaaggctgcctacaggcatcacagtcccatccctgttggtaaccgtgttgtgcaaaaacaccttcatccccacccagtggggcccctgatctaatattcaaagtgtcagaggttccatatttgtaatagcaaatgggccctgactgtaaattagtgaagagtgaatgtaacttattacccacagggacaattccaaatgaaggccttaaatgatgctcagctaagctggttcttgtgtggcctctgtaccttcaaaagctgccgagtcctatgattacacgtgatgggacttgtgcacttgaagtgaaacacagttttaaaacttgctttgtttagaattcccacctcatttttccatggacaaaagtattctttatgtcctagtgcacttacaatttggtattacctgggagtgaaaagaaatattacagccatgcctaactgacttcttgaggtaagattgttctgtcagaaaaccctctcccagttcccctgcagctcttcaggaacccacatctctccagagctctttgttctcatgggtggcacctccagagtgaagaagatcctttgtcaagaagggaaacagaggggaaatgagagggtcctgcaggcagagctggaatcaacttccactctgcctcttgcaagctgtgtgaccctgggcacaatttctccttcctctggaaacctctgttttcttagatttggagcagggtggtcacactgaccttgcagagtcctgagaatcagagacagaacataaaaggcctggaaaacattctccaaaaagaagctgcaacatgtgtggacaatgggcttttcatgcctctcttactgtctcttactgtctgttgacctggtgcaagaaacatgctctggtgatggctgtgagggaggaatgaggatagacatagacactcctgtgtctcaaacatgcctctttattactctgttatgactctgtcttccctggggcaggaccccagcctgcctacatttgcagacagacacagtggcatgtggagacaacagtgtgtcccaatgacttttctttactccccagctgtcggcagtactcagtggaagggtgatatcatgacactgatactgctattttgaaacctggaggatggaaaggtgcaaaaatctatcaccagcaacagaaggtgcagactgtgttggtggcggtaattttgtccatcaaatgaatatgtgtgaaaacattccctcctttggccctacaggtcagaatggcggcagcggagcatcgtcattcttcaggattgccctgctggccctacctcacagctgaagctttaaaaaacaggatgggccgccagccacctcctccaactcaacaacattctataactgataactccctgagcctcaagacacctcccgaatgtctccttcatccccttccaccctcagtggatgataatatcaaggagtgtcctcttgctcctcttccaccctcagtggatgataatctgaaggagtatctcctggtccctcttccaccctctcctcttccaccctcagtggatgataatctgaaggactgtctctttgtccctcttccaccctctcctcttccaccctcagtggatgataatctcaagactcctcccttagctactcaggaggccgaggcggaaaaaccacccaaacccaagaggtggagggtggatgaggtggaacaatcaccgaaacccaagaggcggagggcggatgaggtggaacaatcgcccaagcccaagaggcagagggaggccgaggcacaacaattacccaaacccaagaggcggaggttgagtaagctgagaacacgccattgcactcaagcctgggcaataagaataaatccgtgggtcgaaaaaaagaaaaaaatcaaaaaacaaaacaaaacccacgctccaaaaacaaactaacgaagaataaataaataatataaaaataaaataaatactgcagtccttatgttattgctttgtttcaatatctggtatgattgcctgagggacctgaggtttttaattaattgtagggtttttttttaatctttagaagtggttggttatgtaaaatattattatttttttttttttgagactgggttttgctctgtcacccaggctggagtgcagtggctcgatcacagctcactgcagcctcaacctcctgggcttcaagcaatcctcctgcctcagcctcccaagtagctgggatcacagatgtgtgccaccacgcctggccaatgttaaaaaatcctttaacttttttgtagagatgcactcctggactcaagcgatcctcctactggtcccgaccaccagcctctttccgataaacatttacactgtttattatctgatgccatttctatcttcttccttgtcgtccagacatcaaagaattaggtttcttcagggttttctttttcaagtcctcattgttaaagatcactcacattagggccagacaccacgactcatgcctgtaatcccagcactttgggaggccgaggcgggcagagcacttgaggtggggagtttgagaccagcccggccaacttggtgaaaccccacctctactgaaaaacatacaaaaattagctgggcgtgatggtgcatgcctgtagtcccagccacttgggaggctgaggcatgagaatcgcttgaacccaggaggcagaggttgtagtgagccaagatcacatcagcacactctagcctgggtgacagagcaagactctgactcaaaaaataaataaaataaatatcacttacattagatatacccaaggggtggtctatagagagttggaagcagtggttattgcaacagggacacggaagtcatctggctatgccaggatgcccaggggatactcggggtgggtggcatggtgctgctggggactcaccgcacaggacgctctgattgacgcactgccaggagtagcgctctgtcttggggctgcagccggcctcctcagctcgagtgtaacaacagtcgtggccatggcagcacctgcggatgtcacatgggcaggacagcaggtgggtgaagctctctcctggccctcctctgctgccaggaccatgggtgactgaagacccccagggaggcacagcatcctctaagatttttttttttttttttttaatttaagagacagacagggtctttctctgtcgcccaggctggagtgcagaggcacaatcatagctcacggcagccttgaactcctgggctcaagcaatcctcccacttcagtgtcccaagtagctgagactacaggcacacgccagcatgcccggctggttttttaatttgtatttcctttgagacagcgtatctctctgtcgctcaggctggagtgcaatggctcaatcagctcactttagccttgaactcccgggctcaagtgatactgccacctcaacctcccaagtatgctactacaggaacacaaactccttttttaaattttttgtggatatggggtctcactatgttgcctaggctggtctcgaactcccaggctcaagcagtcctcctacctcagcctccccaaatgctgggattacaggtgggagctactgtacgcctggccttatctaagctgtttccctgaaaatgcccgtcttgggtaatgattccattggccccaccatgccctgtcctgccttcctggctgtgcccaagcttggtccctgcctgcctgcctgcctgcctcactctctctctgggtctcgagctcctgtgacacgtgactcctctctcttcctggagtgatccaagccctgccacttcctgactttgcccacactgtaccctctgcctggggcaacttcatgtctgcccattgtcccttaggcctcagcccaggcacaagcccctgcctgcggaggtcatccaggcctcaccaggctacaccctctcgtaaaattggattccctcccttcagggcaggtttataatgaaaccctcctcagaggccagctgcggtgacacccatctgtaatcccagcactttgggaggctgaggtgggaggatcacttgaggccagggggtcgagaccagcctgggcaacataagagagactcttgtctctcctgtctctataacaaatttaaaaattagctccccaggccaggctcagtggctcctgcctgtaatcccaacactttgagaggccgaggcaggtggatcacgaggtcaggagttcgagagcagcctgaccaacatggcgaaaccctgtgtatactaaaaatacaaaattagccaggcatgctggcacgcacctgtaatcccagctactcgggaggctgaggcatgagaatcacttgaacccaggaggtggaggttgcggtgagccaagatcacgccattgcagtccagcctgagcaacagagcaagactctgtctcgagaaaataaaaacacacaaaaaattaactcgccatgatggcacatgcctatagtcctagctacttgggaggctgaggtgggaggattcccttcagcccaggagtttgaggctgcagtgagccactatgattgtgccactgcactctaacctgggcaaaagcgagaccccaggccagagtgcatgattttgggtcactgccacctccacctcccaggttcgagtgattctcctgcctcagcttcttgagtagctgggactacaggcatgtgccaccacgcctgggtaatttttgtatttttagtagagacagggtttagtagagaccatggtgaaaccccgtctctattaaacaaatctctactaaccccatctctacaaaaaacagctgggcatggtagtgcacacctgtaattccagctacttgggaggctgaggcacgagaatcatttgcatcttggaggcagagtttgcagtgagctgagatcgcaccactgcactccagccgggatgacagagcaagaccctgtctcaaaaaaaaaaagaaaaaggaacaaacaacagcaacaacaacaacaaaaaaaacctgtgtcaatcacagccttcgagctaggggagaggcggccgaattctgccctctgctaacgagctatagctttgtggaaatgggtgagtggcgtgcccttgtgagcctcagggccccatctgtaaaatgggcctaactgtcatgcccgtctttaagaacagccttgggggtaaatgagtggaagtcatggaaagatctcagcccacaaccttccacagaacaggcgcttctcacacaggaagtaggaggagtgcagaggctgcaggcatgaatccagccagactgcctgggttcaagtcccagctcccacgtcttggtaactaagtggcctcagacaagttacttagtatttcttttttcttttttttttttttctcagacagagttttgctctgtcacccaggctggagtgcagtggtgtgatctccgctcactgcaacctccgcctcccgggttcaagcaattctgcctcagcttcctgagtagctagaattacaggcacctgtcaccacgcccagctaatttttgtatttttagtagagacggggtttcaccatgttggccaggatggtctcgaactcctgacctcgtgatctgcctgcctcagcctcccgaagtactgggattacaggcgtgagccaccgcacctggacacgttactgaatatttctgtgccttggtttcttcatctgtgaaatgggattgttatgagaacacaacgggattcccagggcagttcctagtgcatagtctggctgcctttgtgtgtgtgtgtgtgtgtgtgtgtgtgtgtgtgtgtttaatatagagacactctatcaccctcctgtctccaccacatctcagatgggaagggagagtgtcctggattagccgcaggccaagcatgggtcatcccttcatctgcatagggcgccagttcacattagccttttatgagccacagaccaaatccttcatccagataaggggtagccaatagaacctcaaaagcagtacttcctgggtgccatggctcgtgcctgtaatcccagcactttgggaggccgaggtgggccgattaacgaggtcaggagttcaagaccagcctgtccaacatggtgaaaccccatctctacaaaaaatatgaaaattagccgggcatggtgggtgcttacctgtaatcccagctacttgggaggctgaggccagagaatcacttgaactcaggaggcggagattgcagtgagccaagatcatgccactgcgctccagcctgggtaagagacttctcaaaaataataataataaaaaaaataaaatacaaaaactaacaaaacacctaggaaactttgtaaccaggctcttgagccgcttgcttaggcccactcccgccctgcagagtgctttatctgtttcataaattcctgctttcactgcttccttcccatgtctcattgctatgctactttgtggattttgttcaattctttgttcaaaatgccaaggacctggacggctcacactcacagccctgcttcccggaacaggcctggctgagttccagctgtgcagtgaagcccaactgtgggaggcgggtgaccctggactccctctcatgatctggacagagatggggtctgggggtacacctggtctcagaccagccccagattcttttgtgacctgaaggcagctggctggtcattggaactggcagagtccctccaacgattggggagggagcctctgaagcaatctttagagtgacatctgggacacagtgaggaaccccctggctgctgaacgaggggtgtctgtgagccaggaccactgggcaccaagggcctgaatccaggctcctctgccccaggactcgtggtatgctgtgactgcagggacaggcaggaccccatccccttctccccaaatgcagtcacaccccagacgggcccacttgcaagggtcctgcgcttcatttatgctctgctgtcctcatcttgaaatttttagcacatgcctgtaatcctaccactttgggaggtcgaggcaggtagatcacctgaggtcaggagttcgagaccagccaggtggagaaaccctgtctctactaaaaatacaaaaattacccagacgtggtggcgggcacctggaatcccacctactcgggaggctgaggcaggagaatcacttgaacccgggaggcagaggttgcagtgagccaagatcgtgccactgcactcccgccggggtaacagagtgagactccatctcaaaaaaaaaaaaaaaattcttagtaacttctgaataagggccccacattatcattctgtaccaggccccacaaatgatgtagccagccctgcacacccgccttgctcaccagttgcccaaagtggctgacctggaaggatccttcatactctgaagcccgcggtgcttatgtcttgggaactgcatcctttactctgaacaaagggcagcgaggtagaagaggctgtagacaggcccagaagaacctcacagtctctatctttcccttccatctggtaggttgggctgcccgagcttcccctgcacagggcgccccgcaggaaacttgtttcagacagagctgtatattctcccagtgaggtgacaaagtcaggaggaaggaaacctcaggtcgggctggagaactctttgctgagcttgttcactgctcctggcatccccactatgcagaggaaaaggggactccccaagcagtgggatcccccgcttcccagcccaggctctgtctgccttggcagaggctgggctggctgagcacctgtgggcagccacgcacctcaggatgttgcgctacagcctgaccctatagaaagccaagtgcaaacgctgctcattaacctccactcccaagaatcaggctgcttggccttgtctctgctgtggccccaccactcgagcccttcctgccaggcttggaacctcgatggccatttagggacagcatctaagccacctttgcaaccttggccttggaatgggctgttgcacagggagctcagcaaatgttcctccaagtgcctcaggtcccgattccctctcatcatccctagaatagcttttccttttgagatgctcaggacaggcagacacaggcctcctgttcccaagaagcagagaaggggacatggggctgcagggccaacacagggagagtcttcctgagtcctcctcctgccagctggtttttgcagctgcggccagccctggaggcaggagacacagcccccgggttctgcggcagcgcctgcccccgttcctccaagacggcgttctgggtgctctgagcaaaactggatgctggcaggaagcagctcagccctggccttcacgggaagggcaggcaccctctcctgacctggggcttcccaggccctcctttggcacgtactgaactgtttgtggaaccatctatgccacctccctcttccctcccaggctgagacaggacagagccgctctttggagctccttgtccctgtgcaaggccagggaagcagagggcaggggaggagctgggaggagctggcaggaccagcgctgcttcggcttcgcagcctccacctccaaaaccagacagagcaggaaaatcagactccaggcctgggagggcaatgagtccaaacgccttccccttcctggctctcacccagaagtcctccaagatgccagagcaagggcttttcatctttactttcctcctgaaacctgagaccccatgaaatcaacaaggagcaagtgagtacttcccggaggaagctttacctctcagctgcttctcagggaatatctaccccaacgctgaactcctgaagatttcagttaaatgcgaccctcagcctgatcccacggagagccccagggtgtgaactgcacatctgagattgtctttgtttttttgagatggagtttcactctgttgctgaggctggagtgcagcggagcaatcttggctcactgcagcctccgcctcccgtgttcaaggattctcctgcctcaccttcctgagtagctgggactccgggcacacaccaccccaacctggctaatttttgtatttttagtagagatggagtttaaccatgttatccaggctggtctcaaactcctgacctcaagtgatccacccacctcggcctcccaaagtgctgggattacaggcatgagccactgctaccagcctgagattgtcctgtcacctataacacctggcccaccctgaaagtcacaaaagtcacatctcccccttctcattccagtctaaggataaacagccgcagcacttctcagagaaatttgcacactggaggatactttccaaagtcctttcacatcgtgtacaggagccctgtgacctaagaagagcaaatgtctttaccccgtttctcagatgagtaaacagaggcccagggagacaaagttaacttgcacaaggccatgaagcattttgccagaagtggggatgtaatcaatccacgcacgattcccaggcatggaatctttccagtaccctagtgctcacccacactctccgccagaacttttttttttttttttttttgagactgtctcgctctgtcgcccaggctggagtgtagtggtgcgatctcggctcactgcaagctccacctcccagattcacgccattctcctgcctcagcctcccgagtagctgggactacaggcacctgcctccacgtccggctaattttttgtatttttagtagagacagggtttcactgtgttagccaggatggtctcgatctcctgacctcgtgatccgcctacctcggcctcccgaaatgctgggattacaggcatgagccactgcacccggccgacctgtttcattctgctttcttcccatctggctactgacctcccctgtcccggtgtcatctgctgtcattcatgatgaccctgctcattagctgccctacctgtgctccatgcactcagctgtggcgatgcaggaggaagtccacctggggagtccactcctgagccaggagtccagagcaagcatctccagcccgcttccaggtgcttggccccgtgatggttcattcatttattctccagacccctactgagcacctgcctcatgcccagccctgagcagacagcagtgagcaggttcccaccctcactctctggtgtagagctgtcctctctggtagcaagtgctgagagaggggcccaaaaccaaccgtacctccaccaggtgatctggccgcgggaagcacaggggtggcatcacctgacttcccagccctccttgaagctgactcttgcctttaaacccatggagctttctttctctttttcttgttctctttttcttttttcattttctttttctttctttctctttttctttttgtcttttttctttgtctttcaagaaattgaggccaggcatggtgactcacacctgtaatcctagcactttgggaggccgaggtgggtggatcacctgaggtcaggagttcaagaccagcctcaccaacatggagaaactccatctctactaaagaaaaaacaacaacaacaaacacaactagcatggtgggagatcacatcattgcactccagcttggatttcagagtgcgactcctcaaaaaaaaaaaaaaaaaaaaaaaaaaaaaagccagccgggcacagtggctcacgcctgtaatcccagcactttgggaggccaaggtgggtggatcacctgaggtcaggaggtcaaaaccagcccgaccaatgtgatgaaaccccatctctactaaaaatacaaaaactagccaggcatggtggcgtgcacctgtagtcccagctactcgggaggctgagacaggagaatcgcttgaacaaggaggcggaggttgcagtgagctgagacggtgctattgcactccagcctgggcagcacgagtgaaactccatctcccaaaaacaaacaaacaaaacaagcaagccacgtgatctgagactcagcctacaagtgctggctttgtcagtcccatgttctgaccagggcctcattgaccattgcattccatgcggggtgaagctagtagagagcggccttgtgcaaaggcagtaaggcctggagctgggtgccctgagtatctgtgatgtcatctaacttcttgaaaccgtgtatcggtcatgaggcaggagagcgagatctcattgctctctcaaggtgttctccatgcggccctggacacatctgttaactgttctgtaagacgcgggtattaatagcacctgctttgtgagatgattttgaggattaaatgagaagaggaggttgggcaccatggctcacacctgtaatcccagcgctttgggaggccgaggtgggtggatcacctgaggtcaggaattcaagaccagcctggccaatatgatgaaagccagtctctactaaaaataacttctttgcccagttaccttctttttttgggggatgggggtggggagacagctcctcactctgtcacccaggtgggagtttaatgacgtgatcactgcaccctcggactcctgggctcaagcaatcctcctacctcattcttccaaagagctgggattacaggcacgagccactgtgcctggcccaatgtctctattttttatttatttatttttttttgagccacagttccgctcttgttgcccaggctagagtgcaatggcgtgatctcagctcaccacaacctccgcctcccaggtttaagtgattctcatgcctcagcctcgccaatagctgggattacaggcatgcgcaaccatgcctggctaatttttgtatttttagtagagacagggtttctccgtgttggtcaggctggtctcgaactcccgacctcaggtgatccacccacctcggactcccaaagtgctggaattacaggcgtgagccaccatacccggcctcagtttctttattcttgtccttccatcgacttggcccctatttttttttttttgagactagtcttgctctgtcacccagcggggagtgcaatggtgagatctcagctcactacaacctccacctcccgggttcaagcgattctcctacctcagtctcctgagtagctgggattacaggcgtgtgccaccacacctgactaattttttgtatttttagtagagacagtgtttcaccgtgttggccaggctaatctcaaacttctgacctcaggtgatccacccacctcggcctcctgaagtgctgggattacaggcatgagccattttctttctgcccagctatttttttttgcattttttggctagacggggtctcaccctgttgcccaggctgatctcaaactcccgtcctcaagcgatcctcttgccttggcctcccaaagtgctggcattacaggcatgagccactgcacctggccttcgctttgaattaaagtggcaggcaggaagaagcatcatctcaaaaattgatggtgacagcggcagcgactacatctagcttgcacaggtggcagcttctgtcccacttcggtggtgccaattgtagcttctgtgccagcagaggctgtggggtcttcacctggccagctttgcccaatgtcctcttcctgatttgattttctgacccttttgagctcctgggaactagccaggacctctgaccaagtccctttctgcttagagttgccagaattagtttctgttggttaaaactaagaaccttgattctcacaaaaataggaccaggactggacagagcaagaagccccaaaggaaacaggagcaattgaaggctggaaagtggccagaggacagtgaaaatccagctggtattaagggacaggacaccagcagccccatggcacgccctggcaagacagctaatcccattgtccccgggaacaaagtatccatcaaaggcaaggctttgggggacctaatggctcctgccatagaagagaataaagattacactgaagtcaagatctgctgggcagggcggtcatgttaacagcgccacatagcttaaatgaaaagacaagctcagaatccaaattcttggctcaaggtatggttagaaaacccgagtgtgcctggccaaaatggcaaaaccccgtctctactaaaaatacagaaattagccaggtgtggtggcaggtgcctgtaatcccaggtacttgggaggctgaggcaggagaatcgcttatatccaggaggcggaggttacagtgagctgagatcacaccactgcactccagcctgggcgacagagtgagactttgtctccaaaaaaaaaaaaaaaaaccaaaactcgaatgtgttattttgcagctgagagagcagaaaaaactgaaaacttgatccaatggttacagaatgaccaaggggacccacaccttaaaaggtctttatttgggaaagagtgaaatgtggagaccagaggctatgaaaattaggctgtgtggaaagatagggaagccttaggtacctagcccctcccctccccaccacccttgccagccaaagcttcctctttgtcactgaagatcctagtagcaggaactcccttgcgggcagttaggtgttctatgtagctgaggtatggcctgcagcgacggctgagtctgtttctacactgctataaagaaacatccaaggttgggtgcggtggctcatgcctgtaatcccagcactttgggaggccgaggtgggcggatcacctgaggcttggagcacgagaccagcctgaccaacataatgaaacaccctctctactaaaaatacaaaactagctgggtgtggtggttcacgcctgtaatcccagctacttgggaggctgaggcaggagaatagcttcaacccgagaggcagaggttgcaaagagccgagatcacgccattgcactccaacctgggcaacaagagcaaatctccatctcaaaaaagcaaacaccgagactgggtaacttataaagaagtttaattgactcacagttccacacggctggggaggcttcaggaaacttacaaccatggaggtaggggaaagcagacaccttctccacaggatagttacgaggatgtaagcacgagaaagaggaactgccacgctttaaaaccatcagatctcgtgagaactcactcactgtcacgagcacagcatgggggaaactgcccccatgatgcaagtacctccacctggtccatccctcaacccgtggggattgtaattcgagatgagatctgggtggggacacaaagcctaaccatatgggtgggacggatggcagttatttccagggtgggctgtagcctcttcctccaacctacatctcctgtttcccaagctggtaacctggatgccctgggtgacctaagaagccatgtgctaaagatgtcaggacctcagtcggccggggttcccccttccccatttcagttgagggaggaagagcctttcaagagcgagagctagccagcagctagcatttccctatgtaacacaccctgtaatgaccctgccccgaaggagtctccttataagccctacccctcattttctccagaattaaatgacaagtcacatccccgcaggccccaggggccaaatctaggagggtactgaatcatcaaaaaactccagggggaagatactgaatcaccaaaagaaactaaagattttgctaattgatattggcttactcacagtacatggttggctaaaaaatttttttaattgatattggcaaaaatctgggaaggtgatctgagaatgaattctgagggtgcaggatgggtgagggaggaaggggatgctagatagggatgaatgtaccgatattgaggattccacagggacagcttgagaagctgggattataggcgtgagccacagcgataatgtagtactttcagtgctgaaatcaggatagtgccaggcaaactcggacaattggtcaacctagctgttaagtaactaacttgctctaaatcacagttattaagtggcagggcctgtattcaaatgcaggtgggctgacttcagattcaaattgtttgcttttgccagtggttctcaatcttgagcatgcaaacctggaggccttgttaaaattcagatagccccatcttcagggtctccaattcagtaggttggggccgccgagaatttgcctaaccagctccctggtgatgctgaggctgctggactgggaagactgggaaccaactgagaagacctttgtatttggctttctcacctccagataagggctttttaacttttattttgtgagacaaggtctcaatctctcactcacgctgaaatacagcttatgatcatggttcactgcaacctcaaactcttgggctcaagcaatcccctgcctcagcaatatgaataaacatattggaggccaggtgtgagactccacctcaaaaaaaaaaagtaaaggaatagggctgggcgcggtggctcacgcatataatcccagcactttgggaggccaaggcaggcagatcatctgaggacaggagttcgagaccaccctggccatcgtggtgaaaccccgtctctattaaaagtacaaaaaaaaaaaaagccggcatggtgggggcacctgtagtcccagccactcgaaagctgaggcaggagaatcgcttgaacccaggagacggagattgcagtgagccgagatcacgccactgcactccagcctgagcaagagcaagactccctctcaaaaaaaaaaaaaaagtaaagaaataaaacaatggctactccatagagcagccccgagggctgctggttgctcatttttatggttatttattgattatatgctaaagaaggggtggattattcatgcctcccctttttagaccatatagggtaacattctggcgttgccatggcatttgtaagctgtcttggcgctggtgggagtgtagcagtgaggacgaccagaggtcattcgcatcaccatcttggttttggtgggttttggccgcggcttctttactgcttgtgccggcctctcatctcatcctgtgacttagaatgcctccaccacctgggaacacagcccagtaggtctcagcctgattttacccagcgcctactcaagatggagttgctctggttcaaaggcctctaacagaagctaaacacaggtgggggctttcaaagaagcagatccaatgcccactgcccttcctcactcccctaatagatgtagggcaccatggacttttacagactgagggacatactctggatgagaatagtttaccctatcaaggaaaagtaagttccccagatgaaacgccacagataacaggcatattgtaagtcaggctttgtacgttttccaaaactcactacagggatcccctttgaggtgcagaatcttgtatcacaataatcacgattccttggccaaggccttttgatgtcatggtccgtgtttttctccggatcgttgggcatgcggaggcagaaggagagcctggcagagtgaatgacaaacgcaagggaggctgcagaggggagggagtgagggcggcccagggcccagcccggcgggagccgaggaagagaaggaccagccagccaagggcgggcggctccagaggaggcccgggactccccagtttcccagcctcttccaccccacgcggatccctgccccgacgctgattcagggggtcaaagcctcgggcggggcggaccgcggcggtgactggaggcgccccagtttctctgggtgtggcctgcggaccccctcgggagcaggtcgtcccgcaccagtgtctgcccccggcccccagggacacctgcacccgccccactcacgacggcgcgtcaggtccccaaccaggcgtggggcggggtgggaaggtctcggttcggccgccccgcctgtgctgtccccaccgccccccggcctcgggcagcgcgctcccgggtcacccacctcccgcgggcacgcgcagggcggcccctccgggcgctgcggccgcggccccggccaaggggcgggtcccgggtctgggaggaagaggcgcggctgctggctgacccgggaaccagaccgagccggagagcgggccctcccgtctcccaccgggcaggaaggcctggcgctcgcaggcgaccttgcgccagtgcccgggcagggatcagggggctcagcgccttcgcgggaggtagagagagctgggggcatctgtgtgaccaccccgcgtaggtccgcgctgagccaggacacaggacaactgcccgcgcctggttagacaggcgaagccctgggaagcagtgggagagggaaagactgggccggcgcggggccgcatgcctgtaaccccagcactttgggaggcccaggatggcggatcgcttgagcacgggagttcgagaccagcctgagcaacatggtgcaaccccgtccctacaaaaaacacaaaaaatagcggggcgtggtggtgcggacctgtggttccagctacttgggtggctgaggcaggaggatcgcttgagcctgggagttcgaggctgcagtgaaccccagttgcacccctgcactccagcctgtacgacaaagcgagactctgtctcaaaaaagaaaaaaatagggccgggcgcggtggctcacgcctgtcatcccagcactttgggaggccgaggcgggtggatcacgaggtcgggagatcgataccatcctgggtaacacggtgaaaccccgtctctactaaaaatacaaaaaacaaattagccgggcgtggtggcgggcgtctgtagtcccagctactcgggaggctgaggcaggacaatggcgtgaacctgggaggcggagcttgcagtgagccgagatcgtgccactgcactccagcctgggcgacagagcgagactccgtctcaaaaaaaaaaagaaaagaaaagaaaaaaaataaataaatgacagccagactcactgggtttgactcccagctgtatgatcttatgcaagttactcaatctctctgccttcatttcttccgctgtaaactgggacagtgataaccccttgtgggtgatgtctgaggagctgggtgagggagcgggactgcacaggctctgactaccattggccctggtgcgatgacactccgccggtgggggcaacacacacgcgtcgtctcccagacattcagagcaacttctattaataccctgcctgcctgggccccagccatgagaactgcccctcactgaggcagagtctggtcttcctcttcttggggagacccagaacttccagagagtgtcctggaccatgaaggtgaccaggaaagggaataggtgggtggaggccgctgcagtgaagcctcaggccccctctggtctctccagggtcatcctggatcatctgaatttccctttgaaatgagcatgcacaggttcagctgattcataatttaataccccgtggggttcatgccacagggaagctccgctgccccacagggtctgggccaggtggaagagagcagcctttttggaccactggcggtgtcctctccttcgccatctaattgaagcccatcttcccaatcaaaagcaggcgaagggccccagcttcttctaacactcactccctggccctcactggcctccctgcctctctctgcccaacttctggcattgtgcaaggtctgagacctctttggacatgaggcatgtggtcttaacctggcccttgttccagacaggtgggcagacaggtaagcagagccggtgctcccagggcaggcgagggagccatgtggtcaggcctcaggaccctgggccccaccgggagatgtgctcctgggctggaaggaagcagaagagagcagggctcgatggcagcccaggcagtcccaagatggcagccctgttgcactcggtctggaagtgcccatggccgtggtccctgtggcgctccaggccttcctagcagaggctgctgggagctggtgccatgctaggtttcacctccgcctccaccacagttcatggggctcccgggaacaccaaggaacccaacaggttcccaggaagcagctttcatgacaggagagggtccttggagaaatcccctgcagagctgtagctctagtccttcctgcgtggccttgctgtatgaagctgggcccgtcattgcccctctgggctcaggagcccacaggtacaaggccatcaacagggcatcctctatggccccgtgtgcccagacccactctgaacctgccacctagatacccttgcaggctggaccgggtcagcagcactcccagggtcagggatcagagaaggggagcctcaggaagtccctcaccaaactggcagatgtaacggtttcgggttttgcagcgctggtcgttccagttgaaggcagctgaagcctgcagctccacgcagttgccaaacctgcaggccagggtgtggtggtcaggaggcaagagtgaagtcagggatccgggagaggcctaagccctccacccatcaggaccctgcatctcaggggctccagtgcccccacctgccgacggggctgctgggagccaggcccgtccccaagcccccagccctgctccacttctcagggaagccccttcctgggttaacagctctgcctaccccatggcagcactcagccacaccagcctgtggggatggtggggattggaatagacagcccacttgagaggtacacctgggaacccaacaaggcccagacttcctccaggcaagaggccaggggcacaggccggctgttggcaaggagggctggctgaaatcgctggagcccttggtggcctcgcagccggaccacctccaccctggccctgggcattgctgggctttgaagagcagggtggggccacgtgaccagagggttcttgctacaggatggctggtgggtctgcaggtgcagggttgtattgtgaatgagtgcaggtgggtgacagctaaggaatgctggcatcagtgtaactgatgcaggcagagggcatgcagagggaggggtgagtggatgagaattggagggatggagtcacagccaggggacactggggatggacagatggatggaggcttcctgggtccctctctcccccacgtgacgtgccttccggcttgcatctccctcaccccaccaccggcccacaccagctgtgcccacaactctctggcacctgggcaggcaccagggaaggatcagaccctcaaagggcccagccaggcagcgggatgggggggctccaccaggcaggcccaagtgagaaggaggcccaggggagggaggcaccccacacttacccgtggttgtcaggctgcccaaaggcaaaactggtgaaggcctggtgctcccctgtggcccagcggaaggagtccttggcggtcttgtaggtgagccctgggccggggtagtcaaggttggcccactcagaccctggagtctgctgccagctgcctttctggcccctcttcccagcgctggcagcccccatgtgctccctacctgggccctccccgggaaagggggtgagcagctggccccgctctgggctccaggccctcaacacacccttgccatctgctggcagccgccatggcccagggttcctgcagcagggtggggcatcacaaccccttactcgccatacccccaatcagctgggcactcaccgatccagaagttcctggtctcgaagtcactgtcaatcacctcgttggtggtctccaggcggcccagatagaaggcgaggatgtcctgcactttctggctcttgatctgggccagcaccccgcctttcctctgtaaccccaccctgggtcacacaggcaagtctcccagagcccaggctgccccttcctgccacccctgcccatggcctaagatgccacgtgtgtgtgctggccgggctatcatcacccccagcccgcacagcctcccttccaagagcaggggtcccttctgctcccgtctgcttctcttctccctgtgcacaggggcgcgaccagcagcccacaagcccaggcaaggtctggcccctgaggaggttctgtttcacctgcacagtgtcttaaatatatccgagttgattgccaaccccagtaattaattgtggtttcgagagttgccagtggaagtctgggttgctggttttcttgaacaaccccgagctctggccaccctgaccttgcattcctgcaaggcaaccagtggctggaactcccttagatggaggttggtcttgaccttggcccctcaggtcaataagtgacctcctggcttctatgagccttggagtccacgacccctgctttatgctgatgaatagggtgaggtcagagacgttgaaggaaccacctctcactccagggtccctgcattaagaccctcacttgaggccctagggggttcctaggaagctaggggtgactgtcacctgacatttcatcctggctctgtaataggtgtctgcctctgaagacaccatgaagcagtctccgtcgatcctcaggtcacaggtgtggaagggaaaatgcaccttggctggggtaggggagcctgagtttgtgtgtggacttcagaatccctgccctttcctgccctgccggggagctaagctcagggtgccccttcctctggccacctgctccaaaagagtgggtggtgagggtcaggagtgagctggtcagttggaatattgagcttgctctctctcaaaagaaaaaaaaaatccatggtttatagcatttgccaatttctttggtgtaaatatccatgctgtggccagtttcaagatctcaacgtgttgtcactgaatgagttggaaagagaggcacacagcgggctcctgggagctgatgccccattgaaggggggtcttgagaggagctggctctttgggggccctggggcaggactcactggcacactgggctcccccgtagccgatgtcacagacgcacgagcactcctcctcccggaaccggccgtgcacacactgcaggctgcacctcactgccagggcagggcagtggggcagaggctcagcccccagccttctggaccccacgctgccccccagaggcctcgaacatccagggaatgccaaccacagcaagaatacccctcccagagacagaacccaccaaggcttccgattgctggcacgcctggtgtctttggtttggtccccattgcagagtgaggcatattggagtttgggaggtgacctgcccatggtcacagagtgggttagggtagaggggcagtagggcaagaatccacttctgggtcctaattctgtcctcctcccagagcctaaggggctgaacctgatttcactttgaatctcctgcacagctcagggtccggcaaacagctagtgctcagtgaatgcttgttgaaagaatgtatgcagtgggcagactcagggagtacacagtcagcacctctgacacccttgagactctcaggaagtgtagcagccctaggacctgccacgagagcagggctgggcacacccaggctccagtgccctcaccttggcagtatctgcccgtgtagccagggggacagtggcagtggcaggtgctgatgttgagacgtccatggttctggcagctcatgcgacaaggattcctggggacctctggtcagaggaggaggggactctgagaaaagggtcgcctcccagcaggccgggcaggacctccctgggtgctaagggccagggcttctgggacagcccagtaggatgctaccacccccaccccagggtcaccagactgagccctcatgcactcaccacagagcccccctgcatggtcccaggctttgaagcagcctgagacactggctgtgcagagcgaacaccaggcacccttcttataggggatgattgtcttcccgttgacctcccagttgcctctgtgaggacgagcaggcaccacagggtgtgggagggcctggccttgggcaaggcagtggcagggccctgctgcctacctccctggccccttcagctcctgcggccaggccagggagtcagggagctgggtgagatagggagattccctgggagagaagagatggcctccaaaccaatcctggacaaactccctgataccaggaccagtatccaggaagggacatccgcagagcagcaccttctgcgtggccagaatctttagcaccctctgcctttcctctcctcccctctcccaccaagggtgcagagcaaggcatcagggactctactttcgggtggatgtgtgggaatctcaccctcggtgaaagcacccctccctgtctcccagacatcccagcagaaggtgtagcagggcttacccgggggagtaggcacagacaaaggcttctatcgctgtctggcctgcagagcacaggtgccgcccacagcccagctggcttgaggtggcccacacgagctacaggagacacaggggatcagaaaccctattgtgaaccacccctggggagggggacacagctttcgctatcatccaggcgaacagagggctcccttacctcttcgagggctcaggagcagcagctgtcctgggcaggggtagaagcatgggtgggaatagttcaggaaggcttatttatttatttatttatttatttatttatttatttttgagatggagttttgctcttgttgcccaggctggagtgcaatggcctgatcttggctcaccacaacctctacctcctgggttcatgtgattctcctgcctcagcctcccgagtagctaggattacaggcgactgccaccatgcccggttaatttttttgtatttttagtagagacagggcttctccatgttggtcaggctggtcttgaactcccgacctcaggtgaactgcttgcctcggcctcccaaagtgctgggattataggtgtgagccaccgtgcccagcctaggaaggctttcttagttgagagggggatggagaggggaggtacctgaaatgaggggagattgttgatgggtggaggggagtagccaaaaaaagactggaacgtcaagggccttgtgactgcatggtgaccacaaccattcatttcttgcagtaggccactcctttaaatgtgactctgcagctttttgcagcaaagagaggtgtctctttccttgctccttgaatctggctggctctgtaactggtttggccaccagaatgccacagaagtgatactgagccgattttgaacctaggccttaagagaccttgccatttccactcattctcatagaaccatgctcagtcaccacatgaacaaactcagtataggagtttggaaggcctcatggaacagagatgaaccattagaggcctttttgcacagccagctcccagccggccccctagttgattgcaggtgtatgagtgggcccagccaagaccagaaaacctccctgctgagcccaacccaagtggctgacctgcagaatcgtaagctgctaaattttggggtagtatgtcatgcaataaaacctaatggatacaggtctgcaaaccagtttaaagtcttagaatcagcaacagcttggaaatagcacaaatgggcaatatataagaagagtgaaacaaactctccagtagagactaaaaatgacatgtacaagactggcttgtagcaggcagatgtgaacatgtgatcatatacatgtatccaacacttaaagaatatgtatcatttttaggaatgcatgggacttttgcaaaccagaaaggaggaccatacattagaccactaagcaagtttcaacaaatagcaaagaatcagcacatcctacagcccacattctatgaattcaatgcaatgaaatttaaagtaaataatttacaagtaaatagagaagataacatagtttagaaacttaaagatacacttcaaaatctaaaacaacatcatggccaggtgtggtggttcacatctgtaatcccagcactttgggaggctgagttgggtggatcatgtgagttcagaagttcaagatcagcctggccaacatggcaaaaccccatctctattacaaatacaaaaaattagccaggcatggtggcacacacctgtagtcccagctactccggacctgaggtgagaagatcacctgagcccaggaaattgaggctgcagtgagctgagattgcaccactgcactccagcctgggcgacagagccagaccatgtctcaaaacaaacaaaaacaacatcatgattggaaatagaaaaaacatcaaaacttattggatgcagctgaaatcgtttaaagggaaatttatagctttaaatgtatatagtagaaacaaaaaaagatttaaaattaatgatctaaacattcacatcaagaaaattagaaacaataatagaggctgggcgtggtggctcaagcctgtaatcccaacagtttgggaggccgaggcaggtggattacctgacgtccggagtactaaaaatacaaaaattagccaggtgtggtggcaggcgcctgtaatcccagctactcaggaggctgacgcaggagaatctcttgaactggggaggcggaggttgtagtgagctgtgatcgcaccactgcactctggcctgggcaacagagcaagactctgaatcgaaaaaacaaaaacaaaaacaaaacaaacaaaaaacaaccaccaacaacaaaacagagttaggtttttcacacctttgagtctgacaaaacttaaggagccaaggctgggcacagtggctcacgcctgtaatcccagcactctgggaggccgaggcaggcggatcatgaggtcaggagatcaagaccaccctggctaatacggtgaaaccctgtctctactaaacaaaatacaaaaaaatagccgggtgtggtggcgtgtgcctgcagtcccagctactagggaggctgaggcaggagaatggtgtgaacccaggaggcggagcttgcagtgagccgagatcgcaccactgcacagcagcctgcgcgacagagcgagactccgtctcaaaaaaaaaaaaaaaattaaggagccagaagatcttcgggaagtgggaactggtttgctggtctgcacagttggcgtaagcactttggcagcacctagttgtaggggcacatgttcttctttttactgagccagggttttactcctgctgcccaggctggagtgcaatggcgcagtctcagctcactgcaatcttcacctcccaggctccagcaattctcctacctcagcctcccaagtagctggaactacaggcgcacaccatcacacctgggtaatttatgtatttttttgtagaggcaggttttttccatgtggcccaggctggtctcgaactcccgggctcaggcaatcctgccaccttggcctcccaaagtgctgggattacgggcgtgagccaccgcacccagccttgtgtaatatttaaacatgcacaacccacttgcacaggtagtggaggtattaaatatttcctgggattttgcttgtgtttttcagtgcatctgaagagcaccaggtgtgtgtagaagaccctcaacaaatatttgttgaatgaagagaaaaaatggaaacttgcttggcagtgatgctcctgaactttgggaagattccctccagggagggacagcgggaaaaggggaggagcagggctttagtttagtagcatcttctaaacctaggtagtgggtaagagtggggccgttttaaatttatgtttgaggctgggtgcggtgtctcacacgtgtaatcccagcactttgggaggcccacgcaggtggatcacttgaggtcaggagtttgagacccagcctggccaacatggtgaaaccctatctctactaaaaatacaaaaattagtggggtgtggtggctcgtgcctgtagtcccagctacttgggaggctgaggcaggacagtcacctgaatctgggaggcagaggttctagtgaaccgagatcaagccattgcactccatcctgggtgacagaacaagacttcgtctcaaataaataaataaatacgtttatgtttgaaattatttatatttcagattgaaaaaaagtggcttaggccaggcatggtggctcacgcctgtaaccccagcactttgggaggctgaggcaggcagatcatttgaggtcaggagttcgagaccagcctggccaacatggtgaaaccctgtctctactaaaaatacaaaaaaatgagctgggtgtagaggcgcacacctgtaatcccagctacttgtgaggctgaggcacaagaatcgcttgaatctaggagacggaggttgcagtaagctgagatcacgccactgcactccagcctggggtgacagactgagaccatgtctccaaaaaaagaaaaaatgtggcggggcacagtggctcacgcctgtaatcccagcactttgggaggctgaggtgggtggatcacttgaggccaggagttcaagaccaacctggccaacatggtaaaaccctatctctactaaaagtataaagccattagccaggcctggtggcacatgcctgtagtcccagctagtcaggaggctgaagtacaagaatcacttgagcccaggaggcggaggttgcagtgagccgagatcacgccactgcactctagcctgcgcaacacagcaagactccgtatcaaaaaaaaaaaaagtaaaactaaaccaattggaggaaaaggaatcccaacatttaggacaaactgtagcctcttctgagatggcccagtggaagtctgtatctgggagctggcacgctggcctcacctgcagcacactcacctgcgtgtagtgggtgcaggtggcgttgcgagcacactctcctgccgcgtggctgtaccgctgcccctctgcaaaccacaggctgaccacttcaacaaaggacgccaagcccgcgggcagcagctgcatgttccagcccacttgcagggtgcgccacaggccggacgccaggctcggggttgggattccacagagggctgccctggcttgagccagttgggccaggctgtcactccagtcctgggggcagcacaaacagacatctgtgggaggcctttgactgctgggccaggcctcaaagattcaactcccctgccatctctgagcatccaccgggtgccaggtcaggtggcaaagagagcactggatgaggagtcctgctggaggaagcactggtgttgtctgatgtccctccaggaggagcccagctcctctcacgactgagcctccatctccaaatcctgtcgtgggcatccttcggccctgcccaggcagtgggacccgctcctgctgtctttctcccatctggtcatgtgagcagtgcccacgcgttgcagactggttctgtgtttgggccctggccattgtcagaaaggctccactgctcccacccggccatgctgccctcctgtgatgcaaaaagccctacagccacacctctctgccctagtctcctgcccccaggagcctggcctcatatgctccccaccacgcacagctgaccccgccccctccctcttcttttttttttttgagacagagtctcaccctgtcgcccaggctggagtgcagtggagaaatcccggcttactgcaacctccgcctcccaggttcaagcaattctcctgcctcagcctcccaagcagctgggattacagccatgtgacaccacacctggctaatttttgtatttttagtagagacggggtttcaccatgttggccattgctggtgtcaaactgctgaccttaggtgatctgcttgtgtcagcctcccagagtgctgggattacaggtgtgagccaccgtgcccagccccctccctcttcttaaacaaggggcctggcaatcaccacccctgggtgacttggtgcagtcccctgatctcccgagactccctgagctcatctgtaaacggagcagggaggtgcctgcaggataggactcacaagcacagagtggatgcagggaggggggcccctcggggctgcaccccaagccaacttcatcctgcactaatgtccatcggggttttacctctgatgaaggctggggccaggagctgggggctccccggggtccctcagcagccctccacccccacaagaccttcagtctccactgtgtccaaagaaggggtgccctggagccctagaggcccggagggtgctcggggccgggccacgagggaggctgagccatggagctccatttgcacctttatggaaatgaagttttctaagactttgacaaaagggccctggaaagggtgccagctgccagccaacgaccaccgcagcccctcctggggtcccaggcaggagtacccaaccacggaggtcacagctgggagcacccctggttgcccagggtctgagcctgaggagaggcagagccactcagggctgggaatgggggagaagcgaccccccgcatttagccaccccacccccacctcctgggaaactgaccctagagtgttcaaggtcgccactgtggccacctgccttggaggagttcatgggaagcagccatggggaaccctcccgcccccaccaccctgccctggctccctggcctgctaacatgggctggggctgctggggtcccagacaatggagggcagcgtttctgagcctccagatgacagtcccaaccccgcagccccagccgggctggtggggaactctatacccccgacccctggcccctgctgaaaatgtggaaaatgtggacgagtgagtgagcagagaacatgggcaaggcccgtcctagtggctcagataagctcaggaggaggcgctgggtccttgccgcacagaagcccctccccagcccagcacgaccttctccctccctggcccggccgcccatcctgcagggctcctcgtgaagctccccttccctggaggaggggatccggctcctcctgtggctcctggtctctgtggcaacaagatgccagggaaggcccaaggtcctgcccttcaggcgagtgggagccaaggggcccgacctcctgaactgagggtggggggttaagaaactgcagagacccccagcaaccagggcctccgtccctcaggggcaaggtggctggctgtgcctgcccaccctggtcaagtggaagggcacctggacaggcgtggcctcctgagccgccctctggggtccgcgcctccggccacccccctggcagagcccagctgggtcgggtactcaccagcctccgcatgtcagccgcagggggctggacccagctgcgcaggcggttgtgcagggagaggagcaagaaactctccttcctgttcagggctggggtggggagagaaggtcaggcagcccgaggatggggggacctgaacccaacacacggcagaataagcatgtgtccctgcccttggaaaacaagatgggagaggagtgtggtgggtgcaggggacgtggggcatagcaatggagcgaggctgagagagagaccaggtacagcaggcgtgggctgagtgctggggttggggtggcgggagggaacagcggtgcgggctgggtgtaggggccagccctggctcccgcaggcccctgtctggggctcctccgggccacggatttctccaggccccagccacagcgctcctcggcgttcctccttgaccccagccctggtcctccttcctcctccttcctcctccttcctccccagtccagcatccacccctcaccgcccccgggctgtcccagggcttcctcattaaaccacccgcacggcctggggctcaggcctgggaccgggcttccagaagtctcctagcacccactcctcagagctcataatggtgcctccacctacctcctcaccaggtgtcccttacctccggccatcggagcctgctcctgcagctggggtggccacacctctgcccaggtggtgccaaggagggccaggagcacagccaggagatgcccccggccaggggaggtctctggatgcagcatgggtctgttgggcccgtcaggcgctccgtgcacagcctggctcagccacccggcttgtttctcaggctggatggagctattcacaatctccaggagtcaggctgggctggtggacaaaagaggggggctggtgaacaaaagaaggaggctggtgagtgagtaatcagtgtgtccagacagcctcctgttggcgctggcatgaaaagagacaactcccggggatgcctgcctgctccggcctcggcctggccagcccgcccccgacagcaggcagagtggcgtgcactgccccgcggcccctgctaatcattgtgggattattagcacccttggggagcccccagagaccccgctgattggcctggggacattccggtgctgcagattagtgaccgatggccgtgtcctggctgggacagtgtcctccgagcccactgatggcttccgctccccagccccgggccctgggaggaggacctcggctatggtccttctggtgagcaggaactgggcaagaccccaggggagttctttcctttcttgggaagctcgtcccaaccccccagccatgaattaaacataggcaagaggtaaccgcacaccagaggggtgcaatctgtgggctcaaaggggggtgggctgaggccgcacctgcacgaggaaaagggtgccttaggaaagtctgtctgggcagggtcgggggctgggcccagccccggtgcccaccaccctcacccacgtgactacaggccagggggggagtgaggcaggaggagtcaaagcaggcggggaccagagcacgtgatgccctgggctgactccagtcctgctgggatcacgtccgcctctagaaaaacaggcggcgtagcaggtgggcagcacgttgccatgatgtgccgtggcccggccgtggctggcgtgatcccaccagagtgagctggagcagatctgcaccatgggccaagtttctcagaaaatacatggcttcctgcgggctgcagcctaatgcccacgttcctctcggggcagaccgaaggttattcaaccagggcaaaggacagccttgcaaaccaactacgtcctccttctggagtttgtgtgacccctggcccctgagcccacaccctctcggagcggggttccaactccgtggaagctctgctgagatgcaggtagggttggctttcctggggaaacaccagtggaatgtggctatcgtcatgggtgccagggatggggatgaggccaggcatacaggccatgaaggcggtctggaactgcatgtcccccacaatacctaggggctcaggagtttcttctccctcaaacagaaacccagcaccctcagggtcactgcgtgtgggtcctagcaatgcttaatagctacctgttttttgatgtatttttatttttattttttagacagtttcattctgccactcaggttggagtgttataatctcagctcactgcagccttgacctcttgggcccaagtgatccttccacctcagcctcccaagtagctgggaccaggtgtgtgccaccatgcctggctaattattattattttttttggtagagacaggatttcatcgtcttgcccaggctggtctccaactcctgggctcaagggatcttcccaccttggcctcccaaagtgctggggttgcaggcatgagccaccacacctggccgagccacctgtgtttatggagctcacaaagcctgtttgcatgtgtgagttcaagttattgccacaagaacctggtgcagtagcagatgggatgcccgtcgtgtagatgaggaaacgggcttagtgtgtctaaggggcttgtccaaggtcactcagcgagtgcatggagcatcccagctaatccaaggtctctgccttcccattcccaacgctttaattcacatcctgatctttcccagtgcagtttccacagctctgctatgccgggtgataaaagacccacttcctacaattgggcttccatggcaaacacggccagttgacccatatagtatgatgccaggcacttgggacaggcgggagaaaaagatattttggggattagggtggagcaacttttgaagggtcccatggccctggctcactgcaagaagagtcccaggccgggtgtgatggctcatgcctgtaatcccagaactctgggaggccaaggcaggcggatcacttgaggtcaggagcttgagaccagcctggccaacatggtgaaatcctgtctctactaaaaatacaaaaattagctgggcagggtggtgggtgcctgtagtcccagctactcggtaggctgaggcaggagaattgcttgaatctgggaggcggaggttgcagtgaagcaagatggcaccattgcactccatcctgggcaacagagcgagactctgtcccacccccgacccctcaaaaaaaaaaaaaaagagtcccaggagagcaaggttcatgggccagaagagaagctgagtggataaaagattaatgagacactggaagacctaggctggaaccgacacgctgtgtgaccctgaggatggcactcccactcctgaagctcagtatccaatggcgtagagctgggatgacccctctgctgggcccctaaccagggcattgcaacttggtttccatggtactccctcctgggttcagactttttagtggagcctgctcggtggctggggtgggtttggagaatgggcagcctcattcttgcaaggcagctttccccaggtgaggctactacagggtttacatccaccacccagactgtaggattcacattttgctatattttctttatcacctgtgtctctatctatcccacccctctccagctcatgcatagctgatacctcttctcccagtctgcatttgaaggttatagcgttcgagtcattttgtctcttcctgaagcagctcctttcttcaaagccttgaaatcttgttgatggtctcaaaaaaaaaaaacaaaaaaaaaacaaaaagaaaaccatttaactctaggagagttgtggccacattttcttttaaaaattacatgtccaggacaggcgtagtagctcactcacacctataatcccagcactttgggaggccaagctgggtggactgcttgatctcaggagtttgagaccagcctgggcagcatggtgaaaccccgtctctaaaaaaaatacaaaaaattagctgggcgtggtagcacgtgtccatagtcccacctacctgggaggctgaggtgggaggatagcctgagccagggatgtcaaggctgcagtgagctgtaatcgtgccactacacactagcctgggtaacagaccaagattctgtctcaagaaaaaaaaaattaggccaggtgcagtggctcatgcctgtagtaccagcactttgggaggccgaggtgggcggatcacctgaggtcaggagtttgagaccagcctggccaacatggcaaaatcccgtctctactaaaaatacaaaaattagctgggtatggtggaacacacctgtaatcccagctacttgggaggctgaggcatgagaatcacttgagcccaggagacagaggttgcagtgagctgagatcacaccactgcactccagcctgggcaacagaatgagactctgtctaaaaaaaaaaatcatgtctatttgatttttaaatttttcttgagacgaagtctggctctgttgcccagctggaatgcagtggcacaattttggttcactgtgacctctgcttctggggctttgacctccacatcccaggctcaagccatcctcctacctcaagctcctgagtagctggactgtgggtgtgcgccaccatgccaggtaatttttgtatttttagtagagatggggcttcaccatgttgcccaggctggtctcaaagctcaagtcatctgctgggattataggcgtgagccaccacaaccagccccatattagtatgttgaagccctacctccattacctccgtgtcactgtatttagagatagggtctttaaagaggtaattaaagttaaatgaggtcactggggtgggtcctgatccagtctgactggcctcgttataagaagagacacacagagggaagatcctgtgaagacacagggagaaggcggctgtagacaagccaaggaaagaggtcctcagagggaaccaaccccccggcaccttgatcctggcctttatgcctccagaactctgagaaaatacattctgttttttaagccacccagtgtgtggtaccttgtatggcagtcctagcaaacgaatacagcccttacgcaaaacgtacagctaatatcacacttaacagtgagaccaaagactttcctccctaagatcaaaacaaggcaaggatgtcttttgtcaccggtcccactaaacattgtactattgaatgcgcaatttgtgcaataagttaagaaaaagacattaaaggcatccacactgaaaagaaagaagtaaaactatcttcatttgcagatgacataattctactgtagaaaatccgaaggaatgtgtaaaaaaaaaaaaaaaccctactagaataaaggtctcagaatacaaaattaacataccaaaatccactgcatttctacacattggcaataaacaatccgaaaatgaaattgaggaaacagttccacacatggccaggcacggtggctgacatctgtaatcccagcactttccgagaccgaggcagatggattgcttgaggtcaggagttcaagaccagcctggccaacatggtgaaacctcatctctactaaaaatacaaaaaattagccaggcgtggtggtgggcaactgtaatcccagctactctactcaggaggctgaggcagaagaattgcttgaacccgggaggcggaggttacagtgagccgagattgcgccactgcactccagactaggcgacagagtgactcattctcaaaaaaaaaaaaaaaaaaaaaaatccatacacataaaactgtaaaacaacattgctgagagaaactaaagatctaaaaaaatgcatagacatttcacattcatccaggctggactgcagtggcgtgatctcttcctactgcaacctctgcctcctgggttcaagtgattctcctgcctcaacctcccgtgtagctgagattacaagcacctgccaccatgtccagctaatttcttttttttcttttcttttctttttttttttttttgagacagagtctcactctgtcactgaggctggagtgcagtggcgcgatctgggctcactgcaacttccaccccttcggtttaagtgattctcctgcctcagcctcccaagtagcttggatcacaggcacccgccaccacacccggctaatttttgtatttttagtagagacagggttttaccatgttggccaggcaggtcttgaactcctgacctcaagtgagccacccaccttggcctcccaaagtgctgaaattacaggcatgagccactgcacctggccaatttttgtatttttagtagagacagatttcaccatgttggccagggaaaactcaatattgttaagatagatggtaattctccccaaatttgtctattaattcaatgcaatgcccatcaaacttccaaaagatttttgttgttgttgtgtttattttaaagcaattgagaggccaggtttggtggcatgcgcctgtaatcccagctatttgggagactgaggcaagaggatcccttgagccctggagtttgagaccagcctgggcaatatagcaagatccatctcaaaaaaaatttgaaaactggatcttaaaatttgcatggaaacgcaaaggaattagaataaccaaaacacatttgaaaaagaataaaactggagaatgtatactacctgatttcaaaacttgctatgaaacttctagtaatcacatctataagatatggaaaaaggacaagacatatagatcaaggaacagaatgaacaatacaggaaaaaactcttacatttatggccaatttattttgttttatttgagggtctcactttgtcacccaggctggagtgcagtggtaccataattgctgagtagcctcgaattcctgggctcaagccatcctcatgcctcagcctcctgagcaggtagaatgataggcacgtgccaccatacccagctactttttttttttttccagacagggtctcactctgtcacccaggctggagtacagtggtgtgctcacggctccggggttcaggtgatcctcccacctcagcgtcccaggtagttgggactatgggcatgcaccaccatgcccggctaattttttgtatttttggtagagacggggtcttgccatgttgtctaggctggtctaaaactcctgggctcaagcgatcctcctgccttggcctcccaaagcgctggcattacagttgtgagccaccgcgcccggctccgcctcccgggtttacaccattctcctgcctcagcttcccgagtagccgggactacaggcgcccaccaccacacccggctaattttttgtatctttagtagagaaggggtttcactgtgtgagccaggatggtcttgatctgaccttgtgatccacatgccttggcctcccaaagtgctgggattacaatcatgagccaccgtgcctggcccttctttttcttttttttagataggggtctcactatgttgcccaggctggagtgcagtggctattcataggtgcaatcatagtgcactgcaatctccaactcctggtcagccgctacttcttaaaatgtttctctgtctggttcatgtttcaaagtctggttcatgactctgctacacttcagtttcaaaagctggtagcaaaggaaagaacatgccaagagctgaggttctgctgtgatgagaccacccaagctccccgtatctataccaagggatctgttgcccaggctggagtgcagtggtgtggtcttggctcactgcaacctctgcctcccgggttcaagagattctcctccttcagcctctcaagtagctgggattatagatatgcactaccacacccggctaatttttgtatttttagtagagatggcgtttcaccatgttggccagactggttttgaactcctgacctcaagtgatctgcccgccttggccttccaaagtgctgggattacaggcattagccaccacacccggcccagatgtcttacttagctcttcaaggcttacggaagttggtaccttgtggaactaggctggggaggtctggatgccagatgttcttctgaggttgctgttcttataattgctgtattcaaatatatcacccagttgagatgaaatgcctagagcacagctgcggagtgggaccagctgggctgaggagggaatgaagtacaaacatccagcgatgttcagggccctgaagcagctgggaagcgcaggcgttcaaatcaccagaggcatggctatatcagctcacatatcatgcacacagatgcatgtcctaggcgtggaaacaaagctccccagaccatggttaactcaccgcatgcacctggagttccatctgcaccaaggcaccagtggttacttttagaaataaacaagtcacaatgaacacagttaaaagatgtcagcactagtggcacttggggactccagcccagctcctgtcacaagcaactggccaccaggtctggacccacatcctttgctcttggcctactgaggtcattcagttttgctcatctcccacaacctggaaacccaagggggcaggctgtgcagttcatcctggaagaataatagaagagcagctgtcgtgcatggaaagatcatgcaatgggtcaagtatttaattaattattttttgagacagggccttgatctgtcacccaggctggagtgcagtggcgcgatcatagctcactgcagtcttgaacttctgggctgaagcgatcctttcacctcagcctcccgggtaactgggactataggcacgtaccactctacctggctaattttttgatttttggtagagacggcgtctccctaagttgcccagacttgtcttgaactcctgggctcaagcgatcctcctgcctcagcctcccaaagtgctgggattacaggtgtgagccactgcgcctgacctgttaatttattttttgagacagggccttgatctgtcacccaggctggagtgcggtggcacgatcacggctcatagcagtcttgaacttctgggctgaagcgatcctttcacctcagcctcccgggtagctgggactacaggcacgcaccattatacctggctaatttttttatttttggtagagacggggtctccctaagttgcccaggctggtcttgaactcctgggctcaagcgatcctcccaccttggcctcccagtgttgggattacaggcgtgaaccaccatgccagtctgggtcaagtattttatattcattacttgagtttcataacaaccctataaagtaggcatcactgtccattttaaaacaagtaaacagaggcctaggaaaggtaaccacccaaggtcgtatacaccaaggaagaggcaatgctggcattcagacccaggccagtaaacccaaagccccatgcccttgacccaccacaacaatctgggattctgaggggcttgagtcaggtgacaccccagatctaagcatctgaaggtccctaactgtggaggctttcatgagaacaagccactggacggtaagcacacgtcgctcttctcaagggagggtgtactaaaggagcctcatctcactccccctgtgccatggaggccacaccaggtgagcacccttgggagggagacgcatagcctgactggggtgctaatgtgtcccggcactgggttctccacatgaacagttgtgtgaatccaggaggctcagatcacgtgccacagcgccacctactggcctgcgaacaacaacatcaggagatcgattccactggcttttctttgttgctctgtgtgatttctttacatattctggatacactgtcagatgtatgtattagtctctctctatatagagaagaattatataaggaattgactcacgtgattgtgcagaccggcaagtctgaaatttgcagggcaggctggaaactcaggtaagagttgatgttgctgctcgtcttgagttgaaggcagtctggaagccaaaatccttcttcctgggggaactttagtcttttctcttaaggtcttcaactgattgggtgaggcccacccatattatggagggctttactgctttactcaaagtctactgacttaaatgttaatcacatccaaaaagtatcttcacaataatatctaggctgatgtttgccaaacgtctgggcaccaaagcctagcaaagttgacacataaaattagccagcacagcatccacttacttgcttgtaaaatgggcagtgacacaccttttttttagacttaactaatgcacattaaatatgcggcctgttgtaaaaatcttcccatacatgacaactgctttttaccttcttttttttttttttttttttttgagatgaagtctccctcttgtcacccaggctggagtgcaatggtgtgatctcggctcattgcaacctacgcctcctgggttgaagcagtactcctgcctcagcctcccaagtcccaagtagctgggattacaggtgcctgacaccacgcctggctgaatttttttatttttagtacagacggagtttcactatgttggccaggctgatcttgaactcccaatctcaggtgatccacccatcttggcctcccaaagtgctgggattacaggtgtgagccactgcacccagcctactttttaaattactcttgcaagacaaactgcatggcctatccccttggatttccaggttgtgacagatgactggagatgagcaaaatgaaatgacccaaggaggcccagaaacattcagctcgagaagcaaataacccaggcccaggtgtgttggtcagttgcttgtgatgaacgctgggctggagtccacaagtgccattggcactgatgtcttctaaccgagctccttgtgtctgtttactaattatgtgggcttagtgtagacttcctctaggatgcagcctgggagttggtgcaatggtctgattgcagggaggtatctttgcatgcccaggacatgcccctgggtgcatatcctatgtgagcagctctcctcctggcccctggggatattggctagcatgggccctatgctttccagcatcttccgggccctgcatgtagctcgaagtttgtgcttcatttcctcctcagactggctggcccactctgctgctgtgctccagaacctctccactgtgtgaccagtttgaacacccaacctctgcacctatcgtctgggttagaacctttcagcagcctcacaggaaagctttgtgcccagtcttccacagcccatctgcacggggaccaactgctgccagccttgcagagcaaaggtggccaggacggctggccacagaaaagggtgcagacatggggaaggctggctagagtctcatccagagaggagagcccatacttgtgacccattccacattctcctttaccgggcagttttttgtttttttgttttttttaaaacagcatctcactctatctcccaggctggagtgcagtgacacaatcacagctcactgcagcctcgacccctgggctggagtgaccctcctgttgacagctattgtgaggccttggttcttgtcttcttggtttaaaagaatttaaacaagagacacacagcaaaagaagtgcagcatagagtcatttactgtaaagaaaagagtattttgaaagttaactatatataggctgggcatggtggctcacgcctgtaatcccagcactttgggaggccgaggcgggtggatcacaaggtcaggagttcgagaccagcctggccaatatggtgaaatgccgtctctactaaaaatacaaaaattagccgggcatggtggcaagcgcctgtagtcccagctacttgggaggctgaggcagaagtattgcttgaacacaggaggcggaggttgcagtcagccgagatcgtgccactgcactccagcctggccaacagagcaagactgcatctcaaaaaaaaaaaaaaaaaaaaagttaagtatggaatagacagtgcactgagaaacagcattcgtaaggatgagacagcaaagactggcgctagggaggctccctttctggaagcctttcatgattattcgtaagtgggtgggaagaggcgttactagtaggcatggtctgggtggtcttcttggtgcacatgtgcagtagttgtacatgcttgtttatacatcgcatgtctctttagcatctttttttttttttgagacagaatctcactctgtcgccgaggctggagtgcagtagtgcgatctcagctcactgcaacctccacttcccaagttcaagcaattctcctgactcggcttcctgagtagctgggattacaagcacgtgccactacccctggctaatttttgtacttttagcagagccaggctggtctcgaactccaacctcaagtggcctgccctccttggcctcccaaagtgctgggattacaggtgtgagccaccgcacctggcatctttagcatcttaaatctccacccaggggtgtattttttactattaaaatgagcagtgtgtcggtttgaggacaggtgaaatcaaaatgtgcatgctctctacaggggcaatcgcctactgaagacagctttgcttgaatgagctcgattacaatgtgaatgctgaggcttattgtgttgattgtacagtcaccacgcttgctgcgttcccagaacatggtcatttccttaactacctatcctgcctcactcccaccccagcctcttgagtagctgacactacaggtgtgcaacaccacacctggctaatttcttttcttttcttttttttagacagtcttgctcttttgcccaggctggagtgcagtggtgcaatcttgcttcactgcaacctctgcctcccgggttcatgtgattctcttgcctcagccccccgagtagctgggattacaggcatgcaccaccacgcccagctaatttttgtatttttagtagagacagggtttcaccatgttggccaggctggtctcgaacacttgacctcaggtgatccactggccttggcctcccaaagtgctgggattacaggcgtgagccactgtgcctggctccttttcaatttttgtagagacaaggtctcactatgttgctcaggctggtcttgaactcctggcttcaagccatcctcccaaagtgctaggattataggcatgagccactgcacccagccactacctgacagcttttaagccaaagcttagtggaatcatgggagggagaaatcctagcgtcagcaagtgaggactcgggcaaggaaaaggacctctcctctccaggtccacttagtgccagagctctgcgcctcacaacacactgcttgttccaggctccactttttcttctcaaaatgctttataaatgcctggtccccatcctctttggagtaagggttaacgctattcttcaggtaataaaataaggcacagactctcttcatatgatctggtacaacacctcatcccagatgtgaaatcctctttgcctagccaggccatgctttcctcctccaggcaggcttccagatctccagctgcagctactcatccagtcaggagccaagagaacgagagaggtagacagggtgcagcctgcagccttctgcaacctccagccccagaacccctcagcaccagtttataaatgaaagaggtttaattgactcacagttccgtatggctggggaggcctcaggaaacttacaatcatggtggaaggggaagcaggcacatcttacatggtggcaggcaaaaggcggccagagcagggaaaactgctttataaaaccatcagatcttgtgagaactcactcatatcacaagaacagcatgggggaaaccgcccccatgatccaatgatttcccttcccttccttacaggtccctccctcgacacctggggattacaattagagatgcgatttggatggggacaccgagagaaaccatgacaggggctctccagagaagcagcccagccttgggcaacttagttctcccatctgaccatccaacccaataaggctgctgactcacataggaccaggttagtgtttttcttaaaggcactacctttttgtggctaatttttagaatttatttttattattatttttttgagacggagtctcactctgttgcccaggctggagtgcagtggcgtaatcttggctcaccacaacctctgcctcccgggttcaagcaattctcctgcctcagcttcatgagtagctgggactacaggtgcatgccaccacaccctgctaattttttgcagttttaatagagatggggtttcaccgtgttagccaggatggtctctatctcctgacctcgtgatccccctgcctcagcctcccaaagtgctgggattacaggcgtgagccactgtgcccggccgctagaatttaatttttatcagatatataaatactagtttgaagtcaagtaatactacaaagcttataatgatgaacagcagctccctgactcaccaaacccttgcaattctcaatcctcaggagtaataactctcaactcttagagctctttcttatggtaattaactattaattcatgctcatactgttattttattggttttcaggtttcagatattctccactaactaggaagatgattttgctttcagaccacacagacactcatcgcccctcttgccacccatcctttaaatttgattgttttttccttctggggttcaatcaatattcattgtttacattgttttaattatgcaaatatcactacttgaggcataccacatactctaattacatttctgttagttttcctttaactgaaaacgtcttaatttcaccttcattcttgaatgatatatttggtggatatagaattttgagctgacagttcttttctttcaacccctaatgatgttctactggcctctatgatttctgatgagaagtccaagtcattcaaatccttgtctgccttaaatttgttgttttctctgttttcaagattttctcagtttgctttttttttttttttttttgagacagagtctcgctctgtcacccaggctggaatgcagtgctgagatcttggctcactgcaacctctgcctcttgggctcaagcaattctctggcctcagcctccctagtagctaggattacaggcacctgccaccatgcctggctaagttttgtatttttagtagagacagggtttcaccatcttggccaggatggtcttgaactcctgacctcaggtgatccaccagcctcggtctcccaaagtgctgggattacaggtgtgagccactgcgcccagactattttgcatttttaatagtttgatcatgaggtgcttaggcatagttctcttcaaatttattttgtttggggcttattgagtatatttatttatttatgagatggagtctcactctgtcacccaggctggagtacagtggcatgatctcggctcacttgcaacctccacctcctgggttcaagcaattctcgtgccttggcctcccaagtagctgggactacaggcatgcaccaccatttttttgtggctaatttttgtattcttagtagagatggggtttcaccatgttgaccaggctggtcttgaactcctgatctcaagtgacctgcctgcctcggcctctcaaagtgctgggattacaggcgtgagccactgcgtctgaccttattgagctttaatctgtaaacttatttactaaagttgggatgttttcagttattatttctttaaatatttttcttccatgttgtctttcctatcaatttttttctgtccttcagatttcattatttctattatccaacttcatcttcactcactcttttgttggtttttaaaaaatttttttttctatttttttcttttttcactgacttttctttttcaattctgttttactagtaagctcattgctctggttttaatgtgtcccccaaaattcatgcattgatacttaatggacaatgtgatggtattaagaattggggcctttagtaggcaattaagtcataaggttggagccctcatggatggggttagggtccttaataaaagatcttgcaggagtgggctcattctcttctgctcttccaccacgtgaggacatagcattcattccttctggaggatacagcaaaaagataccatctcagaaacagagagcagcccatagcagacaccaaacctgccttgatcttggacttcccagtcttcagaactgtgagaaataaatttctattatttatgcatcacccaatttcagttattttgttatagcagctcaaatagaataagacacccatctagtgattatttttttttttggagacagagtctcactcttgttgcccaggctagggtgtagtggcacgatctcggctcactgcaacctccacctcttgggttcaagtgattctcctgcctcagcctcccgagtagctgggactacaggtacccgccaccacacccagctaattgttttcactagagatggggtttcaccatgttggccaggatggtctcgatctcttgacctcatgatccacctgcctcggcctcccaaagtgctgggattacaggcggaaggtactgcgcccagcctttttttgagacagagtttcgctcttgtcacctaggctggagtgcaatggcgctatctcagctcactgcaacctctgcttcccaggttcaagtgattctcctgcctcagcctcccaagtagctgggattataggtacgcgccaccacgtctggctaatttttgtatttttagcacagatggggtttcaccatgttggccaggctggtcttgaactcctgacctcgtgatccacccgcctcagcctcccaaagtgctgggattacaggtgtgagccaccaagcccagccactattggtgttttagctcccaggtgctacagattgtttgttccaagttttgactcccctctgaaaactgcctgcttttgttcagtttccagagctcttgagtagttcttttctcaatattatccagagcaagtaagtatttgaaagaagatggcttgttagctttctcctctaaaatggaagtgataacccatctcccaaatacttcaccttttatatcatcaatcctttttttttttttttttgagaccaaggctaggaggctaaagtgcatcttggctcactacaacctccacctcctgggttcaagtgattctcctgcctcagcctcccaagtagctaggattacaagcatgtgccaccatgcctgcctaatttttgtatttttagtagacgcggggtttcaccatgttggccaggctggtctcaaactcactgcaagtgagcctctggccttggcttcccaaagtgctgggattacaggcatgagccactacacccagcctagagatcagtcttatttatagctttgttttttggtaaaacgtactaataatgaaaagcacaagtgaatcatttctctttttacgtgattttttgggaacatagtgatgcatatgtgtgctttgctccataaggcaatacttctcttaaagtccacctaactaaaaatggaaaattcttatgcctgtaatcccagcactttgggaggctaagcggggtgtggatcacgaggtcaggagttcgagactagcctggtcaacatagtgaaaccccatctctactaagaaaaatacaaaaaattagccgggcatggtggcgcacgcctgtaatcccaactactcaggaggttgaggcagaaggatctcttgacctcaggaagcggaggttgcagtgagccaacattgaaccactgcactccagcctgggcgacagagctagactttgtctcaaaaaaaaaaaaaaaaaagaaaattcttgcttttcttcctctccttccccttggggtttggttttaggctctctgatgatagcctatgatcacaatgcttatgtaaaaccactctggctttatctgctgattgatcagttccaacagccccatagagctgtgggtttcctgtttcatatctgacagtggtcattctcagaatagtcttttcctatcaacatgtaattaaatccttttactgctgctcttgtgaacacttttgaacactgacagttacactgatatgtaactgagcaaacttcgctttgcctttattttaaagttgcctgtgctcatcaggcgatctgatactccacatcgagaagctccaacctcagggttgtgggagtgtttttaattgtttcctgcgtttcctaccaggcattgccaagtgactagacttaaccttctcaggaagactcgaatgctttcccctctcttaccctaccccgtcattaaggcatagcagatcctcgagttgacctttcatactactgactctcacgtcagtctgcccgttggtcagtttatgcttagtgacttgtccttcagttaggagacttatgttttcttgtttgtttttttgagacaaagtctcactcagtcacccaagctgagtgcagtggtgcaatcacggtcactgcagtcttgacctgctggctcaagcgatcttcccacctcagcctcctgagtagctgggactacaggcgtgcaccaccacatccagataaatttttttaagagatggggtctcactatgttgcccaggctgatctcaaactcctggcctcaagtcatcctcccacctcagcctcttttttttccctgcgagttgcaattatagctgagtgaaacaaactgtaaccgaatgaaagcaacgacaacagaatcctccccaggaagcagctgattagacagggccaaacgcacagacatcttgacaacctgtaaccagcaagttctggcaagttattgatggaggctctttgaagttcagccaaagttgggatccacttggctgggcacggtggctcacttgaggttaggagtttgagaccagcctggccaacatggtcaaactctgtctctactaaaaacacaaaaattagctgggcatggtggtgcatgcctgtaatcccagctacttgggaggccaaggcaggagaatcgattgaacctgggaggcggaggttgcagtgagctgagattgcgtcactgcactccaccccgggtgactctgtctcaaaaaaaaaaaaaaaaaaaagggctgggatccacctactaattattttacagtttccttctctgcggcagagtgagagcaacagaaaaccctccactgttagctgttagcagatgcctctcagtgttctctgctgcttggaggagtgacccatacacttgtgtccagtgagtgctgcaccatgttggcctcttaaggaagcgcttcgcttcagtgctgtccaggacttcccactttcctttacaagaactgcgattacatcagtggcccccgttaggggactgggctactgtaatgtgttttaaaaattaggtgccaagaacatgtacaagaatgttcacagcagcattactcttaagagccaaggtggaaacaatgcaaacatctttttttttttttttttctgagacagggtctggctctgtcgcccaggctggagtgcagtggcgcgatctcagctcactgcaacctccgcctcctgggttcaagcaattctcctgcctcagcctcccgagtagctcggactacaggcacccgccaccatgcccagctaattttgtatttttagcagagacagtttcaccatgttggccaggctggtctcaaactcctgacctcaggtgatccacccacctcagcctcccaaagtgctgggactacaggtgtgagccactgcacctggcctgaaacaatgcaaacatcaactaatcaatggataaaaaaaaatacatccacacaatggactattactctacaatgaaaaggaatacatttctgatacatgctacaacctgaatgaaccttgaaaacattatgtgaaagaatccagagccacaaaaggtgacacattatgtgattccatttattggaagtgtccagaatagacaaatccataaagacagaaagtttcatgggaatgaaaggagttggggtgaatgggggtacattttaatttttttgagctggagtctcactctgttgtccaggctggagtgcagtggtgcaatcttggctcactgcaactttcacctcctgggtcaagtgattctcctgcctcagcctcctaagtagctgcaattataggtgtgcaccaccacacccagctaatttttgtatttttattagagacagggttttgctgtattggccagcatggtcttgaactcctgacctcaagtgatcagcctgcctcggcctcccgaagtgctgcgattacaggcatgagccaccacacccggccagggggtacactttaaatggctgaattgaatgaagtgtgttatatctcaataaagctgtttttaaaaaaagttaagatgccaggtttctgaccccacagtggcaggcaacgaccctgttctgtgagcatccgggattatttttggtatggcagctgcccaggatttttgtgcagagccttcatacctgtcactgatggaggctctccgaagttcaagccaaagctgggatccgcctacaaactgttttacagttttccttcttctccaaggtgcagtgaaagcgaaggaacgctgctggacatggtgagacatggaggactttgtaagggataacctttggttccctgattttttgacatgaatctaacgctctgcaccttcctccttcttcttgacagtgacattcataaaggccagaagctcggtgtttttgtttctgttgtctgtattctgtattctgttccactagtccatctgtccatccttgtaccaatacttcactgtcttcacattacagtaactttttagtcttggttcctggtaggataagtcggaggtttgttgttcttcaagatcaccttggatattctaggtcctttacatttccatataacattttagaaacagcttgccatttttccacccacaaaaaccatgctgggatttggttgagatgactttgacaccacacatcagtttgggaagaaccaacaactttataatactgagtcttccaatgcatatacatagtatatccctccatttagttacattttgttagacttatttctaagtatttgatgctttttgatgctatcataaattatattgttttggcaatttcattttctatttgtagctgttaggtataaatacagtttatttttctgtgttcacctgatactcagtgaccttgctaaactaacttattaattctaatggtttatacatttaaaaatttactgtatattccatcaagttgtctggaaataataaaagttttatttcttcctttccaatctatgctttggtttgttttttgagaccggtctcatactgtcgctcaggctggagtgcagtgtcagatctccgctcaccacaacctccacctcctgggctcaagcgatcctcctgcctcagcctcctgagcagcggggactccaggagtatgccaccaaacccggctaattttcgtatctcttttggtacagacagggtttcaccatgttgcccaggctgatgttgaactcctgggctcaagcaatctgcttgcctaggcctcccaaagtgcaaggattacaggcatgagccgccacgcccagccaaaaaaaaaaaattttttttttaaagcttttctcaagtggtttttgttgttgttgttgtttgttttagacagggcctcactctgtcacccagactggagtgcagtagcatgatcacagatcaccccaggctcaggtgatcctcttacctgagtctcccaagtagcttggactacagggatgcaccaccacacctggctaatttttgtatttttggtaaagatgaggtttcaccatattgctcaggctgtggagttcacggaacattgtagcctcaacctccagggctccagcgatcctcccacctcagcttcctgagtagctgggactacaggcgcaaaccaccacgcccaattaaaaaagttttttttttgtagagattgggggtgggtcttgctatgctgcccaggctggtgtttcattttaaaaaatccaatctgacttttatttgaggtattagtctgttcttgcattgctataaggaactacctgagactgggtaatttatgaagaaaagaggtttaattgactcacagttctgcaggctgtacaggaagtgtggctgcggaagcctcaggaaacttacaatcatgggggaaggcgaaagggaagcagggaaatcttccatggcagagcaggagatagagaagggagaagagttacatgcttttaagcaaccaagttttgtgagaactcactatcaagaggacagcaagggggaagtccgccctcatgatccaatcacctcccccctggcctctcctccaataatggggaacacaactcgacatgagatttgggtggagatacagagccaaaccatataaaggcgtttagaccatttacagtacagttgttgacatggtttggtctatgtctttctgatggattgactcctttatattattaagtatacatctttaataatgttttctggtcttaaagtctactttgtctgatatagtatagctacataaactgatatctttatttttatttatttatttttattcaaacagagtttcactctgtctcccaggctggagtgcagtggcatgatctcggctcactgcaacttccgcctcctgggttcaagcgactctactgcctcagcctcctgagtagctgggattataggtgcacagcacgacacccagctaatttgtgtatttttagtagagatggggtttcaccatattggccaggctggtcttgaactcctgacctcaagtgatctgcctgccttggcctcccaaagtgctgggattagaggcataagccaccacacccagcctcactagttttattatccactgactcgacttgcttgagacgattttactatgttggttatcaaatggtaactttctaattctgtaattccttctgtgtttattagctcaaggtctatgggatgcagtgttgacagggttctgtctacttcacttgcctctgttcccagggcctagctctccaagtctttcaactgaaatcccatagtattccccaggttccctccttttgagagatcttgaaaactgtctactcagctcattgcaacctctgcctcccaggctcaagcgattctccttcttcagcctcctgagctgggattacaggcacacgccaccaggcctggctaatttttgtatttttagcagagatggggtttctccatgttggccaggttggtcttgaactcctaacctcaagtgatccacccgccttggcctcccaaagtgctggaattactggtttcttttttttttttttttttttttttttgagacagggtttcactctgccgcccaggctggaatgcagtgacgcgatctgagctcactgcggtgaagcgatctgagctcactgcagcctctgcctcctgggttctagcgattctcgtgccgcagcctctcgagtagctgggattacaggcacctgccaccattcctgggtaatttttttactcagcactgtgactctgcaaaattccgctctgctttagagaggtctaagcttagtgtttcaggtttgcatcttgtgtattcagatttcaccagatggcttgagacctagccatctattcgaggccattcaagcctccaaattttgtcactccggctggtgagactataaaaacataaaaaacctggatcctcagcctctggccagagttggcaaatgcaagtggctgcaggctgtcagctctcctctctacaatcctgaccctttagttactgttgcctctgcaactcacttaaaccaaaacctcacctctggctttcattttcctttgtaaatctccatcttaaggacttcacaggccgggcgaggtggctcacgcctgtaatctcagcactttgggaggccaaggagggaggatcacctgaggtcaatagttcaagaccagcctggccaacatggcaaaaccccgtctctactaaaaatataaaaattacccaggaatggtggcgggtgcctgtaatcccagctactcgagaggctgaggcaggagaatcgctagaacccaggaggtggaggttgcagtgagctgagatcgcatcactgcactccaccctgggcggcagagtgaaaccctgtctcaaaaagaaaccagtaattccagcattttgggaggccaaggcgggtggatcacttgaggttaggagttcaagaccaacctggccaacatggagaaaccccatctctactaaaaatacaaaaattagctgggcatggtggcatgtgcctgtaatcccagctcaggaggctgaaggaggagaatcgcttgagcctgggaggcagaggttgcaatgagctgagattgcaccactgtattccagcctgggtgacagagcgagactgtctcaaaaaaaagaaaagaaaaaaagaaaaacatctgggaaagtattagactcagtctctggttctgtccccaactctctggggccccttgggtgagtcttttaccttctctgggcctcagatccacccgcctacctattacacccagttctgaggctacagagtgaacagaaaagaaaaccactgctgtccttacagaacttaagcctaacttttccatctataaaatggggatactacaacctcccggagagtaagtgagccagagagcttgctctttgggaggtggcagtggcagacaggaaaagcccatggaaacacaatgtcagaggtcagcccaacctttcacctgggcctgtgtgccctgcagtgaaacttgaacagatcttcactgctgtcacctactgctacctggggctgttgggtgcagctcagttctatggcctgatcctggttgctctctgaagaaatccctgctatttggcccaccctaaggggtctcccagccaaatgggtcaaggagcagtccctggctccaagacccaggcaggagaaaggcatagtcctgccagggccctggagtatgacagccaagcactagcaactgcctagtcctcagaagagcggcctgtgctccagcccctacctcctcatttgagccaacttcctcctagtctgctgcccctgttgcccctctcctcctggcttttctcttccacatcgtccaagtgtctccccaagtacagagtgtttgagaagacactgttctgctgtgggttgttgtgggcaagtgaggtagggatttagggccgaggccgagagctcccagggaaggcctgtctggggagtctgcagcatcctgcgttggggatgttcctatcttctcctacaacccaatggcagctggggttttagtttggtcattcattcaggtccccaggctaatctggccagtgagagggacagtgcctggtggggcaggcattcctgggcactgctgatcagctgtctgagaagggcctcccctctctgcacctcactttttcatcaagtgagaattggatgtctaaggttctcctcattttggctaaaactctttaattcctagccccttttgaggacaaatgccaaatgcctctgaggattatgttggccaaggattttttaccagaaacatcttcacacataaaatgtgagggtgggggcgatacattcagactattaaggcttcagctgggcagctgtctccatcaccgccagggcctctggggctgtggcgtccacttatggggcagagtggagctggggtaggtgaaccaaaatctcccttgtagggtgcactggtgacaaggagcctgaaccatggaccccaccttcctaagcttagatcaaagcaggcagcctctccaagacgctcacggacaggctccccacatgcagagactgatggctgccttgggctccctagacagagcaagatctgcagtgatgactcacaaggaccccaagtccctcctccttcttcctcctctactcttcaccttctccccgtctctcctctatgtctgggcccacagcctcctaggtgacaactgcctatgatgggcatgagttctgagaacaaaccctgggtcccaagtatctgcctcctctcgcagcacatctcattcctcaaatcgtagtatggatattaccacttcaagaaacccctgctaccatgcaaattcctgaagccattcatttttaacacgcagacgcaaattaacttcgccgagacaggcagcagcagaaggctcagggaggaggtctggaaaggctactgacgcagggactgggctgctggaatgtgagggagaagactgacaagggggtgatggggaagggtggccactgaagatcaggcgcctctcaggaccagccatccacacgtcagatctgtacacagagctgccagattctgctctccccaggacagagcctcatgatgtgggcttaaacatatcagtagaatgaataattctggacacattggctcaagagtcagaaaaccccagacgtgacttccagctctgctactagcagcatacagaaaccaaggggatcaaggtccctagtcctctaaaagtccttgagtcctactctgctgaacctaactggtcaagaactaaggacctgatcagcaaggtttgtgagcatcagttggcaagttcaaggccactgcttccactagcagagaggtggttgaggttcctcccagtcaccacagagaagatttaacaagtaaaaacctgcaaactctttattaaattctcccatttcatctgtacagaaaaaaatgcacattatgttcagaacatatctcagtaacatctcaaaattacacagcatgaacatgtaaaaacaagggaccaccacgattttatacatagaaaggaaacccatttacaaaagaggcttgttaattgtatttttttctttctttcaaaaacaaaacaaaacaaaaaaagtgaaaagcctaagatctcacacagcatttgctgtacagactgttttccggatggactggtttgggaacactgtgctgggggaagctgcccaggaagcgctcccgctgccggctttccggaggtctctgcccagtgcactgcagggggacctggagggcccatttctaccaccctagcatgtctgacagaaagccctgctgggctctggggtccagatgtcaactctacattggaggaggcaaaacacaatctagaggcactgtctgaactttcccctggcccagggagatttctccactgcacacagcacagtgtcctatacatgtgtcctggtggagcagagggagcgggagaggaccacgggtcaggatcctgtcaccaccagcctgagcagacagtcccatctttgtgatccaggtgacaaataatcagtccctggtccccacaatgacctcaccagatggctttggggagctcttcaccctaaagattcggtctggtttgctaatgacttatctattatctgaagtctgtggaggaaggaccaagaaggggtgcagttagagggatgagcaaccaaagaccaatgggagggaaggcaggcaagaacctcagacccggccccacgccctctaggaaccaaagtctagtggagaggaggcgagtggggaggaaggaagtgtccctcaaggcctgagagagacccacagcaccagatgctgcattttacaaaaccacttaggtgctgcccaaatggtgagaaataaaaggaagcattctggcctttcaggtttttcaaactcacaagatgttgaaatacaagtaaatataccaaaatgcacataattgaggccaaggtgggtggaccacatgtggtcaggagttcgaaaccagcgtggccaacatgatgaaatcctgtctctactaaaaataagaaaaaattatccaggcatggtggtgcatgcccgtaatcccaactacttgggaggctgaggcaggagaactgcttgaacctaggaggcagaagttgcagtgagccgagattgcgccactgcactccagcctgggcaacgagtgaaactgtgtctcaaaagaaaaaaaaaaaaaaggccaggccgggcgtggtggctcacgcctgtaatgcactttggaaggccgaagtgcactttggccgaagtgggccactttgcggccactttggaaggccgaagtgggcacatcatgaggtcaggagatggagaccatcctggacaacacggtgaaaccccgtctctactaaaaatacaaaaattagctgggtgtggtggtgcatgcctgtaatcccagctactccggaggctgaggcaggacaatcgcttgaaccagggagtcggaggattcggtaagctgagatagcgccacagcactccagcctggcaacggagtgagactccatctcagaaacaaaacaaaaaaccaaaaaagccattacggccaaaatttaggctgactgttctagggctggctgacttccaaggttcctggtccagcttccttcttcttagattaagttctgacttagagtgtgttctaaggaggcaggggaggaaatgggaagggaaggcctcttttcagtggcctctccccagatgactcactatagtaggaacttcggggcagaagtcacaccacaggcctggaggatgggaggataggagacacttccagaagccacactgacataagaacagaatcttctcttgggaaggccaagggaagtcagccacataattccctttccagtgtgccttgataaaacgtaaaacatgaatgaagacactctcaccattagattcttctgttagt

SEQ ID NO: 723 - DNA, 114996 bp, Homo sapiens
ggcattcaataaatatgcaaagtttcctaatctattactttggttcccaaatacttactgttatctcaaactctgtgaaagaggacatgtcaatgacacacacagcttccttacagcacttgacttcagactccacgatgtcaaaccaatctggcttatagaaagtcttgctctgctccaatgccaggaggtctacggaatggaaaaatcacaaggccctgtagagtttagtgtagtccacgtggttctttttcttctgtgaacacattctagcctatgcatttgaaaatacgttttattaattcccaggacaaaaaaaaaaaggagcaaaaatgagaatgtgacttcttacccttgtcagggggaacaaagtactttggcctctcaaatccatgtttctccatccacctggctccctgtgcatccagccggtcgtagagaggagaggtgcgtaactgcctaccggtctggaagtcccagtggggaaccttcagatcatacatcaaagctagaaaagacacgagtagtctatcaaagcccaagacacagattctagacctgagtagccaatatccactagactctggagttgtttctattcaaaagagctttccaggctaacgtagtttgtttttttttttttttaagacggagttttgctcttgttgtccaggctggagtgcagtggcacaatcttggcttactgcaacctccgcctcctgggtttaagcgattctcctgcctcagcttcccgagtagctgggattacaggcacgtgccaccgtgccacactgatttttgtatttttagtagagacagggtttctccatgttggtcaggctggtctcaaactcctgacctcaggtgatctgcccgccccggcctcccgaagtgctgggattacaggcgtgagccactctgctcggcccaatttccaggctaatgtagtctaattttcaaaattacccagtgtatcaggcatgctccagaaggaaagacaatcctgccaagctgctatcgtccctccctggagctacgtgtcacggcatgactcggcctgtattcacattcagcattccacattagtaggtagaaatgatggcagaaaggtcagggtcctaaaccttactaagcttcatagcagagaacaaggttactaagtgggacacaggtggtaacaaaatgtgaaaaaatggcattcgattcttcattgtgcctgtgttaggatctcagacctgttacagacatttcctccctgataattaactcacttctgaagtgaaagggtacatattgtagcttgattaggtggctctgaaatctgagaagttacattgtattgtaccaatgacattattcacacaacaaagctagggtcagaattcatttctcttaggctgggtgtggtggctcacgtctgtaaacccagcactttgagaggtcaaggtgggcggatcacgaggtcaggagttcgagatcagcctgaccaatgtggtgaaaccctgtctctactaaaaatacataaattagccaggcatggtggcaggcacctgtaatcccagctacacgggaggctgaggcaggagaattgcttgaacccaggaggcagaggttgcagtgagccgaaatcacgccacggcactccagcctgggcaatagagcaagactatctcggaaaaaaaaaaaaatttcatttcccttaatgtctaatcttcaacagcaataagtaaaaaaagccagaagagtgggatctgtggtcccttgcaaagagaagacctgatctcacaccgtcccaaacaaaaggcacatcaaggcttggggaggttgggagacaggagaaggaagccaggtggggttctctgcatggtgacaatctctccatctcctggtactttaggttctatcttccccttccccattttcttttctattttttttttttattttttgttgagatggaatccctctctatcacccaggctagagcgcagtggtgcgatcttggctcactgcaacctccgtctcccgggttcaagtgattgtcctgcctcagcctgccaaggagctgggatcacaggcacataccaccacgtggctaaatttttgtatttttagtagagacagggtttcgccatgttggtcaggccagacctcctgacctcaagtgatccgcctgcctcagcctcccaacatgctgggattacaggcttgagccactgcgcctggcgccttccccattttctatgtgcctgccacttctatttcatgagaattggctaccaaaagtgtcatatcaccaagcagaagctcaagctcaattatgatttgtacaggttccaaagtaactatgggtggggaaatttaggcttataatagttcaactttaaaacaaaaaactttgatttttttattttatttttttgagacagggtctcagtcccactgcccaggctggagtacacagtggcaccatcatggctcactgcagcctcaacttccccagctcaggtgattcgcctacctcagcctcccaagtagctgggacttcaggtgtgtgccactaaggcatggctaattttttggttttggttttagtagagacagggtttcgctacgttgcctaggctggtctcaaactcctgacctcaagtgacctacctccctcagcgtcccaaagtgctgggattacagacatgagccagcacacccagccaagttcaacattttaaccaaaatatttgctaaaattaaagaaccttagcagttaaacatattgctgttaggtccttcatctccatggatgtacatcctcttcccaggccaaaagtgagcactcaggcattaaaggccatccagagtcctcaccaacaatgttgttcaactaccaaactaacagtttacttgtaaccaagaatggtggtcagagccaacacagaaacttagtcctgagcataagtatgcccaaaatatttagataccatttggcaaagtctgagaacagctcctcagtacaggaaaatgaaattacaacttgaacccacgtggtttggttcaattcctgatacaaaagctttctaagggcttcctagaaaataaatcagagatcaaggtagaataacaaattaagatgaagtggccagtccttcaaagttgaagcagggcgagaacacgggagtgagagcaggaatgtatgttttgtatttatatgggaagtggctcccaatcttgctgctgtagggtggattaatggtgaaagtcactcacggaagcctgaagctctgagaataacttggcaaattctctgacttggaaagaaaaaactaagtggggagtgagaaagcattttctcaaaaactaagtgggagtgagaaagcattcacttcgacacagggtctctcaaggcagactgcagaaagcacgcacttcgacatacggtctctcaaggcagaccgggaagaaggcattgcttagaatatttatgaagctgctatgtaccaactgtaactcctattctactttcttgttcccagaaggaaaaaaggtccgatgcactaaagaaaatgttacatatatatcatgaggagcataaagccccttaactcaggcctgaaacagtcaaatcaaatgtccaactcaaagcacttgttaaagaactgaggaaaactttgctccttctgaatgacaacacgggccaccgagaagatacctgcaactaggagcaactgcgataaagcttcacttacgcatgacttccatgacccggtggcgcagaaaggtgcggctgctctggagggctccaaaacgtttcaggtccaattcccaaacgttttctgagggataaccatgtaccatccattcggcaaggtacctatatagacagagggcacttgttggggctcaggtgtgagatttgagaaaattaatattctacaaatcgagaactaacagaatcaaaagatcctaaattgccatagaccagctgaatagttttgggcactttccttaacttttctggaagcaacgaacatgggtctgtgtactgctctcaaaagactactatgaggattttaccccagatgataagattccctaggaggcatttaacatagaagccagccagacacattggctgatgcctgtaatcccagaactttgggaggctgaggcaggggattgcttgaagtcaggagtttgagaccagcctggacaacaaagtaagaccccgtctctaccaaaaaaagaaaagtttcaaagtgagccaggtggctcacacctgtaatcccagcactttgggaggctgaggcatacggatcacctgaggtcaggagttcgaaacaagcctgaccaatgtggagaaaccctgtctctattaaaaatacaaaattagccagtgtggtggcacacgcctgtaatcccagctactacggaggctgaggaaggagaactgcttgaacctgggaggcagaggttgcagtaagcctagatcacgccattgcactccagccagggcaacaagagcgaaactccatctcaaaaaacaaaaacaaacaaacaacaacaaaaaaaaaaattagccggcgtggtggcacatgcctgtaatcccagctactcgggaggctgaggcaggagaatcacttgaacccgggaggcagaggttgcggtgagccgagattgtgccattgcactccagcctgggcaacaagagcaaaacttcgtttcaaaaaaaaaaaaaaaaaaagagctgggtatggtggcacatgcctgtagttagttctaactcttctggagtctgatgcgggatgatcccttgagcccaggaacttgcggctgcagtgagctatgatggtgccactgcactccagcctgggtgagagtaagatcttgtttcaaaaaaagttataagcctcatctatgaagaaataagactaaaacacatataaatatactctaaatatccaatgggtttttttctctcacctcaagattatacagttatgtgaccccatctcctttgctccaaacatttttgtaactcctcttctgtaattgtttttagagccattctacaaatcactcaagagaactggtctcataaatttaaaataagcttttcatcgtggctaccatcttacccatttgtaagtattcagttcagtggcagtgggtacattcacactgcggtgtaaccttcactaccatccatcctagaactcttttcctcttgcatttgtggaactctgtgctcattcaagaatagctcccctcccccgcctctggcaaacaccattgtactttctgtctctatgatctgacaactctagcaacttcatataagtggaaccacacagtatttgtccttttgtgactggcttatttaatgttcattagtgtcttattttattttattattattatttttattgagatagagtctcgctctgtcgcccaggctggagtgcagtggcgcaatctcggctcactgcaacctctgcctcccgggttcacgccattctcctgtctcaacctcccaagtagctgggaccacaggcgcccgccacaacggccggctaattttgttcttgtatttttagtagagacgcggtttcactgtgttagccagagtggtctcgatctcgtgaccttgtgatccgcccacctaggcctcccaaagtgctgggattacaagcgtgagccaccgcgcccggcctagtgtctaatttttaaacaaaaacttgtggccgggcacggtggctcatgcctgtaatcctagcactttgggaggccaaggtgggtggatcacttgaagtcaggagttcaagaccagcctggctaacatggtgaaaccctgtctctactaaaaatagaaaaattagccaggtgtgctggcacacgcctctaatcccagctactcgggaggctgaggtaggagaacagcctgaacccaggaggtggaggttacagtgagctgagatcatgtcactgcattccagcctgggtgacagagcaagactgtctaaaaaaacaaacaaaacgtgtattacctagttcaaatacctacctcaatcaacacacttggctaccaaactcaaatacacactcaaatgaccaatatttgttacaattgaaaaaatataaaagaatatcccacaggatctgtggctaactccaaaagatgagttgcaaaaacattttgcctgatgacatttctggaacatggggagcctctcatacttagaaggggacaactccaaaattacatgtatcttcttattagtcttaacatactagattaaatataccacacgccatgttaataacaagtaattctagaagggaagagacccagcaagttgacttatgttcacagctgactttgagtgagaaagacttactttccggctcctccaccaaatgaaaggccagcagagttcattcctgccaggacaaagtagccctacactgcaggagactcgcccatgatgcacctcatgtctgatgcgaaggtctctgggcagttcaccaacttcatgatctccagagtctctaattctggcatcctcctcagaagggaactcaacagaggctctgagcaatgacaacaaaaccaaatagagttctcacctttaaggaattaaaccactttcaacccctctacttttttacactctcccctttcagaaaacctcttgaattttttttttttttttttgagatggagtctcactctgttgccccggctggagtgcggtggcacgatctcaactctctgcaaactctgcctcccaggttcaagcgatcctctcgcctcagcctgccaattagctcagattacaggcgtgcaccaccacgccagctaattttttgtatttttagtagagatggggtttcaccatgatggccacactagtttcgaactcttgacctcaagtgatctgcctgccttggcctcccaaagtgctaggattataggtgtgaaccactgcgcccggctggaagagatttttttaaagacaagccaactgggccatttattacaaagcagaaaccttggtagaattacaggatatagctgcaaaatacttggtataaagactgaggaaaaaagatattggttagaaaggaaagcagcagagaacagcaagtaaaacgtatctacagataataatcttgaagggaccagtgtgagtggacaagctcttaaatggcggccacagagattttaataaaaggtgatgttctgagctgggcatggtggcttgcgtctgtaaccccagcactttgggaggccaaggtgggcggatcacctgaggtcaggagttcaagagcattatggccaaaatggtgaagcctcgcctctactaaaaatacaaaaattagccagtcatgatggtggaagcctgtaatcccagctactcgggaagctgaggcagaaaaatcacttgaatctgagaggtggaggttgaagtgagcagagatcgtgacactgcactccagcctgggcaatagagtgaaactccatctcaggaaaaaaaaaaaaaaggcaatgttctgcattggaatagctgcaaaagacagaccctgctttaaaggaaatctaccatcagggcataatccagtggacagcagaaaaagatgaaaccagaccagagctggataatgggtacatgggggctcatcacactactctcgccaggtttgtttagtagacacatagtctccagtctcgccatgttgcccaggctggtcttcacttcctgggctccagtgatcctcccatcttggcctcccaaaatgatggaattacaggtgtaagccactgtgcccagcttctatccagttttaaaagtttgaaattttccataagaatttattaaaaaacgaaagcccatcaagggtcagagggaaattcttcattagagactctttcacctttttaaacttggaactaggtaactacattattattattattattctttttgagatggagtctcgctctgtcacccaggctggagtgcagtggtgcgatctcagcccactgcagcctctgcctcccgggttccagcaattctcctgcctcagcctcccaggtagctggcattacaggtgcgcgccaccacatccagctaatttttatatttttagtagagacgggtttttgccatgttggccaggctggtcttgaactcctgaccacaggcgatccgcccgccttggcttcccaaagtgctgggattacaggccttaaaggccaggtgcagtggctcatgcctgtaatcccagcactttgggaggccgaggcaggtggatcgcttgaggtcaggagttcaagaccagcctggccaaatagtgaaaccccatctctactaaaaacacaaaaattggctctgcgttgtggtgggcgcctgtaattccagctacctgggaggctgaggcaggagaattgcttgaatccaggaggtggaggatgcagtgagctaagatcgcaccactgcactccagcctgggcaacagagcaagactccatctcaaaatgaatgaatggatacataaataaacaaataaaattattttaaaatttaataaaatactacactaacaaaacaattctgaaaaacaaaacaaaacaattctgttttctaaagaactcctcaattttatatgaagtcctactgaaagaagtctcctcctaaaacctaaaatctgagcaataattttaggtgaataaagaataagcaggggccgggcgtggtggctcatgtctgtaatcccagcactttaggaggccgaggcgggcagatctcctgaggtcaggagttcgagaccagcctgaccaacatggagaaaccctgtctctactaaaaatacaaaattagccaggcgtggtggcgcatgtctgtaatcccagctactcaggaggctgaggcaggagaatcacttgaacccaggaggcagaggttgcggtgagccgagatcgcaccattgcactcgagcctgggcaacaagagtgaaactccatctcagaaaaaaaaaaacacacaaaaaaagaagcagagctgggcacagtggctcacacctttactcccagcactttgggagaccaaggcaggcagatcacttgaggccaggatttcaagaccagcctggccaacgtggtaaaaccctgtctctactaaaaatacataaactagctggacatgttggtgcacgactgtaatcccagctactcaggaggctgaggcatgagaatcacttgaacctaggaggtggaggttggagtgagccgagattgtgccactgcactccagtctgggcgacagagcaagactcttatctcaaaaaaaaaaaaaaaaaaaggccagacgcagtggctcatgcttgtaatcccagcactttgggaggctgagggaggtggatcacctgaggtcaggagttcaagaccagcctgatcaacatggtgaaaccctgtctctactaaaaatacaaaaattagtcaggagtggtggcaggcgcttgtaatcccacctaccacctactctggaggctgaggcaggagaatcacttgaaccggggagtcagaggttgcagtgagccgagatcacaccactgcactccagcctgggcaacagagcgagacttcatctcaaaaaaaaaaaaaaaaaaaaagcagctgggtatcatggctcatgcccgtaatcacagcactttgggaagctgaggcaggaggactgactgagcccaagagttcgagaccagcctgggcaacacagtgagaccccatctcaacaaaaaatttaaacattagctaggcatggtggcaagcacctgtagtcccagctacttgggaggctgatgttgcaggatcacttgagctcacgaatttgaggctacagtgagctatgatcatgccactgcactccagcctaggtgacagggcaagacgccatcttacacacacacaaaatgatagagatgactaaacacacacacacaaagggctaggcaaagtggctcacgtctgtaatcttagcactttgggagtccaaggtggaagggatcacttgagcctcggagttcgagatcaacctgggcaacatagcgagaccatgtctctatcaaaaacaaaaaaaaaaagctatgagaccaggagttcggggctgcagtgagctataattgtgcaactgcactccagtctgagcacagagcaaggctccgtctcaagaaataaaagaaaaaagtaaaactaagaataaaattaaaaaagaataaggcaaatgtccattaactaagattttagtcccctgaatctgctacctagtaactccatcctcagaccaggcaaactcaccctctgtaaccactgttgtacctcatggcgatgttataaacattaaacaaggaactattcttcaaaagactttgaaaaatataacatcttaaacaaatataaggcactactgttataatgcagttcacataccaaagtgatcccagtcccctgtagattctgaatctccagctggttcttgccctcagtgaaaattggttttgggttcttctcaaagcccccagacaggatgccaccctgccagttccgaatataaattcttccatcagcatccacaatagctgaggtggagaaatgacatggagtggggagtggaagaaaaaacaagggtttagaggcaagtcagctttctaaatggacagaacaaccaaacaaaaacacccattaatggctttattaatgaaagaacattcaatgaacgcaggcattcattagctttaaaataccttttgaggtcacgggggaagatcctcccatttagcctttcagtggagactgtttctctgattatcccttacctagaagctttgactagtccccaccacgtaactcccactgtgccaagcgaaagtttaacggaaagggggattgcagagcccattctaggcatgaagaccgtcaaaaggatgtgagaaccctctcctatagtgcttggaaccacgaacccacctaagtctatcgtttacctatgacatttctactatccatagtattcaagttaaaaagtcaacaagacagtccaaatattctcaatgacctctgtttaagactaaaattagcttgcaaaacaaaaaacaaaaacaaaaaaatgtattaatggaaattttggccatcctttcataaagagttaataaagaaaagtcagaattgggtccacctccctgtaacatgctctagaaatgaaagactctttcagacacagtctgtccttagcagaaagttttccttttcagaggacaggacactggcaaagaaacaagattttttaaaaaagtgcaagtcctcacttggtgtgctgctctgcagaggggtctccaaggggcgagtcaggaggtagaagtgttcgcaggcatgtagcgggatactaaccggctcctcgttggacagacccagctcgtatgcccactacaaatggacaggttgatttgtgggtgggaaggggaacagaaataaaaatgagcaagttcagcctcttgagattaattccaagtggcttatgtgtgctcttgctacagtgtcaggtgtgggaagtcagcctgctttagttcaattatttggatggggagcaatactacattttttaagacataaaaattactttgagatcaaaggaagagatatttaccagctagtcaaaggagctcatgggaaccaaaggaggtccttttgataaaacgcctgggctcagctacaaaccccaaatagcaatcactaaatgaacttcacgtggcaaaagtatttcttagttcacttcgggatcatagcatggaaggcaagagccaatctgctttaaaagaagcagtgtcccggaaattagtgtccacattcctgacacaataaaatagcctaatatgttatttgctaggttgtagaatgaaatgtaacaccaagacccagcgccaaggattcacgtcaatgcctgaccatttgctggccttcctgaccaggatagcacccatcaacccagtgtggaggaaggacaaggtcacacaggcttctatttgcagactaagtgtaggtttctgatttagaataccctacaagaaacagcatagttactgatatctgtgtaatgaatcacaatactaaccttacttctctacaccaaaaaaatcttggagacatacgttaaataagaaaatcagtgttggtgctgacctacctggccagcacagttgacaaaatactggcattcaatctgtcctttatcggtctccactccagtaacttgaccttttttgcccattacttgaagaacagatgtccggtcatagatctgaacacctgttccaaggtaaagaaagagttggtgcttcatctgatgttccagaatgaaggcatgtgcagcaggttctccacccagaagaaacactgacaaagtcaagtcaatgctttaatttatttttttattttatttttgagacggagtcttgctttgtcgccaagggtggagggtagtggtgtgatcttggctcgctctctgcctcctgggttcaagcaattctcctgcctcagcctctcaagtagctgggattacaggcatgcaccaccatgtcctgctaatttttgtatttttaatagagatggggttttaccatgctggtcagcctggtcttgaactcctggcctcaggtgatccgcctgccttggcctcccaaagtgctgggattacaggcatgagacaccacgcccggctcaatgctttcatttaaaaaaaaacacaaaaccctagaatcacatcctgagactatgtaaatgggccttgttcgagattgaaaatagcaagtcagtttaaaaacagactttggaacacaataattaaattcctggaatcataaactatggagcaaagaggagaggatgtaaatagtgcgccttaagtgctaacctgctcataccatggatatgataccctggacactagttaagtcttcccctcattcaatgcaactgggcttatgatttcaggtgtggattaaacttccaaggtgtgttttcaccttgagcttctcaagtcctgtgggggaaaatattaccttaagtccaaagggcattaattggcagggcacagtggctcacgcctgtaatcccagcacttagggaggccgaggcaggtggatcatctgaggtcaggagttcaagaccagcctggccaatacggcgaaaccccgtctctactaaaaatacacaaaaaaattacctgggtgtagtggcgcacgcctgtagtcccacctactcgggaggctgaagcaggaggatcacatgaacccaggaggcgaacgttgcagtgagccaagattgtgccactgcactccagcctgggcgaaaagagtgaagctccgtctccaaaaaacgggcattaattagcactaaaagcagttctttagaactttaaaaatgtggccctgagggaaaacactcattaacagataaataaaattataagtgttcaaaatggaggctgagtaccccaaagaggataatctttccaaacttgagttggtgtcacttcctactgtgagacacttccttaggtaatgtcttccctgctaacctatcttaagaaaatgcaaaaacctgctcaccattttgggaggcagcacttgccagggcaagagccacgtcagcggaagacaccactgcatcctcaggaacatgcatggcccccaccaggtcgtgcacgttgaggagatggtgaagctcggccactttcttgggggagatgatctcagaagggatacctataacactgccacagaacacaagggacaatgacattcacaggctctttggcagaggccagtgtggtaaagtcaggacacgcttctagactcttacgtacttcagccctgcgttgatgcgcttcagggagatcagtcggtcctgagtttgggccagaaagattgagcctgtccttgtgtaacctgtaagaaaaatgagcccaaatgagacagatcagaccaaatgtaggacgggagagtggaaaatccactagattataagttagaaggcctgtgatgaatcctgggactgccactcaatatccttgggcaggtaaatcagcttctctgagcttctttgcaaaattttaagaacttcagatgcactaaggctccatgccctgaccaaacattctcagctcacagttttgtgaagttgtgaggatcaaatgagattctaggccaggtgtagtggctcatgcttgtaatcgcagcactttgggaggctgaggggggcggatcatctgaggtcagtagtttgagaccagcctggccagcatggtgaaaccctgtctctactaaaaatacaaaattagccaggcacggtggtgtgcacatgtaattccagctaccggggaggctgaggcaggagaattgcttgaacccaggaggtggaggttgcagtgggtcaaaattgcaccactgcactctagcctgggcaacagagtgagacttcgtctttaaaaaaaagaaaaaaaaagaaaaagacagttttgggcagggattcgaccatccctattcttcccaccttttaggcagtttcaccctttctcctcctagtcttgggggagtgtaatccttagcaaaggccactcacaataacatcagctaccaagggtcggattctcccttcttcttccccagtatagccaaacagtgggcatgcgacctaagcttatccaatcagaccctcctggaacagtcagtcttgagcacgtaggtgaatggctagaggtcaccatctcaagggcagcatcagccaggccaggctgctcctgttctggctgagggactgcctgcggtgcagtccccacatcctggcttccaggctgcctccagctggcagcctcctgccaactccacaggcccaagctcctcccaacaagctccaagttggccagagtcaattcctgttgtctgtaatcaacacacctgatatagaaccataattacacttgggccaatgacaattctcctaaaatacaatgactcttaattcttatgaagaaagagttgaagcaatttggtatcttattttcaaaagaagtacagtaaggataatttacatattttcttaatttcttagtagagacggggtttcaccatgttagccaggatggtctcgatctcctgacctcgtgatccgcctgcctcggcctcccaaagtgctgggattacaggcatgaaccaccatgtttaaaaccggccaacccaagttttaattaccaaagcagtaggcacacctggcagaggaccaaatacagaaatgaatataacaatctcagggacaggcaaagcaataaatggaagacacttgcttacctgttcggatccctgtttcttgctctaactgatggtagagtttgtttgagtagtctgccatcttctgctcaatggtcaagtgcctggcagtgctcaggatgccagcacagaacctggtagagccagcagccagcctgcaggatggatgcaaaatgctattaggtagattgacgtcatctgtgaatacgaggtcagggtttctcatttaatactgtttctaataccaaaagatggaaacaagctgggcacagtggctcacacttataatcccagcacttgaggaggccaaggtaggaggattgaggactgcttgaggacaggggtttatgaccagcctggtcaacacagggagaacccatctctaccaacaacaacaacaaaattagccaggcatggtagcacatgcctgcagacccagctacttgggaggctaaggccagaggagcccttgagttcaaaaggtagaggctgcagtgagctgtgatcacatctctgcactccagcttgggcaacagggtgagaaaaatgttcaatgacatgggatagatttaaaattttgtatagtttaggccaggcacagtggctcatgcctgtaatcccagcactttgacgggctgaggtaggaggttcacttgaggccaggagttcaagactggcctgggcaacatagccagaccatgtctctaccaaaaaaaaaataaataaaaataaataaataaataaaaataaaggctgagtgcggtggcttacgcctgtaatcccaccactttgggaggctgagatgggcggatcacaaggtcaggagatcaaaaccatcttggctaacacagtgaaaccccgtctctacaaaaaatacaaaaaattagtcgggcatcatggcgggcacctgtactcccagctactcgggaggctgaggaaggagaatggcgtgaacccgggaggcagagcttgcagtgagtcaacactgtgccactgcgttccggcctgggtgacagagcgagactccacctcaaaaaaaagtaaaaaaaataaagataaaagttagccaggctacttgggaagctgaggcaggaagatcccttgatcccaaaagtttgcggctgcagtgagctaccattgtgccactgcacttcagactaagcaatagagcaagaccccatctctaaaataaaataaaattttggaattcatctatacaatggaatattatgcagctataaaaaagaatgaaaaggtctttatgtaccaatatggaacaatcataatgaaaaagtaaggtgaagaacagtgtgtaaggtatgctcccacttatataaaaaagggaaaaaatataataaatgaatacccatacacatatacacaaacctaccaacacataattgcttatagaagtagagaatataactagaacttaacttccctccagagaggaaagctttttgttagaagtgaagattgagggctgggtgcagtggctcacatctataatcccagcactttgggaggctgaggcaggcagatcacttgaggtcaggcgttcgagaccagcctggccaacatggcgaaaccccatctctactaaaaacacaaaaatcagctgggcatggtggcaggcgtctgtaatcccagctattcagaaggctgaggcaggaggatcgcctgaacccaggaggcagaggttgcaggagttgaggctgcaccactgcacttcagcctcggtgacagaacaagactccatcttaaaaaaaaaaaaaaaaaaaagaaaaggaaagaacattgaggagtctttttcctgtatactcttttacatatatatatgtgtatgtgtgtgtgtgtgtgtgtgtgtgtgtgtgtgtgtggtgtgtgtatatatgtgtatgtgtatatatatacatgtgtgtatatatatatgtgtatatatatatatatgtttgtgtatatatatatgtgtgtgtgtatatatatatatatatatatttttttttttttttttagacgcagtttcactcgtcacccaggctggagtgcaatggcacaatctcggcttactgcaacctctgcctcctgggttcaagctattctcctgcctcagtctcccgagtagcagggattacaggtgtgtgccaccatgcccagctaatttttgtgtttttttttttgttttttgtttttttagagacggagttttgctcatcactcagattggagtgcaatggcacaatctcggctcaccgcaacctccacctcccaggttcaagcaattctcttgcctcaacctcccaagtagctaggattacaggtgtacaccaccatgcctggctaaatttgtatttttagcagagatggggttttgccatgttggccaggctggtttcgaattcctgaccttagatgatccacccgcctcagcctcccaaagtgctgggattacaggcataagccactgcacccagcttcttttacatattttcaattttgaatcatataaatacattgcctattcaaaagtacataaactttacattgaaaaaaatgttctctaatttgtggtagcaacagaatataaaggctacagtaatgctagggcccaaagacccagttttgcaagggacccatatgtgaagaaagcaggtgggggggttctaaggtcattttccccaaattatttatcactcagtaaataaactaacatctgtgtcagcatgcctgtcacttgagtttactgtatttactctaataattatattttccacataagattgtcagctccctaaagagatttttctatcatctttgtaactgtgtggagctccaccccaggtgggagttccattaactggctggtggtcagcacctatagctctggtgacgtctctgctgggatagcactccttgagcagctttgacagtggctctcgcccttggaggtacatcagagtcccccgggaagcttttaaaaatactgatgcctggcctcacccctagagattctcgtttgttctggggagagatctgggcactggtaattgttaaaagctccccagctgattctaatgtgcagacagatttaagacccattgatctatgagaacaatagtgaagatagagaagaggaataattatagataaagggcagtataaaaccatttcacaagccacggataaggcataagaataacttttattttttgagacagtctcactctgttgcccaggctggagggcagtggcacaaacttggctcactacaatctccgcctcccaggttcaagcaattctcctgcctcagcctcctgagtagctacaattacaggctcataccaccacacccagctaatttttgcatttttagtagagacggggtttcgccatgttgggcaggctggtcttgaactcctgacctcaggtgatccacccaccttggcctcccaaagtcgtgggataacaggcatgagccactgcacttggccgagccataattttttttttttttgagactgagtcttggtctgttgcccaggctggggtgcaatggcgcgatcttggctcactgcatcctccgcctcctggattcaagcgattttcctacctcagcctcccgagtagctgagattaacagatgcgcataaccactcccggttaatttctgtatttttagtagagacggcgtttcaccatgttggccaagctggtctcaaactcctgatctctggtgatccactcgccttggcctcccaaagtgctgggattacaggcgtgagcgatcgtgcctggctggcataattatttttaagtgtgaggtttaaatagtctgccttatatcaattctaaggtattatataatcttgaagcaacaaattaaaccacaaatgaacctccctaggttctcccacttagaaacatttacactgagattagtttatcactttttgtggaaatacctgataattaaatttaaaaggatttcaaaaaataggagaacgactttgacatcaaggaagcattatgaggccaagtgcagtggcccacacctgtaaccccagcactttgggaggttgaggtggtccgatcacttgagcccaggagtttgaggccagcctggacaacaaggtgaaatcacgtctctaccaaaaaaacaaaaaattagccaggcatggtagtgcatgcctgtagtcccagctactcaggaggctgtggtgggaggatcacttgagcccaggaggcagaggttgtagtgagctgagattgaaccactgcactccagcctgagtgacagcgtgagaccctgtctcaaaaacattaacaaaaacaaaacccacttttgctcttaaaagtatccactgcaggccaggcacggtggctcatgcctgtaatcccagcactttgggaggctgaggcgggtggatcagctgaggtcaggagttcaagacctgcctggccaacatggtgaaaccccatctatactaaaaatacaagaattagccaggtgtggtggcatgcaactattaatcccagctacttgggagcctggggcaggagaatcactggaatccgggaggcacaggttgcagtgagctgagatcacgtcaccgcactccagcctgggtgacaaagcaagactctgtctcaaaaaaaaaaaactatccactgcataaaatagaaatccatgagtctaaactggggtgtgtgtgtgtgtgtgtgtgtgtgtatacagatatataactgagtaaataaatgggggagaaggaaatctcttcctgacagtaatatgccaactataataaatgtagaagtataatcaaaaaatcaccatttgtcaaccatcatggtggtggctgactcaggcaacagttgtcaacggatgctaagcccggtaggtggaggtctgatatgaacaggatattggcataatctcagaatccatctctcctcaaagggcactggccagttacaaggggagaaaacagggtctctgtgctagagatgcttggaggacaccaatgtaactgggtgaccagggttatcaccaccagaagtgagacaggacagccatacacctcctgatgtggtgcactgctgagagtccagcctaatttctgtggtcttactgccaaaaatgtatgacctggttatgatgatggatgcacaactctgtacaaacagatttcagcacttaacaaggatgagtggcatggtatgcaaattgtatctcaatacagtgatggttataaaagtctctaacccaagtctgatcataagacaacagcctaggccaggtgtggtggctcatgcctgtaatcccagtactttgggaggccaaggtgggtggatcacctgaggtcaggagtccaagaccagcctggctaacacggtgaaatcctgtctctactaaaaaaacagaaattagctgggcatggtggtgggtgcctgtaatcccagctacttgggaggctgaggcaggagaattgcttgaacccaggaggcggaggttgcagtgagcggaaattgcaccactgcactccagcctgggtgacagagagagactccatttcaaaaaaaaaaaaaaaaaaagaaagaaaagaaaacatcctaggcaacacagggagatcccatctctacagaaaaatacaacaatcagccagatgtgatggtgcatgtcagtagtcccagctacttgggaggctatggcagaaggactgcttgaatccacgaggtcaaggctacagtcagctgtgatagtgtgactgcactccagcttgggtgacacagcaagaccccatcttaaaaaaaaaaaaaaagagaagaagaaaacattagctaaacacaggctgagaattatcagagtgaaaggcctgtattcttttttttttttttttttgagacagtcttgctgtgtcacccaggctagcgtgcagtggcatgatctccactcactgccacctccgcctcacagattcaagcgattctcctgcctcagcctgccgagtagctgggattacaggtgcacaccaccacgcccagctaatttttgtatgtttagcagagacaggttttcaccatgttggccaggctggtatcgaactcctgacctgaggtgatctgcccacctcagcctcccagagtgctgggattacaggtgtgagccaccatgcccggccaatattgttgtatgaatctaacattacttgtatagtggtataatattaattaatgatggattataagaatccattctgtaatctctgtaactattacaaattaatataaagggacttagcttacaagccaatagagcagaaaatacttgacctaaaagaaggtgagcacagagaaactaagcctatagagcatatttctcttggagaatgagaacaatattaagaacctagcaattaagcaaacacaagcagttgtctgctttgcttaaatgcagtccacattatttacaaacacaaatttttgtcaaagtctaaaatgttgctgggtacagtgggtcatgcctgtagtcccagcactttgggaggccaaggtgggaggactgcttgaggccaggaattcaagctcagcctgggtaagaaagcgagatcctgtctaccaaaacaccaccaccaaaaaaaaaaaaaaaaaaaaaaaaaaaaaaaggaaaacgacgaaatttgccaactctctaaaaaccagagaacatgagcattattagtcatccttaaacaaaattcaggagattccaccttgcttcttctcatgctacttagcaacatttagattagctactggtggggcagtatctctgaaaggagagggaatctgatacgattagtgcagcacagccatgagccaaatgcagtctgatccttacctgccctgctccaaaaggacaatatccttccaccccattttggattggtgatgggccacagaagtgcccgtgattccacctccacagacgaccacctgtgcctgggtgggcagggccatggaacgcgcctcggcagctgatgcgctgtttcttgcagaggaccagttctgccatcctgggctggctctttgtcttccaacaatcgacagcaaccagtagaacatcatgtctctcaccaactagatctcaggaactcaaactagacagagaaaccaaacatatttcatgccattcaactcagtgcatgggattaatgagaaagggatttgacaaagaacgatagccattcattcagcaaatatttgagggtggccgggcgcggtgcctcacacctgtaatcccagcactctgggaggccgaggcgggcggatcacgaggtcaggagatcgagaccatcctggctaacacagtgaaaccccgtctctactaaaaacacaaaaaattaggctgggcgcagtggctcacatctataatcccagcactttgggaggccgcggcgagtggataacgaggtcaggtgttcgagaccagcctgaccaacatggtgaaaccctgtctctactaaaaatacaaaaattagctgggcatggtggcgggtgcctgtaatcccagctactcaggaggctgaggcaggagaattgcttgaacccgggaggcggaggttgcagtgagcagagatcgcgccaccgcactccagcctgggcgacagagcgagactccgtctcaaaaaacaaaaacaaaaacaaaaaaagaaatatttgagggcattctgagtttcagatattctgctagcagtgaacaagaatggggaagtccctgtctttatgaaatttacatttgagagtttgcgtgtgtgaatgaggagagcaccaatcaatatacaagtaaacatacaaataaaacagtaaataaagctaatgtgatagagtaactaggggcatatttaaaacaggatggtcagaaacagcctccaaggaagtgacatttggaaacagacctgaaggataaggaacgagctatacatttggcagacactgagacgagcatgtgcaaaagccctgaggtaagacagaccaagaacaaaaaggaggccggcatgtacacgacacggggagtgtggggagatgatctaagacaatgctggagaggcaggcggaagccagttacacacagcccttgggtgccatcagcaggagttggaattttattcaaagtacaaaggaaaatcactcatgcgggagtatcactagcaggggaatgaaatgatctgggatgtttttcttttctttgttttttttggcggtgaggggtggggggatgttttccaaaggtcagtctggctccatggtggagagcggatggtagaattataaaaacagagtcgacttcctaggctcaagtgatcctcccaccttggtctcccaaagtgctgagattacaggcatgaaccactgcccttggacaaggcagggttttaacaaacttaatctatcagcaaaacagatgactgttcaagtttcaagaaactgaagaagaaagcacctactggctgtccatgcagtcatgtgtacaggaggatgaggactttgagacgagaggcggtagacaagggggcctcagggcagctcactgctagtcatctccttaccgcctccactgccagccacaggacccacagatgctccacagtcagcccaaattgtccaaggccaaggtatctatgtccatccatcagaattgcaaccaatgcaagcacagactatgtccagacagacatcccatccaactggagacaaattgtcttggccaccttgtggttgccaccatgcctctcatccctggtccctgttaagcaccatctcaaaacagaagcttctctacccggctagtctttacataatctcatctctacgtgaccaatttatttcccgtggcccaagctctctttgctttcctctccttcaagctcctctactgcaccctctagaatacctttcccaaaggtaaacacccacccctttgctgacatcctctctaccctctgtcccaatggcaacacagctctcctggggaactgctgctgccaaatggccagccccatcccattgacctcactgtcaacctcctggcttctgacccgtgaccactcggttatacttgaaaactgtcctgctccttggtggcttaggctagcacatgttaagccacaggtagacctctgtctgtattcaggttcagagcccagctattcctctctcaaccttcaacttcacctcctttcttccctcattctaagcagataacctggctcatctcattccctgaaacccttcctatagacccacttacatctgcaaccatctcttccttcttttatccactggaaagttaatctcccccaagggccctggatcccacttcctcctctcttctcttgaccctagctccatcaactgctgtctctctttcctgtacctgcaatgtttccctccgtttttgctccttttcctcagcaatttttttttttttgagacggagtctcgctctgtcgcccagttgggagtgcagcggtgtgatctcggctcactgcaacctctacattccaggttcaagcaattctcctgcctcggcctcctgaacagctggcactataagtacgcgccaccacgcccagctactttttgtatttttagtagagatagggtttcgccatgttaattaggctggttttgaactcctcacctcgggtgatccactggccttggcctcccaaagtgctgggattacaggtgtaagccaccacacccaccttaatgactttctgatgccctcaggaaaaaggcaaaactcttttcatatcaagtgcaagatccttcacagtctggttcttatctgtggtctcatttctcctttcctcacactctgaccaagccagactgaacaacctgtaattcgtcaaacatatcaggtgaggtgtgaatgttctattcggctccaggttctgtgcatgctgttccctcctggcaggttcctgccacccctcccgcaaatacaggtaatctcctcaggtcacagcctctttgacatcttatttatttattttttttgagatggagtctcgctctgtcgcccacgctggagtgcagtggtgcgatctcagctcactgcaagctctgcctcctggattgatgccattctcctgcctcagcctcctgagtagctgggactacaggcacccgccaccatgcctggctaatttttttttttaatttttaggagagacggggtttcaccatgttagccaggatggtctcaatctcccgacctcgtgatccgcctgccttggcctcccaaagtgctgggattacaggtatgagccaccgtgcccagccctgtctttgacatcttatctgacaatctccccctccttctccaacacttggttaggtggcttttctatgttctcctataacacactacacttctcccagcacagaacttaccacactgcacaatggtctgtttgccaatcagagaagcaacatgccagcatggcagggaatccaggctttgggggcggacagttctgggtttgaaaatatccccacctctcactagctgtatgactatcagcaagttactaaatctctaggctttgaactcctcatctgtaacacgggctagaaacacctacctcacatggttgctgcaaagactaaatcagacaaggcaggaagaacatggtacaagcacctaagaagcactcagtaagtggtagttattttttattattttttgagacgaggtctgtcatgcaggctggagtacagcggcatgatcatggctcactgcagtctcaaccacccagactcaagcgatcctcccacctcagcctccagagtagctgggaccacagatgtgtaccatcacactcagctaattttaaaattatgaatatttgtagaggtgaggtctcactacgttgcccaggatggtctcgagctcctgacctcaagtgatctgcccacattggcctcccaaagtgctggaattacaggctaagccaccacacccggcctattatttccctattataatggaactaagagcagaaaccttataaattgctcaattttcccagcgttcagcataggtacctaggaaatatatgttgatgcatgaatgagaacagagaacaaagaagatggggggaaaaaatcaaaggtaggacccccagatttgaggagatatctaaatacctgagagaattatttttatttttatttattgtgaaacagagtctcactctgtcgcccaggctgaagtgcagaggcgtgatctcagctcactgcaacctctgccttccaggttcaagtgtttctcccgcctcagcctcccgagtagctgggattacaggcgcacgccactgtgcccgactaattttttgtatttttagtagagatggagtttcaccatgttggccaggctggtctcgaactcctgacctcaggtgatccacccaccttggcctcccaaagtgctgggattacaggcatgagccactgtgaccggccaataatttttaaagctaatatttttataagtagttacaatgcaccagatactgcctatgtatataactaatttaatcctcacaaccttatgaggtagatactagcatttctattctacacttgaggaaacaggcacagataagtggaagtgactcacccaaggtcctaccaaactgttgagtagcagaaccctgccaatttggcattagtggccggctatttaatcatgactccacgctacctttcaaataaaagcagatggtaaggaaaggacagctgtgaggactgaaccattaagcacattcccctaacagagaaagggaattgcaaaggtggcagaacaaacacagtaacagatgagttttaaggaggaattaaaaaaaaactttaggccgggcgccatgtctcacgcctgtaatctcagcactttgggaggccgaggcgggtagatcatttgaggtcggaaattggagaccagcctggcaaacatggtgaaactccgtctctaccaaagatacaaaaaattagctgggtgtggtggcacgcacctgtggtcccaggtactcatggtgcggccaccattgcatcttgggcctcactaaccagttcccgtttgttggattcaatactgtctcaccacacaggccaatcttgtgttttattaattttttaaatttttttttttttttttgtagagatgggctcactatgttgcccaggctggtcctgaactcctgaggtaggaggatcgcttgagcctgggagacagaggttgcagtgagccgagattatgctactgcactcctgcctgggtgacacagtgagactctgtcttaaacaaaacaaaacaaaaaaaggccaggcgcaggggctcacacctgtaatcctagcactttgggaggccaaggtgggtggatcatttgaggtcaggagtttgagaccagcctgatcagcatggtgaaaccccgtctctactaaaaacagaaaaattagccaggtgtcgtggcttgcacctgtagtcccagctactcaggaggctgagacaggaaaattgcttcaaccagggagatggaggctgcagtgcgcagagtcgcgccactgcctgggtgacacagtgagactccatctcaaaaaagcccagggtgcttggcgccaaaaaagggatctctgaccttgtgttcattatgaccttcaaaagagtgaagtggtgagggcatgagggcagaggaaaagaagggcttaagacaacgaaggaaaagaaggcaccagagtctagtgcctttgccgccaaacctaagcctataaggttggcagcaaaaccaaagcacaaactgatagcaaaggaggtaaagccaggggagaagaaactgaagacgtcaaagacagaaatgaagcacatcatctggtttaaaacaaatgatagagtttttacagttctggaaaatgaccgtataatattctctgctaagaagaataacttctgctaaacaaccataagactgcagctggctctactcagatctgcttattccaacaagaccaaggtgctagttctaacttcgagtagtccctctgtatggctgcagcgttgcgcacagtggactgccggtcacaaggaagactggatgagcgtgggttcacacatttcccacacttgcctcagcaaaagaaccacctgggacacttgtttaaaaatgacagattcccacggtccacctcggcagattctgatcctgccacgccagggagctgtatttttcaacaagtacaccaggtgatcacgcaagtttaagaaattagcacaagttggccgggcgcagtggctcacgcctgtaatcccagcactttgggaggctgaggcgggcgaatcacgaggtcaggagttccagaccagcctggccaacatagtgaaaccccgtctctactaaaaacacaaaaattagccgggcgtggtggcgcacacctgtattcccagctacttgggaggctgaggcaggagaattgcttgaacccaggaggcagaggttgcagtgagccgagatcgcgccactgcactcccgcctgggcgacagagtgagactccgtctcggaaaaaagaaaaaaaaagaaaaaagaaaaaagaaattaacacaagtccctgccactggaaacgcatatccgttgggctggctcctcctccaccaccagcccccatcccggtacatcacgtttacatgcatgcggaaaatgggcttggagattcttgattcaaatccgaggtatcacacatcggcccccaaaggtcaaacattaagaaggaagcttactgccctgtcccagacttttctaggtgacttcttcctccggactctgcagcagtcttactagttctgaaagcacaagcggaccgcacgtctcaacgcgggaaaacagttccatctgcagggatggaggaccgggctagacaagctggagttggctctgcgccgcaggggtgtgcaagcccaagactggggagcccgaggtcaccccggccgccctggcatcggggctgaggtgcaggctcctggaggagcggtgcgcaggcccaggggtagccgaggacacaagccaaggcacgagcggacaaccttacggggacgagtactaccgcccggacgcgacttcgcgagaggccaggcggaacccactggaagcgtgagctagcggggaccacccccgggcgaaaccaaaggagaaagaggggaacccaggggtcccggggcgcttaggcccgcgcggacggggaggccagagttgccccgaagctatctccttacctcaccggcccccacgggctccgcgctcagctacagcccggcgggagcaatgcggcagccacaacagttgccggcggtcgccgcgggccggaaagcggggttcggggatgggaagggggcggggcgaagcgagcaaaaagttccggggaagccgagaccgcgaccttccgcgctttacggcccccgggcacgggtaccgccggcgcgtgacctcagccgcgcccgagcgcgccgtgacgccctcgcggagccccgcccctgccacgtgggcttgtttgggtctcgcgaggcaccgcccccgcggcctctttgccaccctcagaggcgagctgtggaagccttgactcttagggccgttttagaacccgggcctcggaccggcggggtttctgcacgtggaaccggaacatctgagatgatcgcaggccctgtggagtgtggggagcgcgggggttctttcttccctcgaggcccgtgccagggcttactccaaagccagtgggtccccagtcctaagccaagcagtcccgggggaaaacgcttctcatcgccgtgggagcgcggatcttggaagtggctctgggctttcttgggcgaggctctcacagagtagatcggaaatccattctgctggcccgccccacctcggaggacggactaacggacctgagttcccggccctatcttactcttctcagcttctcagcttggctcagctcagaggaagaggaatcactgaagtctcagagaagtctccactcatcccttcctcaccgtcacatcagccttttctttccttctagaagtcatcactgactcaaggatataagtttgatgactgtcttttccactggtgtgacacgatctctgtcgacagaaccttagtcttatgcatagctttattctcagcacccagaacagtgcctggcacctcttccactgaatattatatgcataagggtctcatgctgcagccaccattgcatcttgggccacactatccagttcccgtttgttggattcaatactgtctcaccacacaaaccaatcttgtgttttattaattaaaaaaaattttttttttttttgtagagataggctcactgtgttgcccaggctgggcctgaactcctggcttcaagtgatccttccatctcagcctcccaaagtcctgggattacaggcgtgagccactgtgcctgccccaatcttgtgttttattgctggccacctgtagccaggcactgtgcaggatgatgggatccagcagtgtacaagaaagaggcggtttctgctcttagggagtggcagtcaagttccagggacccctctgtcacaaggccaggccacagcctacatagtttataccccatttactggccagtcaaatcacacaaagacagcccagatgaggtctgccagacagtggactgaaactatgccataggctcctgtgctagataaatacttccatattttagctaggattgaatgcttggggacacctacctgtctaaaaaaagagaaaacggctgaccaatttgagacattctcggggaaggctttcctgatgcccagatgtggcaatttcatgaaaaatatcacaggttttcctcatgaaccatttggttcaagccatttccaggcacatgaatttgggagaaacctggttgtctgcaggagatggtggatgaaatcaagtgaaatacttaatgtgttgatttcattctgtttacgtgcagtaaatagcaaacaaatggtatagatctgtccctgatttccttctccatcaccatgatcggcctccactccaaaatgctaagtcaggctgggtgcggtggctcatgcctataatgccagcactttgggaggccaaggcagttggatcacgtgaggtcagaagttcgagaccagcctgatcaatatggtgaaaccccatctctactaaaaaatacaaaaattagctgggcgtggtgacacatgcctgtaatcccagctacttgggaggctgggacaggagaattgcttaaacccaggaggcggaggttgcagtgagctaagattgtgtcactgcactctagcctaggtgacagagcgagactgtctcaaaaaaaaaaaaaaaaaaaaaggaaggaagtcctaaggcccctttcattgtcaaagatgggtcttgtccttagtaggttctcataaccactgatgcactattttttctagggggttgagtgtttttattttattattattttttagatggaggctcactctgttgcccaggctggagtgcaatggcgtggtctcggttcactgcaacctctgcctcccaggttcaggcgattctcctacctcagcctccccagtagctgggactgtacaggcgtgcgccaccacgctgggctaatttttgtatttttattagagacagggtttcactatgttggccaggctggtcccaaactcctgacctcatgatccgcccacctaggcctcccaaagtgctggaattacaggtgtgagccaccgcgtccagcctatttttattttttgagattagctctcactctgtcacccaggctggagcacagtggtgcaatcacggctcactgcagtcttaacttcctgggctctagcgattctcccacctcagcctcccgaatagctgagacctcaggcgtgttccaccgtccccagctaacttttgtattttttggtagaggtggggtttcactatgttgctgaggctggcattaaactcctgacctcaagagatccacctgccttggcctcccaatgtgctgggattagaggcatgagccaccacgtcctgccctaaacagacgttttaattacgcttgtcaagtcctcttgtgaaatattcatctgcagtgacttggtaaatgtgtttgctaccacacaggataaacagtgtacagacaaacatttgacatacctatgttaccacagtgtaagaatgaatttggatctgaggtcgctaagatgcaggcgtttatcttacctccctccagcaccggcatggctgtggggaaggcctccctcctccctctgaagttcttgtcgccatcagtagactggacatctgcctacaaccgacttcacagaaaggacctgacacctggcatgcttctcgtgtgcttgagagcctgtgtttgtgtggaaagcagggatgttctcattcacaccatgggaagagaagaatgttgcgagtaacaatcagtactttttttttttttttttttttttgtgagacagagtcttgctttgtcacccaggctggagtacggtggcgcgatcttggctcactgcaagctctgcctcccgggttcacgccattctcctgcatcagcctcccgagcagctgggactacaggcgcatgccaccatgcccagctaatttttgtatttttagtagagacagggtttcaccatgttggccaggatggtctcgatctcttgatccactgcgcccagccaggaacttcttttttttttttgagacggagtctcactgtgtcgccaggctagactgctgtagtgcgatctcggctcactgcaacctccaactccctggttcaagggattctcctgcctctgcctcctgagtagctgggattacaggcgtgtgccaccacacccagctaaattttgtatttttaatagagatggggtttcactatgttggccaggatggtctcgatctcctgaccttgtgatccgctcgcctcggcctcccagagtgttgggattacaggcatgagccactacacccggcctggaacttctctctctttttttttttttgagacggagtctcgctcagtcacccaggctggagtgcagtggcaccatctcggctcgctgcaagctccgtctcctgggttcatgccattctcctgcctcagcctcccgagtagctgggactacaggcgcccaccactatgcccggctaatttttttgtatttttagtagagatggggtttcaccgtgttagccaggatggtctcgatctcctgacctcgtgatctgcctgcctcagcctcccaaagtgctgggattacaggcgtgggccgcggcacccggcccaggaacttctcttatatctagaagccaccggatgttaactaagagtcctgggaagaaatggtagtcatttaaagcttttttaagagggaagacttgcactgggtcttaatgaaaatacataggacaaaatttttccttctgtatcagctcacgtaatctttctggcaatctcatgaagtaaattttagcagatagagtagacacagatgtaacatgacttttccaagatcacacacctaggaggaaggaccagaaatggagctcttcccatgttgaatatctgaatctaatgatctttgcactatgccataggacaggtggccaggaaagcatctgagactgggtgatgtaagggctggatacagagacagaaaaaagcaggcagtgtaacaggaaggaacgcagctagctatggtagatgggatgttgttttcaattcctcattccctattgccatgtgaccttgcagtgcacgaaatggggggagtaggattcctgtcccactgatgttggttggcttcagtcaaacattattattattattttgagatggagtcttgctctgtcgctaggctggagtgcagtggcacgatctcggctcactgcaacctctgcctcctgggttcaagcaattcttctgcctcagcctcccgattagctggtactacaggagcacgccaccacacccagctaatttttgtatatataaattttttttagttgagacagggtttcaccatgttggccaggatggcctcaatctcttgaccttgtgatccgcccgccttggcctcccaacgtgctgggattacaggcgtgagccattgcacctggccaaccaaacttattttttaaggtgggtagaagccatagtgtacagatctggagattggccttaagaggtgttgagcatgtcatcagcccttgtcacaagtttatgccctgagtagctgttggatcatggaaagtgaaaggcacttgaaacagacctgaactcagcctgaagccaagcctgctgaccctcagcctgaaacaaagctgtccaagcctgctgaccctcagtttgaaacaaagctgtccaagcctactgactctcagtttgaaacacagctgtccagctagaccatagtcacctacagtctcatgagcatggcactgaatgctttgttgtaaggcactgagttttgggctggtttactaggtagccttttttgcagctcaaataaaggctgtctgatagtgcaattatataagaatggtgaaatcagggcctacgccttcttaaggaaatcttcactcactgcagtcttgcaagtcaatggtcttattctgcttatccaactaattctggagcagctacatctgggaaccccgtaggctcacgtctacaacagtgtcttcatcctgtcttctcaatcagccccttctatttccagttccaggaatggccaaccacaccagaaacctgggactcacctggtctccccactcgcctctccctccacctcctgctcatcacccagcctcaaagggtctgtctcctcagtgcctctcctctgttcggacctctctgtccctaccaccgctgctgtggttgagagggttgtcagccctgacttcgagaacaatctttttttttttttgagatggagcctcagtctgtcgcccaggctggagtgcagtggtgcgatcttggctcactgcaacctccgcctcccgggttgaagtgattctcctgcctcagcctcctgagtagctgggattacaggcatgcaccaccatgccccgctaatttttgtatgtttagtagagactgggtttcaccatattggtcaggctggtctcgaactccaaaccttgtgatccgcccgcctctgagatcagaactgagatcacgccactgcattccaacctgggcaacaagagctaactctgtctcaaaaaaaaaaaaaaaagtttttaaagacagggtctcgctatgttgcccatgctggtcttgaattcctggggtcaagtgatgcttctgctttagcctcccaaggagctggaatcatgggtgcccaccaccatgctcggctactattttcttcaaaattcaaatattctagcttaacagtacctattagataaataaatggcaattttctggaacattctttttttggttttgttttggttttttttttttttttttttttttgaaacggagtctccctctgtcgcccaggctggagtgcagtggcgcaatctcggctcactgccagctccgcttcccgagttcacgccattctcctgcctcagcctgccgagtagctacgactacaggtgcctgctaccacgcccggctaatttttctgtagttttagtagagacggggtttcaccgtgttagccaggatggtctcgatctcctgacctcgtgatccacccgcctcggcctcccaaagtgctgggattacaggcttgagccgtggcacccggcccaggaacttctcttatatctagaagccaggcttggtgactctacttgctcaccagatgatcctacacctgccacctccgatggatccactgcctctgtgcctgcctgtactgctgatgctccagtggataactcagcatcccagcctaggcccaatgccactgaagatggacctgccccctggagacccaggagttctaccactcagctgtccccagaagtgcccagaccctcattcttatccaggacctaggagccctaccccctggccttccgtcatcagccgtaaatgatgatttactgctgttaccatcatcactgcatttagtaaccaagggccttccaaggtgccagctctggaacgaaggatgcctttgggaggtgatgacactcaggtacacgggtgctcaacagattgcttcctcctatcctcagatggtctttgcatgcatgcagccattggcactcccattgtacgcaaggaaaccagcccagggtcacacagctggtcagcagcaacacagctggtctcaaatctaaggtgcctggccatgcctccatgagggaccgcctgcaagggaggttgatcctggctttggggagcctttcctgggctgcacgagtaacctccaatgtttgaggccccaaactctgctcacatcttcctttccctgtctctgcttgggctatgatcacggtgactctagcaacccttcatggacattatagtactctctgccattcacttttggtctaatctgacttcaacccccacttacttggtctctccttttacaaccaacacaaccgaaatccgagggcttctttttttttgagacagagtctcattccattctgtcacccaggctggagtgcaatggcacgatctcggctcactgcaacctccacctcctgggttcaagggattgtcctgcctcagcctcctgagtagctgggattacaggcgggtgccaccgtgcctggctaatttttgtatttttagtagagacggggtttcaccatgttggtcaggctgatctcgaactcctaacctcgtgatccgcctgcctcagcctcccaaagtgctgggattacaggcgtgagccaccatgcccagccaaatctagggctggaacatggctgcagcatataaatagaattgaattccatagttttgttaaccctgttttttgtttgtttgtagttgttgctgtttttgagactgagtctcgctctgtcgcctaggctggagtgcagtggtgcaatctcggctcactgcagactctgcctcccgggttcaaactattctcctgcctcagcctcccaagtaggtgggactaaggcgcccaccaccacacccggctaatttttgtattttattagagacagggtttcaccatattggccaggctggtctggaactcctgaccttgtgatccacccacctcggcctcccaaagtgctgggattacaggcgtgagccaccacacccagcccctgttttgtttttgttttgcttgtttcttagggttgtttttctatttatggtaaaggcattggctttccatttgtagcatcaatagaatatttcctgtttacaataaccttatgtcatagtaaatggtaaagggatttaaagcagtggttttcagctgccagaggcctgagtgagtttgggcacactctgtgtgatcgggcagaaggcctgtgggaagttcagctgaggacagggccaggaaaggtgatggacagtgggggtctgtcctggtcaccagacccctgggtcctgcccacctgcttggagctccccacccatcacacatgatgctgccaagccctctgggtattgtgggcaaataccttaggagagaagctgatgaactttgtttcttgaaatgcacagattccttggacgtccctgagaggtcaatgatgaaggtcaacttggttttctccccctcatttgggttcagaatttaaagtccacacacacaggcagtaagatgattatagataaggacatcatcactcggtttcagatgttaaaatgtctaggtgggttaggggtgatttgagatcacacaaccttgtgccacaaagaggaattcccaggccagggggagacattttattgccatgttatgatctcatcattgagttgaaaggcaatcttgtttcattttggattctttcttatgtttatgtcttataagggcactttgaatttccaagcaaataataattttgaattagcttttaatcattgacttctagcacagttatatgatcagaaacatgctgtgtgatttgattgctctcaaatatattgagatttgctggaacaaaataagtcaggttaatttttgtaaatgtaccatgcatgcttaaaatgaatgtatctacatttgttcctgagatacaggttgatggacggatggctacatggatgtgatggagatggtttactatcgggaccttccgcatcctgctgatgttttgttgcttaggatatgaatggctgagcggaggctgtaaaacctggcactctgcttgggtatgaagttcttcctgccatcctgccatcatttgttttttatgttttgtcgccaaaagtgaccttgaggaaccctgggagctcaggaaggaaggagagcccagaagcagggacagggagctggttggggaggaccagaaatcaggtttgtgaaggttccagagaggacctgtccttgcgaggagtgtgggagactgagatgggggaggggtcattggaatgatgcgggcgctacttggcattgtccattgtgaggcaccaccggggtcatcagggattggtggagagggagtataaagccccagggttgctaagggagggcccagaccgaagaaggtttggtggatagcagaacctttttgtctccctctaattgctcctaagcctcacgctcccttgccccacgtgtcctgttgcttccctgatcttctccgtgacctgtagctaaaccttccaccagcgcttgagaacttaatttgaaccggatcctttcccagacccctttcttctcctcctcctcctcctccacctcctccaggtgcccaacagcccccttctcctcctttcccttcccttacttccccccttcccctcccctccccctccccctcccctccccctcccctccccctcccctccccctcccctccccctcccctccccctccccaacttagatccggccccggtccccgtccccttccctcccccctgccctaagccacctccacctctgtcctggccgcctcagggcgccctgaaaggaccaggacatgcggctgcgcttttggctcctcatttggctcctgctgggatttatcagccatcagcccacccctgtgagtagacgctggacccgccgggtttcttcctttttactgggctgtgtcacgcggcatgaaattacacagctcaggcctgtaatcccagcactttagggggccgaggtgggcagatcacttgagtccaggagttgaagactagccagggcatcatggcgaaaccccatctctacaaaaaattccaaaaaagattagtcgggcctggtggtgcgtacctgttatcacagttactggagaggctgaggtgggaggatcgcttgggcccaggagctggacgttgcagtgagctgagatggccccgctgcactcttgtctctaacaaacaaaatggaccaaaacaaagtgaaatgtcatttgatttgtgtcacctggtttgatgcctttttttttttttttttttttttgacagagtctcactctgtcgcccaggctggagtgcagtggcaagatctcggctcactgcaacctccgcttccggggttcaagcaattgtcctgcctcagcctcctgagtagctcagattacaacgcctggctaatttttgtatttttagtagagacggggttttaccatgttcgccaggatagtctccatctcttgacctcgtgatccgcctgcctcggcctcccagtgctgggattacaggcgtgaaccaccgcgcctggccaaaatatataaccttaagtgtaagtttactaactttggaaagtacatacaccagcataaaccgaccccctttcaagatctacattattttatttatttatttatttatttgagacagtttctcccttgttgtccaggctggagtgcaatggggcaatatcagctcaccgcaaccgctgcttcccaggttcgagcgattctcctgcctcagcctcccgagtggctgggattacagacatgtgccaccactcccagctaattttgtatttttagtagagatagggtttctccatgttggtcaggctggttttgaactcccgacctcaggtgatccgcccgccttggcctcccaaagtgttgggattacaggcgtgaaccaccgtgcccagccaagatctacactattatgtcaccccagaaagtgaactcccactcttcccagccagtctctttcttatcataggttagcttgcttattctggaatttcgcgtatacagatgcatgccatgccataggtactcttttgtgtctgctttattctgctcaacaccatgtttctgaaatcattaccgttgttgtatggttctctaactccatcatttccatttcagactcagcatatgctgagttccacctgttgaagggctatctctgtttaattcaccatcttgaaagaaacatttaaaattgagatgttttcaagaatatatagttaaatcctgaggaatcgatgtagaaatgttatcacaagctgtctgaacttactcaggggaagtcttcgtcttcactcacataagagtctaatggaattaatatcaacaatcttagagaaatcccacactattcatgccattttcatgatctccaccttggtaattttttttttttttttttttttgagacagagtctcgctctgtcacccaggctgaagtgcagtggtgcgatctcggctcactgcaacctctgcctcctgggttcaagtgattcttctgcctcagcctcccaagtagctggaactataggcacgtgccaccatgccctgctaattttttgtaattttagtagagatgggtttcaccgtgttagctaggatggtctcaatctcctgatctcgtggtccacccacctcggcttcccaaagtgctgggattgcaggcgtgagccaccacacccggcccaccttgttaatttttaagcactaaaatttgatacttatttgtgaatgaagtaatctcttcattgtatttttttttttttttttacttatgctgagctttaaatgacaaagattcatataatccaagagagaagtattatttagagggattcttttaccatgtgatatataataaatgcatccaatgttatacatcaatttaaaaaacaagtaaataactttaaagaaaagataactactggccaggtgcagtggctcacacctgtattcccagcactttgggaggccgaggcaggtggatcaagaggtcacgagttggagaccagcctggccaagatggtgaaaccctgtttctactaaaaatacaaaaattagccgagtgcggtggcaggcgcctgtaatcccagttactcagtagctgaggcaggagaatcgcttgaacccgggaggcggaggttgcagtgagctgagatcatgccactgcaatctagcctgggtgacagagcaagactttgtctccaaacaaaaagaaaagataattactttatacttagcttgtcttagccatgagtgacgggctgcatgtggcccaggacagttttgaatgcagttcaacacaaatttgtaaactttcttaaaacattaggagattttggccaggtacagtggctcatgcctgtaatcccagcactttgggaggttgaggcgggcagattacctgaggtcaggagttcgagaccaccctggccaacatggcaaaaccccatctccacaaaaaatacaaaaatttgctgagtgcattgtcaggcacctgtactcccagctactcaggaggctgaggcaggagaatcacttgaacctgagaggcagaggttgcagtgagccgagagcacgccactgcactccagcctgggtgacagagtgagaccccatctcaaaaacaaaacaccaaacaaaaacaaaaacaaaaaaaaatggctgggcacggtggctcacacctgtaatcccagtactttcagaggccgaggcaggcagatcgcctgccaggagttcaaggccagactggccaacatggtgaaacctcatctctactaaaaatacaaaaatgagtcgggcatggtggcagagacctgtaatctcagctactcgggaggctgagggaggagaatggcttgagcccaggagctggaggttgcagtgagccgagattgcaccactgcactccagcctgggcgactgagtggagcggaactctgtctccaaaaaaaaaaaaaaagagtttttttttagatcatcagctattgttagtgttagtgtatgttatgtgtggctcaagacaactttgcttcttttaatataggcagggaagtgaaaagattggatatccctgctttataccaagaaagacaacaccccacatttgcaatgcctaaaaacactaccagccatctgaaaaacatgagacttctaacttctgttcttttttgtagcagtggaatcccacggtgatatctgagggatgtggttaccttttggaggaggttgacggtttctaaggatgattctttctgagtgaaatattgtcggtgtcattgaccttttcattctttcaactattattattccaggtcatcaatagtctggctgtctatcgtcatcgtgagactgactttggtgtaggagttcgagaccaccctggccaacatggcaaaaccccatctccacaaaaattggataatttgataattatcattattgggtttctgagacgtgacacatttaccattctcttctgcacaagttacctttgtgtgagtatactaactttctgtagaggtatacttgtaatcacaaataagaataaattatataaaacaattcacgtttctggacttcattatgaatatgtggttttacccaaaaaatcagggaaatgatttattagcataagaattatgaaaatgtctgccatttacattatgaaaattaaataggtcggtgtttgtttaatagaatgtcaacagagcttttggtcaaaaataagtttttttagcctttgtgctatttatcacaaatggagtatgaggtttcgtcacttaaataggaaattctttctaaactcttctgctttatagttctatcgtatgggtggaaggaaagcttccaatctcctctctgaagattcactgcagaaatgagctgacaacagacagcttaacaggaaaagaaaaacatagaacaggcataaacatgggaaccagctgaaaaatgagactgctagaagggccggatggttgatgcttaaagagcaccctcttctgaggggagagggagatagatggagatgtaggccatttagaggggcagcaaatgatttttaggggaaatgaaagaggccaaggaacaaacaattggcctgagacaaagttcctctgaggtcatagggacgaggtgacaaactgccggaaggtgaagggcagaactgcactgcgtctcatgatgcagagaaagccccagagaatctcttagaactgccctccaagagaatcaatgaaaagtgtgtctgggcagggtaattttgaatgacatcattcaaagtgcatgttcccacttgcaactggaaagagatcagtatgtcaaaagtctgtacttggtaagaatttggctgctaagttgtgccataatttgtcttttgagccttttttcctttgggtaagttgagctctacattttgtcttaccattcatgacagtaaaaatgtggttttctgggggctgaacctccttctgaacaatgatccaagataaaagtactaataccacaatgcttttttatattcaagggaagaggaagtatgtttcagttttaccacctagataattacaagtcatttggcactgcctttcaagatatgtagaaaacagaaaatatatgagttatgaagatatctaggcacatttaacattctctatgccacttagtcctgaacagagaatttttggtataaattggaggaagctttttttttttttttttttttcttttctcacccccgaaacgagtctccctctgttgcccaggctggagtataatggtgtgatctcggctcactgcaacctccacctcctggcttcaagcgattcccctgcctcagcctctcaagtagctgggattacaggtgcccaccaccatgcccagcaaatttttgtatttttagtagagtcggggttttaccatgttggccaggctagtctcaaaacccgacctcaaatgatccacccgcctcagcctcccaaagtgctgggattacaagcgtgagccaccacgtgagccaggggaagtttttaaatttaccactttttaacagttccatttaggaaagttcagttgagctgctggacttggacaacttcgcacctctcatctttgtccttgtcatctagtcatctataccattacctcctaagcagggacatcatgggtgccatgaagcattcatgcgtgatggcatttctttgcttctcatttcttcatgtgtttgacatttctcctagctccaaactgggccagctacctttcctatgaaatctagtagtagctgtgggattgacgtggttgctcttttcatctttttagattacccattgcttctctcgaaatcctagtatatgattttttttttttatcctatgtgcagaaatcaggaaaaaacaaattctacaaagaatttgaaagatattatttcaggccaggtgtggtggctcatgcctgtaatcccagcactttgggaggctgaggcaggtggatgacttgaggtcaggagttcaagaccagatgggccaacatggtgaaaccccatctctactaaaaagacaaaaattagccaggcatggtagcaggcacctataatcccagctacttgggaggccgaggcacaagaatcgcttgaatctgggaggtggaggttgccgtgagccaaggtagcgccactgcacttcagcatggttgagagtgacactccatctcaagaaaaaagtcatttcaatgactacctcaggagattcataggtatctgacccacatctgagatgggatttgcattgcattttcgctatgatgagaacaaatatttaatatcttagaagattaaaagcatactgtgataatatggaaatcttggtgggaattcagtcattagtgagaatgttttgcgttaagttcaaaccagcctcaatgaagctgatgtgagggaagggaaagtgaactctgagtagagcagggacagaaggaagatgctccagtgcagatcaggaaggagcagggggtgaaatgttacaaattctagaactcagagagctgaaggtaattacttccttttcaagttgtgaaacatgttaacctgtggtaaaatacttataagatgataattaccatctaaccgtgttgaagtgtacagttcagttgtgtgaagtatattcatgtcattttttttttttttttgagacggagtctcactctgtcaccaggctggagtgcagtggtgggatcttggctcactgcaacctctgcctcctgggttcaagcagttctcctgcctcagcctcccgagtagctgggactacaggcgtgcatcaccatgctcagctaatttttgtatttttagtagagacggggtttcaccatgttgcccaggatggtctccatctcttgaccttgtgattcacccgcctcagcctcccaaagtgctgggattacaggcgtgagctaccgcacctggcctatttttttttttttttttttttttttttttgagacagagtttcaattttgttgcccaggtttggagtgcaatggcacaatctcagctcaccacaaccttttcctgctgggttcaagtgattctcctgcctcagcctcccgactagctgggattacaggcatgcaccaccatgcctggctaattttgtatttttagcagagacagcatttctccatgttggtgaggctggtctcaaactcccgacctcaggtgatccacctgcctcggcctcccaaagtgctgggattacaggagtgagtcaccgtgccagcctcatgtcattcttgtgtgtgtgtgtgtgtgtgtgtgtgtgtgtgtgtgtgtgtgtgacagagtctcattctgtcgctcaggctggagtacagtggtgtgatctcggctcactgcaacctccgcctcccagcttcaaacggttctctgcctcagcctcccgagtagcttggattacaggcgcccgctgccatgcctggctaatttttgtatttttagtagagacagggtttcaccatcttggccaggctggtcttgaactcctgaccccgtgatccacctgcctcggcctcccaaagtactgggattatttatacgcatgagccaccgtgcccagccgtcattcttatattattatttcctaggtgtctttcctgaagactatcttctggtctcgaaatggacatgatggatccacggatgtacagcagagagcctggaggtccaaccgcagtagacagaaaggtatggctctgttggagtccccatagtgtggaaatgagtttgccctggaaagggaaagaacagcttcttgacctcaggtttctcaccttctcctctcctcactctcaccaagggctgaggtccatttgtatgcacacaaagaaaagagtttcttcctttcgaggaaataaaattggcctgaaagacgtcattactctacggaggcatgtggaaacaaaagttagagctaaaatccgtaagaggaaggtgacaacgaaaatcaaccgtcatgacaaaatcaatggaaagaggaagaccgccagaaaacagtaagatgtgccttgacacaaatactgttgtatgaaccatgtgccaatcaaagtagacaactgtaaagtccttgagaatattttctacaatatttgtggcaaattcagtgggctcaaaattgagtttgtcctttctgcttcattagtttaagctgtataattcctttcccttcctacattcttgtttgtaattttttcgggggaagaggagttgctagtactggcattggttttcctttctctcttttttttttttttcctgagatggagctttgctgttgttgcccaggctgtagtgcaatggcacaatctcagctcactgccttttggcttcaagcaattctcctgcctcagcctcccaagtagctgggattacaggtgcccaccaccacgcccagctaatttttgtatttttactagagatggggtttcaccatgttgtccaggctggtctcgaacttctgacctcaggtaatccacctgcctcagcctcccaaagtgctgggattagaggtgtgagccaccacacccagccttttttttttttttttttttaaattttgagatagaatctcgctctgtcgcccaggctggagtgctatggtgcaatcttggctcactgcaacctctgcctcccagtttgaagcaattctgcctcagcttcctgagtagcttggattacaggtgtgtgccaccacattcggccaatttttttttttttttttttgagacagagtctcactctgtcacccaggctagagtgcagtggcatgatcttggctcactgcaacctccgcctcccaggttcaagcgattcttatccctcagcctcttgagtagctgggactacaggcatatgccaccatgcccggataatttttgtattcttagtagaggcggggtttcaccatattggccaagctggtctagaactctggacatcatgatccacatacctcggcctcccaatgtgctgggattacaggcgtgagccaccgtgcccggcccaatttttgtatttttagtagagacaggggttcaccatgttggccaggctagtcttgaactcctgacctcaggtgatctgcctacctcagcctcccagtgtgagccaccgcacccagcctggattgttgaattcaatgcttgggtcacctccagattcattttcacagtctttcatgttttggtcatattacattgtattttgctgccatatgactgatctctttttgttaaatgtgagatacttgttaaaaaatatttagcaatgaattgaggcctagtggcatgttatcttgctgcagaagagatgggagtctacttctgggggatggtcacgggtcctccatacaggctgcaattgaggtcgtcggtgcaggctcagtccctagaaaggccagggtatttcctgtccacctctattctgatgcatgactcttctgggtctcaaccagagccagtggacttcagtacgggtcgctttcattggcagaccctcaatccacttgttttccatctaatcccacgcatgtgtgcaaaagctgctgtgcttctttgcatctcagtagttccttctggaattcagcaatgaaactcagggaaatggattccaaatgcgaggctgactttcgtcctgggtttccttcttctccatcttcacctcatgtctgtttactgccatgttagctatttgatgtattcaatcatgggttttatattctgtttggtgtcccccattgttctcatcggagatcagaagcttcagatgcacttatgtcaactcaagagtagaatgcttccttagcttccctccagagtcaggttttgtgtttctagttcccaagtgcacagcaggagtagtgatgtcctcactggcttctcatttgcattaaactgtgagcttctttagcgtggggacaggaccctgctcccattgcattctcagcaccacaccacacactccttgttggaggccactccagacagcatgtgctgaaggatgccctgtggtcagaaacaagttcattaactttccctttgaagtgttttcgcccctgtttcctagcgttctgggaattttacacatccttcctataaaaccaagtatcaggtgagatccttaggatcaggaccatgaatcaagtggtgtgagggcaacacagcaaacttaccctttttaggccatttcctttttctgccctcaaactctgtgaactgaaccttgttaaagtcagtcaacaccagggtggatggtttgccgttgtcacctattttcaggacataacaccctgacttaggagccattccgatcatttctaattcaatagatgcacccagcattcagattgccttttctctcaaccaggatctttaaagtcgatgacaagagttccagtcctgaatcatggcaaagtgcagtagtgaactgcggggttaatgacaccatattctggaaggatctctctatggctgatggtctcagttctggcatcagcctctgactgagaagcaggtctcacacaggaagagtcagatgaggagcaatcctctgcttccgatggagttagttgtgatgagttggtgaggtctggtttttcacactgaactaaaatgatctttcgctgtgtcaaacacaagactgaccccagacacacacatagtgcacctcatagaagcttttaatagtctttatatttactaaagaataggactaactatggaactatgaagatgagctggaaatgacaggtgacttgccagcaggccagagtgtgattttttttggtccctcaatgggaggtgtccattctcccttcggttgtgagaatcagttggttcatttgtgggaaggttgcaggggggatctttgaatcacagccttcagatgccagaagggcagagggaatcccacatggactggtggatcatgtgtgtgcatttctctcccttctaacctgaggaaactaagcatgaaagaatgtgagcacacagaaaaggagaggcaggtatcagaggcagaggaaaatgggaaattggatatgaaagaaatacacacctacaagtgagttcagaaactgaaccccaccctcctgggaaacgcccattggagtgttgtttataacctctgtacaatgtttagacccagtaaatgcagaaatagaaacaaatggtcagaagacctatcgtgagagagagagagagttcacaaaacagaaaacaaagtacctgaatatttaccagtgaccaaaagatgtgaagtagcaaaacgtctcctgaccccattgccagctagactgtgtggaaactcggttcataccagccattctaggggtggggtgagttgttgtcatccttaggaaagtgtgttgttgtaggatcaaccacatccttcaaaaggactatgcctgtttataagcccagctctttctgccctgtgaaacacggtaaggatattaatacaaagagaatacagctttatgataaaagatgctcaatgaaggatgaattagggatatactgagaatggggaaggaaactatcatctcagaagtcagcaggcagtaagcaagaggaggaatcaatatagcaacagtttggatcagaccgtacagtttttttgtttttgtttttgtttttctgagatggagtctcactgtgtcacccaggctggagtgcaatgacgtgatcttggctcactgcaacctccgcctcccaggttcaagtgattcccctgcctcagcctcccgagtagctgggattacaggtgcctgccaccacgcccggctaatcttttgtatttttagtagagacggggtttcaccgtattagccaggatggtctcaatctcctgacctcgtgatccatccgcctcgccctcccggagtgctgggactacaggcatcagccaccgtgaccggctcagactgtactcttatagccatctgaaatacgttttctaggtagagatagattgtgtaagggtacagttgtgaggataacagaaacatggcagattatttaaaatcatcctgaacatggtgctttatctgatgaaagtgattgtaatccataggaaaatgtttcaacgtgcgcaagagttgcggcggcgggcagaggactaccacaaatgcaaagtaaggagcttcctccccgcagttgcaggatagttcagtgctgatgcagatgatgccacggctcttagactctctcaacattcaatttctcatgtgttggctttttcagatccccccttctgcaagaaagcctctttgcaactgggtaagtttgcttgttttccttgcttttgaacatagtctgccaggtcaggacatggatacatttttctccctacagctctgtgctcaagccctgcagagggagatggcagagaggaaggctgcctacaggcatcacagtcccatccctgttggtaaccgtgttgtgcaaaaacaccttcatccccacccagtggggcccctgatctaatattcaaagtgtcagaggttccatatttgtaatagcaaatgggccctgactgtaaattagtgaagagtgaatgtaacttattacccacagggacaattccaaatgaaggccttaaatgatgctcagctaagctggttcttgtgtggcctctgtaccttcaaaagctgccgagtcctatgattacacgtgatgggacttgtgcacttgaagtgaaacacagttttaaaacttgctttgtttagaattcccacctcatttttccatggacaaaagtattctttatgtcctagtgcacttacaatttggtattacctgggagtgaaaagaaatattacagccatgcctaactgacttcttgaggtaagattgttctgtcagaaaaccctctcccagttcccctgcagctcttcaggaacccacatctctccagagctctttgttctcatgggtggcacctccagagtgaagaagatcctttgtcaagaagggaaacagaggggaaatgagagggtcctgcaggcagagctggaatcaacttccactctgcctcttgcaagctgtgtgaccctgggcacaatttctccttcctctggaaacctctgttttcttagatttggagcagggtggtcacactgaccttgcagagtcctgagaatcagagacagaacataaaaggcctggaaaacattctccaaaaagaagctgcaacatgtgtggacaatgggcttttcatgcctctcttactgtctcttactgtctgttgacctggtgcaagaaacatgctctggtgatggctgtgagggaggaatgaggatagacatagacactcctgtgtctcaaacatgcctctttattactctgttatgactctgtcttccctggggcaggaccccagcctgcctacatttgcagacagacacagtggcatgtggagacaacagtgtgtcccaatgacttttctttactccccagctgtcggcagtactcagtggaagggtgatatcatgacactgatactgctattttgaaacctggaggatggaaaggtgcaaaaatctatcaccagcaacagaaggtgcagactgtgttggtggcggtaattttgtccatcaaatgaatatgtgtgaaaacattccctcctttggccctacaggtcagaatggcggcagcggagcatcgtcattcttcaggattgccctgctggccctacctcacagctgaagctttaaaaaacaggatgggccgccagccacctcctccaactcaacaacattctataactgataactccctgagcctcaagacacctcccgaatgtctccttcatccccttccaccctcagtggatgataatatcaaggagtgtcctcttgctcctcttccaccctcagtggatgataatctgaaggagtatctcctggtccctcttccaccctctcctcttccaccctcagtggatgataatctgaaggactgtctctttgtccctcttccaccctctcctcttccaccctcagtggatgataatctcaagactcctcccttagctactcaggaggccgaggcggaaaaaccacccaaacccaagaggtggagggtggatgaggtggaacaatcaccgaaacccaagaggcggagggcggatgaggtggaacaatcgcccaagcccaagaggcagagggaggccgaggcacaacaattacccaaacccaagaggcggaggttgagtaagctgagaacacgccattgcactcaagcctgggcaataagaataaatccgtgggtcgaaaaaaagaaaaaaatcaaaaaacaaaacaaaacccacgctccaaaaacaaactaacgaagaataaataaataatataaaaataaaataaatactgcagtccttatgttattgctttgtttcaatatctggtatgattgcctgagggacctgaggtttttaattaattgtagggtttttttttaatctttagaagtggttggttatgtaaaatattattatttttttttttttgagactgggttttgctctgtcacccaggctggagtgcagtggctcgatcacagctcactgcagcctcaacctcctgggcttcaagcaatcctcctgcctcagcctcccaagtagctgggatcacagatgtgtgccaccacgcctggccaatgttaaaaaatcctttaacttttttgtagagatgcactcctggactcaagcgatcctcctactggtcccgaccaccagcctctttccgataaacatttacactgtttattatctgatgccatttctatcttcttccttgtcgtccagacatcaaagaattaggtttcttcagggttttctttttcaagtcctcattgttaaagatcactcacattagggccagacaccacgactcatgcctgtaatcccagcactttgggaggccgaggcgggcagagcacttgaggtggggagtttgagaccagcccggccaacttggtgaaaccccacctctactgaaaaacatacaaaaattagctgggcgtgatggtgcatgcctgtagtcccagccacttgggaggctgaggcatgagaatcgcttgaacccaggaggcagaggttgtagtgagccaagatcacatcagcacactctagcctgggtgacagagcaagactctgactcaaaaaataaataaaataaatatcacttacattagatatacccaaggggtggtctatagagagttggaagcagtggttattgcaacagggacacggaagtcatctggctatgccaggatgcccaggggatactcggggtgggtggcatggtgctgctggggactcaccgcacaggacgctctgattgacgcactgccaggagtagcgctctgtcttggggctgcagccggcctcctcagctcgagtgtaacaacagtcgtggccatggcagcacctgcggatgtcacatgggcaggacagcaggtgggtgaagctctctcctggccctcctctgctgccaggaccatgggtgactgaagacccccagggaggcacagcatcctctaagatttttttttttttttttttaatttaagagacagacagggtctttctctgtcgcccaggctggagtgcagaggcacaatcatagctcacggcagccttgaactcctgggctcaagcaatcctcccacttcagtgtcccaagtagctgagactacaggcacacgccagcatgcccggctggttttttaatttgtatttcctttgagacagcgtatctctctgtcgctcaggctggagtgcaatggctcaatcagctcactttagccttgaactcccgggctcaagtgatactgccacctcaacctcccaagtatgctactacaggaacacaaactccttttttaaattttttgtggatatggggtctcactatgttgcctaggctggtctcgaactcccaggctcaagcagtcctcctacctcagcctccccaaatgctgggattacaggtgggagctactgtacgcctggccttatctaagctgtttccctgaaaatgcccgtcttgggtaatgattccattggccccaccatgccctgtcctgccttcctggctgtgcccaagcttggtccctgcctgcctgcctgcctgcctcactctctctctgggtctcgagctcctgtgacacgtgactcctctctcttcctggagtgatccaagccctgccacttcctgactttgcccacactgtaccctctgcctggggcaacttcatgtctgcccattgtcccttaggcctcagcccaggcacaagcccctgcctgcggaggtcatccaggcctcaccaggctacaccctctcgtaaaattggattccctcccttcagggcaggtttataatgaaaccctcctcagaggccagctgcggtgacacccatctgtaatcccagcactttgggaggctgaggtgggaggatcacttgaggccagggggtcgagaccagcctgggcaacataagagagactcttgtctctcctgtctctataacaaatttaaaaattagctccccaggccaggctcagtggctcctgcctgtaatcccaacactttgagaggccgaggcaggtggatcacgaggtcaggagttcgagagcagcctgaccaacatggcgaaaccctgtgtatactaaaaatacaaaattagccaggcatgctggcacgcacctgtaatcccagctactcgggaggctgaggcatgagaatcacttgaacccaggaggtggaggttgcggtgagccaagatcacgccattgcagtccagcctgagcaacagagcaagactctgtctcgagaaaataaaaacacacaaaaaattaactcgccatgatggcacatgcctatagtcctagctacttgggaggctgaggtgggaggattcccttcagcccaggagtttgaggctgcagtgagccactatgattgtgccactgcactctaacctgggcaaaagcgagaccccaggccagagtgcatgattttgggtcactgccacctccacctcccaggttcgagtgattctcctgcctcagcttcttgagtagctgggactacaggcatgtgccaccacgcctgggtaatttttgtatttttagtagagacagggtttagtagagaccatggtgaaaccccgtctctattaaacaaatctctactaaccccatctctacaaaaaacagctgggcatggtagtgcacacctgtaattccagctacttgggaggctgaggcacgagaatcatttgcatcttggaggcagagtttgcagtgagctgagatcgcaccactgcactccagccgggatgacagagcaagaccctgtctcaaaaaaaaaaagaaaaaggaacaaacaacagcaacaacaacaacaaaaaaaacctgtgtcaatcacagccttcgagctaggggagaggcggccgaattctgccctctgctaacgagctatagctttgtggaaatgggtgagtggcgtgcccttgtgagcctcagggccccatctgtaaaatgggcctaactgtcatgcccgtctttaagaacagccttgggggtaaatgagtggaagtcatggaaagatctcagcccacaaccttccacagaacaggcgcttctcacacaggaagtaggaggagtgcagaggctgcaggcatgaatccagccagactgcctgggttcaagtcccagctcccacgtcttggtaactaagtggcctcagacaagttacttagtatttcttttttcttttttttttttttctcagacagagttttgctctgtcacccaggctggagtgcagtggtgtgatctccgctcactgcaacctccgcctcccgggttcaagcaattctgcctcagcttcctgagtagctagaattacaggcacctgtcaccacgcccagctaatttttgtatttttagtagagacggggtttcaccatgttggccaggatggtctcgaactcctgacctcgtgatctgcctgcctcagcctcccgaagtactgggattacaggcgtgagccaccgcacctggacacgttactgaatatttctgtgccttggtttcttcatctgtgaaatgggattgttatgagaacacaacgggattcccagggcagttcctagtgcatagtctggctgcctttgtgtgtgtgtgtgtgtgtgtgtgtgtgtgtgtgtgtttaatatagagacactctatcaccctcctgtctccaccacatctcagatgggaagggagagtgtcctggattagccgcaggccaagcatgggtcatcccttcatctgcatagggcgccagttcacattagccttttatgagccacagaccaaatccttcatccagataaggggtagccaatagaacctcaaaagcagtacttcctgggtgccatggctcgtgcctgtaatcccagcactttgggaggccgaggtgggccgattaacgaggtcaggagttcaagaccagcctgtccaacatggtgaaaccccatctctacaaaaaatatgaaaattagccgggcatggtgggtgcttacctgtaatcccagctacttgggaggctgaggccagagaatcacttgaactcaggaggcggagattgcagtgagccaagatcatgccactgcgctccagcctgggtaagagacttctcaaaaataataataataaaaaaaataaaatacaaaaactaacaaaacacctaggaaactttgtaaccaggctcttgagccgcttgcttaggcccactcccgccctgcagagtgctttatctgtttcataaattcctgctttcactgcttccttcccatgtctcattgctatgctactttgtggattttgttcaattctttgttcaaaatgccaaggacctggacggctcacactcacagccctgcttcccggaacaggcctggctgagttccagctgtgcagtgaagcccaactgtgggaggcgggtgaccctggactccctctcatgatctggacagagatggggtctgggggtacacctggtctcagaccagccccagattcttttgtgacctgaaggcagctggctggtcattggaactggcagagtccctccaacgattggggagggagcctctgaagcaatctttagagtgacatctgggacacagtgaggaaccccctggctgctgaacgaggggtgtctgtgagccaggaccactgggcaccaagggcctgaatccaggctcctctgccccaggactcgtggtatgctgtgactgcagggacaggcaggaccccatccccttctccccaaatgcagtcacaccccagacgggcccacttgcaagggtcctgcgcttcatttatgctctgctgtcctcatcttgaaatttttagcacatgcctgtaatcctaccactttgggaggtcgaggcaggtagatcacctgaggtcaggagttcgagaccagccaggtggagaaaccctgtctctactaaaaatacaaaaattacccagacgtggtggcgggcacctggaatcccacctactcgggaggctgaggcaggagaatcacttgaacccgggaggcagaggttgcagtgagccaagatcgtgccactgcactcccgccggggtaacagagtgagactccatctcaaaaaaaaaaaaaaaattcttagtaacttctgaataagggccccacattatcattctgtaccaggccccacaaatgatgtagccagccctgcacacccgccttgctcaccagttgcccaaagtggctgacctggaaggatccttcatactctgaagcccgcggtgcttatgtcttgggaactgcatcctttactctgaacaaagggcagcgaggtagaagaggctgtagacaggcccagaagaacctcacagtctctatctttcccttccatctggtaggttgggctgcccgagcttcccctgcacagggcgccccgcaggaaacttgtttcagacagagctgtatattctcccagtgaggtgacaaagtcaggaggaaggaaacctcaggtcgggctggagaactctttgctgagcttgttcactgctcctggcatccccactatgcagaggaaaaggggactccccaagcagtgggatcccccgcttcccagcccaggctctgtctgccttggcagaggctgggctggctgagcacctgtgggcagccacgcacctcaggatgttgcgctacagcctgaccctatagaaagccaagtgcaaacgctgctcattaacctccactcccaagaatcaggctgcttggccttgtctctgctgtggccccaccactcgagcccttcctgccaggcttggaacctcgatggccatttagggacagcatctaagccacctttgcaaccttggccttggaatgggctgttgcacagggagctcagcaaatgttcctccaagtgcctcaggtcccgattccctctcatcatccctagaatagcttttccttttgagatgctcaggacaggcagacacaggcctcctgttcccaagaagcagagaaggggacatggggctgcagggccaacacagggagagtcttcctgagtcctcctcctgccagctggtttttgcagctgcggccagccctggaggcaggagacacagcccccgggttctgcggcagcgcctgcccccgttcctccaagacggcgttctgggtgctctgagcaaaactggatgctggcaggaagcagctcagccctggccttcacgggaagggcaggcaccctctcctgacctggggcttcccaggccctcctttggcacgtactgaactgtttgtggaaccatctatgccacctccctcttccctcccaggctgagacaggacagagccgctctttggagctccttgtccctgtgcaaggccagggaagcagagggcaggggaggagctgggaggagctggcaggaccagcgctgcttcggcttcgcagcctccacctccaaaaccagacagagcaggaaaatcagactccaggcctgggagggcaatgagtccaaacgccttccccttcctggctctcacccagaagtcctccaagatgccagagcaagggcttttcatctttactttcctcctgaaacctgagaccccatgaaatcaacaaggagcaagtgagtacttcccggaggaagctttacctctcagctgcttctcagggaatatctaccccaacgctgaactcctgaagatttcagttaaatgcgaccctcagcctgatcccacggagagccccagggtgtgaactgcacatctgagattgtctttgtttttttgagatggagtttcactctgttgctgaggctggagtgcagcggagcaatcttggctcactgcagcctccgcctcccgtgttcaaggattctcctgcctcaccttcctgagtagctgggactccgggcacacaccaccccaacctggctaatttttgtatttttagtagagatggagtttaaccatgttatccaggctggtctcaaactcctgacctcaagtgatccacccacctcggcctcccaaagtgctgggattacaggcatgagccactgctaccagcctgagattgtcctgtcacctataacacctggcccaccctgaaagtcacaaaagtcacatctcccccttctcattccagtctaaggataaacagccgcagcacttctcagagaaatttgcacactggaggatactttccaaagtcctttcacatcgtgtacaggagccctgtgacctaagaagagcaaatgtctttaccccgtttctcagatgagtaaacagaggcccagggagacaaagttaacttgcacaaggccatgaagcattttgccagaagtggggatgtaatcaatccacgcacgattcccaggcatggaatctttccagtaccctagtgctcacccacactctccgccagaacttttttttttttttttttttgagactgtctcgctctgtcgcccaggctggagtgtagtggtgcgatctcggctcactgcaagctccacctcccagattcacgccattctcctgcctcagcctcccgagtagctgggactacaggcacctgcctccacgtccggctaattttttgtatttttagtagagacagggtttcactgtgttagccaggatggtctcgatctcctgacctcgtgatccgcctacctcggcctcccgaaatgctgggattacaggcatgagccactgcacccggccgacctgtttcattctgctttcttcccatctggctactgacctcccctgtcccggtgtcatctgctgtcattcatgatgaccctgctcattagctgccctacctgtgctccatgcactcagctgtggcgatgcaggaggaagtccacctggggagtccactcctgagccaggagtccagagcaagcatctccagcccgcttccaggtgcttggccccgtgatggttcattcatttattctccagacccctactgagcacctgcctcatgcccagccctgagcagacagcagtgagcaggttcccaccctcactctctggtgtagagctgtcctctctggtagcaagtgctgagagaggggcccaaaaccaaccgtacctccaccaggtgatctggccgcgggaagcacaggggtggcatcacctgacttcccagccctccttgaagctgactcttgcctttaaacccatggagctttctttctctttttcttgttctctttttcttttttcattttctttttctttctttctctttttctttttgtcttttttctttgtctttcaagaaattgaggccaggcatggtgactcacacctgtaatcctagcactttgggaggccgaggtgggtggatcacctgaggtcaggagttcaagaccagcctcaccaacatggagaaactccatctctactaaagaaaaaacaacaacaacaaacacaactagcatggtgggagatcacatcattgcactccagcttggatttcagagtgcgactcctcaaaaaaaaaaaaaaaaaaaaaaaaaaaaaagccagccgggcacagtggctcacgcctgtaatcccagcactttgggaggccaaggtgggtggatcacctgaggtcaggaggtcaaaaccagcccgaccaatgtgatgaaaccccatctctactaaaaatacaaaaactagccaggcatggtggcgtgcacctgtagtcccagctactcgggaggctgagacaggagaatcgcttgaacaaggaggcggaggttgcagtgagctgagacggtgctattgcactccagcctgggcagcacgagtgaaactccatctcccaaaaacaaacaaacaaaacaagcaagccacgtgatctgagactcagcctacaagtgctggctttgtcagtcccatgttctgaccagggcctcattgaccattgcattccatgcggggtgaagctagtagagagcggccttgtgcaaaggcagtaaggcctggagctgggtgccctgagtatctgtgatgtcatctaacttcttgaaaccgtgtatcggtcatgaggcaggagagcgagatctcattgctctctcaaggtgttctccatgcggccctggacacatctgttaactgttctgtaagacgcgggtattaatagcacctgctttgtgagatgattttgaggattaaatgagaagaggaggttgggcaccatggctcacacctgtaatcccagcgctttgggaggccgaggtgggtggatcacctgaggtcaggaattcaagaccagcctggccaatatgatgaaagccagtctctactaaaaataacttctttgcccagttaccttctttttttgggggatgggggtggggagacagctcctcactctgtcacccaggtgggagtttaatgacgtgatcactgcaccctcggactcctgggctcaagcaatcctcctacctcattcttccaaagagctgggattacaggcacgagccactgtgcctggcccaatgtctctattttttatttatttatttttttttgagccacagttccgctcttgttgcccaggctagagtgcaatggcgtgatctcagctcaccacaacctccgcctcccaggtttaagtgattctcatgcctcagcctcgccaatagctgggattacaggcatgcgcaaccatgcctggctaatttttgtatttttagtagagacagggtttctccgtgttggtcaggctggtctcgaactcccgacctcaggtgatccacccacctcggactcccaaagtgctggaattacaggcgtgagccaccatacccggcctcagtttctttattcttgtccttccatcgacttggcccctatttttttttttttgagactagtcttgctctgtcacccagcggggagtgcaatggtgagatctcagctcactacaacctccacctcccgggttcaagcgattctcctacctcagtctcctgagtagctgggattacaggcgtgtgccaccacacctgactaattttttgtatttttagtagagacagtgtttcaccgtgttggccaggctaatctcaaacttctgacctcaggtgatccacccacctcggcctcctgaagtgctgggattacaggcatgagccattttctttctgcccagctatttttttttgcattttttggctagacggggtctcaccctgttgcccaggctgatctcaaactcccgtcctcaagcgatcctcttgccttggcctcccaaagtgctggcattacaggcatgagccactgcacctggccttcgctttgaattaaagtggcaggcaggaagaagcatcatctcaaaaattgatggtgacagcggcagcgactacatctagcttgcacaggtggcagcttctgtcccacttcggtggtgccaattgtagcttctgtgccagcagaggctgtggggtcttcacctggccagctttgcccaatgtcctcttcctgatttgattttctgacccttttgagctcctgggaactagccaggacctctgaccaagtccctttctgcttagagttgccagaattagtttctgttggttaaaactaagaaccttgattctcacaaaaataggaccaggactggacagagcaagaagccccaaaggaaacaggagcaattgaaggctggaaagtggccagaggacagtgaaaatccagctggtattaagggacaggacaccagcagccccatggcacgccctggcaagacagctaatcccattgtccccgggaacaaagtatccatcaaaggcaaggctttgggggacctaatggctcctgccatagaagagaataaagattacactgaagtcaagatctgctgggcagggcggtcatgttaacagcgccacatagcttaaatgaaaagacaagctcagaatccaaattcttggctcaaggtatggttagaaaacccgagtgtgcctggccaaaatggcaaaaccccgtctctactaaaaatacagaaattagccaggtgtggtggcaggtgcctgtaatcccaggtacttgggaggctgaggcaggagaatcgcttatatccaggaggcggaggttacagtgagctgagatcacaccactgcactccagcctgggcgacagagtgagactttgtctccaaaaaaaaaaaaaaaaaccaaaactcgaatgtgttattttgcagctgagagagcagaaaaaactgaaaacttgatccaatggttacagaatgaccaaggggacccacaccttaaaaggtctttatttgggaaagagtgaaatgtggagaccagaggctatgaaaattaggctgtgtggaaagatagggaagccttaggtacctagcccctcccctccccaccacccttgccagccaaagcttcctctttgtcactgaagatcctagtagcaggaactcccttgcgggcagttaggtgttctatgtagctgaggtatggcctgcagcgacggctgagtctgtttctacactgctataaagaaacatccaaggttgggtgcggtggctcatgcctgtaatcccagcactttgggaggccgaggtgggcggatcacctgaggcttggagcacgagaccagcctgaccaacataatgaaacaccctctctactaaaaatacaaaactagctgggtgtggtggttcacgcctgtaatcccagctacttgggaggctgaggcaggagaatagcttcaacccgagaggcagaggttgcaaagagccgagatcacgccattgcactccaacctgggcaacaagagcaaatctccatctcaaaaaagcaaacaccgagactgggtaacttataaagaagtttaattgactcacagttccacacggctggggaggcttcaggaaacttacaaccatggaggtaggggaaagcagacaccttctccacaggatagttacgaggatgtaagcacgagaaagaggaactgccacgctttaaaaccatcagatctcgtgagaactcactcactgtcacgagcacagcatgggggaaactgcccccatgatgcaagtacctccacctggtccatccctcaacccgtggggattgtaattcgagatgagatctgggtggggacacaaagcctaaccatatgggtgggacggatggcagttatttccagggtgggctgtagcctcttcctccaacctacatctcctgtttcccaagctggtaacctggatgccctgggtgacctaagaagccatgtgctaaagatgtcaggacctcagtcggccggggttcccccttccccatttcagttgagggaggaagagcctttcaagagcgagagctagccagcagctagcatttccctatgtaacacaccctgtaatgaccctgccccgaaggagtctccttataagccctacccctcattttctccagaattaaatgacaagtcacatccccgcaggccccaggggccaaatctaggagggtactgaatcatcaaaaaactccagggggaagatactgaatcaccaaaagaaactaaagattttgctaattgatattggcttactcacagtacatggttggctaaaaaatttttttaattgatattggcaaaaatctgggaaggtgatctgagaatgaattctgagggtgcaggatgggtgagggaggaaggggatgctagatagggatgaatgtaccgatattgaggattccacagggacagcttgagaagctgggattataggcgtgagccacagcgataatgtagtactttcagtgctgaaatcaggatagtgccaggcaaactcggacaattggtcaacctagctgttaagtaactaacttgctctaaatcacagttattaagtggcagggcctgtattcaaatgcaggtgggctgacttcagattcaaattgtttgcttttgccagtggttctcaatcttgagcatgcaaacctggaggccttgttaaaattcagatagccccatcttcagggtctccaattcagtaggttggggccgccgagaatttgcctaaccagctccctggtgatgctgaggctgctggactgggaagactgggaaccaactgagaagacctttgtatttggctttctcacctccagataagggctttttaacttttattttgtgagacaaggtctcaatctctcactcacgctgaaatacagcttatgatcatggttcactgcaacctcaaactcttgggctcaagcaatcccctgcctcagcaatatgaataaacatattggaggccaggtgtgagactccacctcaaaaaaaaaaagtaaaggaatagggctgggcgcggtggctcacgcatataatcccagcactttgggaggccaaggcaggcagatcatctgaggacaggagttcgagaccaccctggccatcgtggtgaaaccccgtctctattaaaagtacaaaaaaaaaaaaagccggcatggtgggggcacctgtagtcccagccactcgaaagctgaggcaggagaatcgcttgaacccaggagacggagattgcagtgagccgagatcacgccactgcactccagcctgagcaagagcaagactccctctcaaaaaaaaaaaaaaagtaaagaaataaaacaatggctactccatagagcagccccgagggctgctggttgctcatttttatggttatttattgattatatgctaaagaaggggtggattattcatgcctcccctttttagaccatatagggtaacattctggcgttgccatggcatttgtaagctgtcttggcgctggtgggagtgtagcagtgaggacgaccagaggtcattcgcatcaccatcttggttttggtgggttttggccgcggcttctttactgcttgtgccggcctctcatctcatcctgtgacttagaatgcctccaccacctgggaacacagcccagtaggtctcagcctgattttacccagcgcctactcaagatggagttgctctggttcaaaggcctctaacagaagctaaacacaggtgggggctttcaaagaagcagatccaatgcccactgcccttcctcactcccctaatagatgtagggcaccatggacttttacagactgagggacatactctggatgagaatagtttaccctatcaaggaaaagtaagttccccagatgaaacgccacagataacaggcatattgtaagtcaggctttgtacgttttccaaaactcactacagggatcccctttgaggtgcagaatcttgtatcacaataatcacgattccttggccaaggccttttgatgtcatggtccgtgtttttctccggatcgttgggcatgcggaggcagaaggagagcctggcagagtgaatgacaaacgcaagggaggctgcagaggggagggagtgagggcggcccagggcccagcccggcgggagccgaggaagagaaggaccagccagccaagggcgggcggctccagaggaggcccgggactccccagtttcccagcctcttccaccccacgcggatccctgccccgacgctgattcagggggtcaaagcctcgggcggggcggaccgcggcggtgactggaggcgccccagtttctctgggtgtggcctgcggaccccctcgggagcaggtcgtcccgcaccagtgtctgcccccggcccccagggacacctgcacccgccccactcacgacggcgcgtcaggtccccaaccaggcgtggggcggggtgggaaggtctcggttcggccgccccgcctgtgctgtccccaccgccccccggcctcgggcagcgcgctcccgggtcacccacctcccgcgggcacgcgcagggcggcccctccgggcgctgcggccgcggccccggccaaggggcgggtcccgggtctgggaggaagaggcgcggctgctggctgacccgggaaccagaccgagccggagagcgggccctcccgtctcccaccgggcaggaaggcctggcgctcgcaggcgaccttgcgccagtgcccgggcagggatcagggggctcagcgccttcgcgggaggtagagagagctgggggcatctgtgtgaccaccccgcgtaggtccgcgctgagccaggacacaggacaactgcccgcgcctggttagacaggcgaagccctgggaagcagtgggagagggaaagactgggccggcgcggggccgcatgcctgtaaccccagcactttgggaggcccaggatggcggatcgcttgagcacgggagttcgagaccagcctgagcaacatggtgcaaccccgtccctacaaaaaacacaaaaaatagcggggcgtggtggtgcggacctgtggttccagctacttgggtggctgaggcaggaggatcgcttgagcctgggagttcgaggctgcagtgaaccccagttgcacccctgcactccagcctgtacgacaaagcgagactctgtctcaaaaaagaaaaaaatagggccgggcgcggtggctcacgcctgtcatcccagcactttgggaggccgaggcgggtggatcacgaggtcgggagatcgataccatcctgggtaacacggtgaaaccccgtctctactaaaaatacaaaaaacaaattagccgggcgtggtggcgggcgtctgtagtcccagctactcgggaggctgaggcaggacaatggcgtgaacctgggaggcggagcttgcagtgagccgagatcgtgccactgcactccagcctgggcgacagagcgagactccgtctcaaaaaaaaaaagaaaagaaaagaaaaaaaataaataaatgacagccagactcactgggtttgactcccagctgtatgatcttatgcaagttactcaatctctctgccttcatttcttccgctgtaaactgggacagtgataaccccttgtgggtgatgtctgaggagctgggtgagggagcgggactgcacaggctctgactaccattggccctggtgcgatgacactccgccggtgggggcaacacacacgcgtcgtctcccagacattcagagcaacttctattaataccctgcctgcctgggccccagccatgagaactgcccctcactgaggcagagtctggtcttcctcttcttggggagacccagaacttccagagagtgtcctggaccatgaaggtgaccaggaaagggaataggtgggtggaggccgctgcagtgaagcctcaggccccctctggtctctccagggtcatcctggatcatctgaatttccctttgaaatgagcatgcacaggttcagctgattcataatttaataccccgtggggttcatgccacagggaagctccgctgccccacagggtctgggccaggtggaagagagcagcctttttggaccactggcggtgtcctctccttcgccatctaattgaagcccatcttcccaatcaaaagcaggcgaagggccccagcttcttctaacactcactccctggccctcactggcctccctgcctctctctgcccaacttctggcattgtgcaaggtctgagacctctttggacatgaggcatgtggtcttaacctggcccttgttccagacaggtgggcagacaggtaagcagagccggtgctcccagggcaggcgagggagccatgtggtcaggcctcaggaccctgggccccaccgggagatgtgctcctgggctggaaggaagcagaagagagcagggctcgatggcagcccaggcagtcccaagatggcagccctgttgcactcggtctggaagtgcccatggccgtggtccctgtggcgctccaggccttcctagcagaggctgctgggagctggtgccatgctaggtttcacctccgcctccaccacagttcatggggctcccgggaacaccaaggaacccaacaggttcccaggaagcagctttcatgacaggagagggtccttggagaaatcccctgcagagctgtagctctagtccttcctgcgtggccttgctgtatgaagctgggcccgtcattgcccctctgggctcaggagcccacaggtacaaggccatcaacagggcatcctctatggccccgtgtgcccagacccactctgaacctgccacctagatacccttgcaggctggaccgggtcagcagcactcccagggtcagggatcagagaaggggagcctcaggaagtccctcaccaaactggcagatgtaacggtttcgggttttgcagcgctggtcgttccagttgaaggcagctgaagcctgcagctccacgcagttgccaaacctgcaggccagggtgtggtggtcaggaggcaagagtgaagtcagggatccgggagaggcctaagccctccacccatcaggaccctgcatctcaggggctccagtgcccccacctgccgacggggctgctgggagccaggcccgtccccaagcccccagccctgctccacttctcagggaagccccttcctgggttaacagctctgcctaccccatggcagcactcagccacaccagcctgtggggatggtggggattggaatagacagcccacttgagaggtacacctgggaacccaacaaggcccagacttcctccaggcaagaggccaggggcacaggccggctgttggcaaggagggctggctgaaatcgctggagcccttggtggcctcgcagccggaccacctccaccctggccctgggcattgctgggctttgaagagcagggtggggccacgtgaccagagggttcttgctacaggatggctggtgggtctgcaggtgcagggttgtattgtgaatgagtgcaggtgggtgacagctaaggaatgctggcatcagtgtaactgatgcaggcagagggcatgcagagggaggggtgagtggatgagaattggagggatggagtcacagccaggggacactggggatggacagatggatggaggcttcctgggtccctctctcccccacgtgacgtgccttccggcttgcatctccctcaccccaccaccggcccacaccagctgtgcccacaactctctggcacctgggcaggcaccagggaaggatcagaccctcaaagggcccagccaggcagcgggatgggggggctccaccaggcaggcccaagtgagaaggaggcccaggggagggaggcaccccacacttacccgtggttgtcaggctgcccaaaggcaaaactggtgaaggcctggtgctcccctgtggcccagcggaaggagtccttggcggtcttgtaggtgagccctgggccggggtagtcaaggttggcccactcagaccctggagtctgctgccagctgcctttctggcccctcttcccagcgctggcagcccccatgtgctccctacctgggccctccccgggaaagggggtgagcagctggccccgctctgggctccaggccctcaacacacccttgccatctgctggcagccgccatggcccagggttcctgcagcagggtggggcatcacaaccccttactcgccatacccccaatcagctgggcactcaccgatccagaagttcctggtctcgaagtcactgtcaatcacctcgttggtggtctccaggcggcccagatagaaggcgaggatgtcctgcactttctggctcttgatctgggccagcaccccgcctttcctctgtaaccccaccctgggtcacacaggcaagtctcccagagcccaggctgccccttcctgccacccctgcccatggcctaagatgccacgtgtgtgtgctggccgggctatcatcacccccagcccgcacagcctcccttccaagagcaggggtcccttctgctcccgtctgcttctcttctccctgtgcacaggggcgcgaccagcagcccacaagcccaggcaaggtctggcccctgaggaggttctgtttcacctgcacagtgtcttaaatatatccgagttgattgccaaccccagtaattaattgtggtttcgagagttgccagtggaagtctgggttgctggttttcttgaacaaccccgagctctggccaccctgaccttgcattcctgcaaggcaaccagtggctggaactcccttagatggaggttggtcttgaccttggcccctcaggtcaataagtgacctcctggcttctatgagccttggagtccacgacccctgctttatgctgatgaatagggtgaggtcagagacgttgaaggaaccacctctcactccagggtccctgcattaagaccctcacttgaggccctagggggttcctaggaagctaggggtgactgtcacctgacatttcatcctggctctgtaataggtgtctgcctctgaagacaccatgaagcagtctccgtcgatcctcaggtcacaggtgtggaagggaaaatgcaccttggctggggtaggggagcctgagtttgtgtgtggacttcagaatccctgccctttcctgccctgccggggagctaagctcagggtgccccttcctctggccacctgctccaaaagagtgggtggtgagggtcaggagtgagctggtcagttggaatattgagcttgctctctctcaaaagaaaaaaaaaatccatggtttatagcatttgccaatttctttggtgtaaatatccatgctgtggccagtttcaagatctcaacgtgttgtcactgaatgagttggaaagagaggcacacagcgggctcctgggagctgatgccccattgaaggggggtcttgagaggagctggctctttgggggccctggggcaggactcactggcacactgggctcccccgtagccgatgtcacagacgcacgagcactcctcctcccggaaccggccgtgcacacactgcaggctgcacctcactgccagggcagggcagtggggcagaggctcagcccccagccttctggaccccacgctgccccccagaggcctcgaacatccagggaatgccaaccacagcaagaatacccctcccagagacagaacccaccaaggcttccgattgctggcacgcctggtgtctttggtttggtccccattgcagagtgaggcatattggagtttgggaggtgacctgcccatggtcacagagtgggttagggtagaggggcagtagggcaagaatccacttctgggtcctaattctgtcctcctcccagagcctaaggggctgaacctgatttcactttgaatctcctgcacagctcagggtccggcaaacagctagtgctcagtgaatgcttgttgaaagaatgtatgcagtgggcagactcagggagtacacagtcagcacctctgacacccttgagactctcaggaagtgtagcagccctaggacctgccacgagagcagggctgggcacacccaggctccagtgccctcaccttggcagtatctgcccgtgtagccagggggacagtggcagtggcaggtgctgatgttgagacgtccatggttctggcagctcatgcgacaaggattcctggggacctctggtcagaggaggaggggactctgagaaaagggtcgcctcccagcaggccgggcaggacctccctgggtgctaagggccagggcttctgggacagcccagtaggatgctaccacccccaccccagggtcaccagactgagccctcatgcactcaccacagagcccccctgcatggtcccaggctttgaagcagcctgagacactggctgtgcagagcgaacaccaggcacccttcttataggggatgattgtcttcccgttgacctcccagttgcctctgtgaggacgagcaggcaccacagggtgtgggagggcctggccttgggcaaggcagtggcagggccctgctgcctacctccctggccccttcagctcctgcggccaggccagggagtcagggagctgggtgagatagggagattccctgggagagaagagatggcctccaaaccaatcctggacaaactccctgataccaggaccagtatccaggaagggacatccgcagagcagcaccttctgcgtggccagaatctttagcaccctctgcctttcctctcctcccctctcccaccaagggtgcagagcaaggcatcagggactctactttcgggtggatgtgtgggaatctcaccctcggtgaaagcacccctccctgtctcccagacatcccagcagaaggtgtagcagggcttacccgggggagtaggcacagacaaaggcttctatcgctgtctggcctgcagagcacaggtgccgcccacagcccagctggcttgaggtggcccacacgagctacaggagacacaggggatcagaaaccctattgtgaaccacccctggggagggggacacagctttcgctatcatccaggcgaacagagggctcccttacctcttcgagggctcaggagcagcagctgtcctgggcaggggtagaagcatgggtgggaatagttcaggaaggcttatttatttatttatttatttatttatttatttatttttgagatggagttttgctcttgttgcccaggctggagtgcaatggcctgatcttggctcaccacaacctctacctcctgggttcatgtgattctcctgcctcagcctcccgagtagctaggattacaggcgactgccaccatgcccggttaatttttttgtatttttagtagagacagggcttctccatgttggtcaggctggtcttgaactcccgacctcaggtgaactgcttgcctcggcctcccaaagtgctgggattataggtgtgagccaccgtgcccagcctaggaaggctttcttagttgagagggggatggagaggggaggtacctgaaatgaggggagattgttgatgggtggaggggagtagccaaaaaaagactggaacgtcaagggccttgtgactgcatggtgaccacaaccattcatttcttgcagtaggccactcctttaaatgtgactctgcagctttttgcagcaaagagaggtgtctctttccttgctccttgaatctggctggctctgtaactggtttggccaccagaatgccacagaagtgatactgagccgattttgaacctaggccttaagagaccttgccatttccactcattctcatagaaccatgctcagtcaccacatgaacaaactcagtataggagtttggaaggcctcatggaacagagatgaaccattagaggcctttttgcacagccagctcccagccggccccctagttgattgcaggtgtatgagtgggcccagccaagaccagaaaacctccctgctgagcccaacccaagtggctgacctgcagaatcgtaagctgctaaattttggggtagtatgtcatgcaataaaacctaatggatacaggtctgcaaaccagtttaaagtcttagaatcagcaacagcttggaaatagcacaaatgggcaatatataagaagagtgaaacaaactctccagtagagactaaaaatgacatgtacaagactggcttgtagcaggcagatgtgaacatgtgatcatatacatgtatccaacacttaaagaatatgtatcatttttaggaatgcatgggacttttgcaaaccagaaaggaggaccatacattagaccactaagcaagtttcaacaaatagcaaagaatcagcacatcctacagcccacattctatgaattcaatgcaatgaaatttaaagtaaataatttacaagtaaatagagaagataacatagtttagaaacttaaagatacacttcaaaatctaaaacaacatcatggccaggtgtggtggttcacatctgtaatcccagcactttgggaggctgagttgggtggatcatgtgagttcagaagttcaagatcagcctggccaacatggcaaaaccccatctctattacaaatacaaaaaattagccaggcatggtggcacacacctgtagtcccagctactccggacctgaggtgagaagatcacctgagcccaggaaattgaggctgcagtgagctgagattgcaccactgcactccagcctgggcgacagagccagaccatgtctcaaaacaaacaaaaacaacatcatgattggaaatagaaaaaacatcaaaacttattggatgcagctgaaatcgtttaaagggaaatttatagctttaaatgtatatagtagaaacaaaaaaagatttaaaattaatgatctaaacattcacatcaagaaaattagaaacaataatagaggctgggcgtggtggctcaagcctgtaatcccaacagtttgggaggccgaggcaggtggattacctgacgtccggagtactaaaaatacaaaaattagccaggtgtggtggcaggcgcctgtaatcccagctactcaggaggctgacgcaggagaatctcttgaactggggaggcggaggttgtagtgagctgtgatcgcaccactgcactctggcctgggcaacagagcaagactctgaatcgaaaaaacaaaaacaaaaacaaaacaaacaaaaaacaaccaccaacaacaaaacagagttaggtttttcacacctttgagtctgacaaaacttaaggagccaaggctgggcacagtggctcacgcctgtaatcccagcactctgggaggccgaggcaggcggatcatgaggtcaggagatcaagaccaccctggctaatacggtgaaaccctgtctctactaaacaaaatacaaaaaaatagccgggtgtggtggcgtgtgcctgcagtcccagctactagggaggctgaggcaggagaatggtgtgaacccaggaggcggagcttgcagtgagccgagatcgcaccactgcacagcagcctgcgcgacagagcgagactccgtctcaaaaaaaaaaaaaaaattaaggagccagaagatcttcgggaagtgggaactggtttgctggtctgcacagttggcgtaagcactttggcagcacctagttgtaggggcacatgttcttctttttactgagccagggttttactcctgctgcccaggctggagtgcaatggcgcagtctcagctcactgcaatcttcacctcccaggctccagcaattctcctacctcagcctcccaagtagctggaactacaggcgcacaccatcacacctgggtaatttatgtatttttttgtagaggcaggttttttccatgtggcccaggctggtctcgaactcccgggctcaggcaatcctgccaccttggcctcccaaagtgctgggattacgggcgtgagccaccgcacccagccttgtgtaatatttaaacatgcacaacccacttgcacaggtagtggaggtattaaatatttcctgggattttgcttgtgtttttcagtgcatctgaagagcaccaggtgtgtgtagaagaccctcaacaaatatttgttgaatgaagagaaaaaatggaaacttgcttggcagtgatgctcctgaactttgggaagattccctccagggagggacagcgggaaaaggggaggagcagggctttagtttagtagcatcttctaaacctaggtagtgggtaagagtggggccgttttaaatttatgtttgaggctgggtgcggtgtctcacacgtgtaatcccagcactttgggaggcccacgcaggtggatcacttgaggtcaggagtttgagacccagcctggccaacatggtgaaaccctatctctactaaaaatacaaaaattagtggggtgtggtggctcgtgcctgtagtcccagctacttgggaggctgaggcaggacagtcacctgaatctgggaggcagaggttctagtgaaccgagatcaagccattgcactccatcctgggtgacagaacaagacttcgtctcaaataaataaataaatacgtttatgtttgaaattatttatatttcagattgaaaaaaagtggcttaggccaggcatggtggctcacgcctgtaaccccagcactttgggaggctgaggcaggcagatcatttgaggtcaggagttcgagaccagcctggccaacatggtgaaaccctgtctctactaaaaatacaaaaaaatgagctgggtgtagaggcgcacacctgtaatcccagctacttgtgaggctgaggcacaagaatcgcttgaatctaggagacggaggttgcagtaagctgagatcacgccactgcactccagcctggggtgacagactgagaccatgtctccaaaaaaagaaaaaatgtggcggggcacagtggctcacgcctgtaatcccagcactttgggaggctgaggtgggtggatcacttgaggccaggagttcaagaccaacctggccaacatggtaaaaccctatctctactaaaagtataaagccattagccaggcctggtggcacatgcctgtagtcccagctagtcaggaggctgaagtacaagaatcacttgagcccaggaggcggaggttgcagtgagccgagatcacgccactgcactctagcctgcgcaacacagcaagactccgtatcaaaaaaaaaaaaagtaaaactaaaccaattggaggaaaaggaatcccaacatttaggacaaactgtagcctcttctgagatggcccagtggaagtctgtatctgggagctggcacgctggcctcacctgcagcacactcacctgcgtgtagtgggtgcaggtggcgttgcgagcacactctcctgccgcgtggctgtaccgctgcccctctgcaaaccacaggctgaccacttcaacaaaggacgccaagcccgcgggcagcagctgcatgttccagcccacttgcagggtgcgccacaggccggacgccaggctcggggttgggattccacagagggctgccctggcttgagccagttgggccaggctgtcactccagtcctgggggcagcacaaacagacatctgtgggaggcctttgactgctgggccaggcctcaaagattcaactcccctgccatctctgagcatccaccgggtgccaggtcaggtggcaaagagagcactggatgaggagtcctgctggaggaagcactggtgttgtctgatgtccctccaggaggagcccagctcctctcacgactgagcctccatctccaaatcctgtcgtgggcatccttcggccctgcccaggcagtgggacccgctcctgctgtctttctcccatctggtcatgtgagcagtgcccacgcgttgcagactggttctgtgtttgggccctggccattgtcagaaaggctccactgctcccacccggccatgctgccctcctgtgatgcaaaaagccctacagccacacctctctgccctagtctcctgcccccaggagcctggcctcatatgctccccaccacgcacagctgaccccgccccctccctcttcttttttttttttgagacagagtctcaccctgtcgcccaggctggagtgcagtggagaaatcccggcttactgcaacctccgcctcccaggttcaagcaattctcctgcctcagcctcccaagcagctgggattacagccatgtgacaccacacctggctaatttttgtatttttagtagagacggggtttcaccatgttggccattgctggtgtcaaactgctgaccttaggtgatctgcttgtgtcagcctcccagagtgctgggattacaggtgtgagccaccgtgcccagccccctccctcttcttaaacaaggggcctggcaatcaccacccctgggtgacttggtgcagtcccctgatctcccgagactccctgagctcatctgtaaacggagcagggaggtgcctgcaggataggactcacaagcacagagtggatgcagggaggggggcccctcggggctgcaccccaagccaacttcatcctgcactaatgtccatcggggttttacctctgatgaaggctggggccaggagctgggggctccccggggtccctcagcagccctccacccccacaagaccttcagtctccactgtgtccaaagaaggggtgccctggagccctagaggcccggagggtgctcggggccgggccacgagggaggctgagccatggagctccatttgcacctttatggaaatgaagttttctaagactttgacaaaagggccctggaaagggtgccagctgccagccaacgaccaccgcagcccctcctggggtcccaggcaggagtacccaaccacggaggtcacagctgggagcacccctggttgcccagggtctgagcctgaggagaggcagagccactcagggctgggaatgggggagaagcgaccccccgcatttagccaccccacccccacctcctgggaaactgaccctagagtgttcaaggtcgccactgtggccacctgccttggaggagttcatgggaagcagccatggggaaccctcccgcccccaccaccctgccctggctccctggcctgctaacatgggctggggctgctggggtcccagacaatggagggcagcgtttctgagcctccagatgacagtcccaaccccgcagccccagccgggctggtggggaactctatacccccgacccctggcccctgctgaaaatgtggaaaatgtggacgagtgagtgagcagagaacatgggcaaggcccgtcctagtggctcagataagctcaggaggaggcgctgggtccttgccgcacagaagcccctccccagcccagcacgaccttctccctccctggcccggccgcccatcctgcagggctcctcgtgaagctccccttccctggaggaggggatccggctcctcctgtggctcctggtctctgtggcaacaagatgccagggaaggcccaaggtcctgcccttcaggcgagtgggagccaaggggcccgacctcctgaactgagggtggggggttaagaaactgcagagacccccagcaaccagggcctccgtccctcaggggcaaggtggctggctgtgcctgcccaccctggtcaagtggaagggcacctggacaggcgtggcctcctgagccgccctctggggtccgcgcctccggccacccccctggcagagcccagctgggtcgggtactcaccagcctccgcatgtcagccgcagggggctggacccagctgcgcaggcggttgtgcagggagaggagcaagaaactctccttcctgttcagggctggggtggggagagaaggtcaggcagcccgaggatggggggacctgaacccaacacacggcagaataagcatgtgtccctgcccttggaaaacaagatgggagaggagtgtggtgggtgcaggggacgtggggcatagcaatggagcgaggctgagagagagaccaggtacagcaggcgtgggctgagtgctggggttggggtggcgggagggaacagcggtgcgggctgggtgtaggggccagccctggctcccgcaggcccctgtctggggctcctccgggccacggatttctccaggccccagccacagcgctcctcggcgttcctccttgaccccagccctggtcctccttcctcctccttcctcctccttcctccccagtccagcatccacccctcaccgcccccgggctgtcccagggcttcctcattaaaccacccgcacggcctggggctcaggcctgggaccgggcttccagaagtctcctagcacccactcctcagagctcataatggtgcctccacctacctcctcaccaggtgtcccttacctccggccatcggagcctgctcctgcagctggggtggccacacctctgcccaggtggtgccaaggagggccaggagcacagccaggagatgcccccggccaggggaggtctctggatgcagcatgggtctgttgggcccgtcaggcgctccgtgcacagcctggctcagccacccggcttgtttctcaggctggatggagctattcacaatctccaggagtcaggctgggctggtggacaaaagaggggggctggtgaacaaaagaaggaggctggtgagtgagtaatcagtgtgtccagacagcctcctgttggcgctggcatgaaaagagacaactcccggggatgcctgcctgctccggcctcggcctggccagcccgcccccgacagcaggcagagtggcgtgcactgccccgcggcccctgctaatcattgtgggattattagcacccttggggagcccccagagaccccgctgattggcctggggacattccggtgctgcagattagtgaccgatggccgtgtcctggctgggacagtgtcctccgagcccactgatggcttccgctccccagccccgggccctgggaggaggacctcggctatggtccttctggtgagcaggaactgggcaagaccccaggggagttctttcctttcttgggaagctcgtcccaaccccccagccatgaattaaacataggcaagaggtaaccgcacaccagaggggtgcaatctgtgggctcaaaggggggtgggctgaggccgcacctgcacgaggaaaagggtgccttaggaaagtctgtctgggcagggtcgggggctgggcccagccccggtgcccaccaccctcacccacgtgactacaggccagggggggagtgaggcaggaggagtcaaagcaggcggggaccagagcacgtgatgccctgggctgactccagtcctgctgggatcacgtccgcctctagaaaaacaggcggcgtagcaggtgggcagcacgttgccatgatgtgccgtggcccggccgtggctggcgtgatcccaccagagtgagctggagcagatctgcaccatgggccaagtttctcagaaaatacatggcttcctgcgggctgcagcctaatgcccacgttcctctcggggcagaccgaaggttattcaaccagggcaaaggacagccttgcaaaccaactacgtcctccttctggagtttgtgtgacccctggcccctgagcccacaccctctcggagcggggttccaactccgtggaagctctgctgagatgcaggtagggttggctttcctggggaaacaccagtggaatgtggctatcgtcatgggtgccagggatggggatgaggccaggcatacaggccatgaaggcggtctggaactgcatgtcccccacaatacctaggggctcaggagtttcttctccctcaaacagaaacccagcaccctcagggtcactgcgtgtgggtcctagcaatgcttaatagctacctgttttttgatgtatttttatttttattttttagacagtttcattctgccactcaggttggagtgttataatctcagctcactgcagccttgacctcttgggcccaagtgatccttccacctcagcctcccaagtagctgggaccaggtgtgtgccaccatgcctggctaattattattattttttttggtagagacaggatttcatcgtcttgcccaggctggtctccaactcctgggctcaagggatcttcccaccttggcctcccaaagtgctggggttgcaggcatgagccaccacacctggccgagccacctgtgtttatggagctcacaaagcctgtttgcatgtgtgagttcaagttattgccacaagaacctggtgcagtagcagatgggatgcccgtcgtgtagatgaggaaacgggcttagtgtgtctaaggggcttgtccaaggtcactcagcgagtgcatggagcatcccagctaatccaaggtctctgccttcccattcccaacgctttaattcacatcctgatctttcccagtgcagtttccacagctctgctatgccgggtgataaaagacccacttcctacaattgggcttccatggcaaacacggccagttgacccatatagtatgatgccaggcacttgggacaggcgggagaaaaagatattttggggattagggtggagcaacttttgaagggtcccatggccctggctcactgcaagaagagtcccaggccgggtgtgatggctcatgcctgtaatcccagaactctgggaggccaaggcaggcggatcacttgaggtcaggagcttgagaccagcctggccaacatggtgaaatcctgtctctactaaaaatacaaaaattagctgggcagggtggtgggtgcctgtagtcccagctactcggtaggctgaggcaggagaattgcttgaatctgggaggcggaggttgcagtgaagcaagatggcaccattgcactccatcctgggcaacagagcgagactctgtcccacccccgacccctcaaaaaaaaaaaaaaagagtcccaggagagcaaggttcatgggccagaagagaagctgagtggataaaagattaatgagacactggaagacctaggctggaaccgacacgctgtgtgaccctgaggatggcactcccactcctgaagctcagtatccaatggcgtagagctgggatgacccctctgctgggcccctaaccagggcattgcaacttggtttccatggtactccctcctgggttcagactttttagtggagcctgctcggtggctggggtgggtttggagaatgggcagcctcattcttgcaaggcagctttccccaggtgaggctactacagggtttacatccaccacccagactgtaggattcacattttgctatattttctttatcacctgtgtctctatctatcccacccctctccagctcatgcatagctgatacctcttctcccagtctgcatttgaaggttatagcgttcgagtcattttgtctcttcctgaagcagctcctttcttcaaagccttgaaatcttgttgatggtctcaaaaaaaaaaaacaaaaaaaaaacaaaaagaaaaccatttaactctaggagagttgtggccacattttcttttaaaaattacatgtccaggacaggcgtagtagctcactcacacctataatcccagcactttgggaggccaagctgggtggactgcttgatctcaggagtttgagaccagcctgggcagcatggtgaaaccccgtctctaaaaaaaatacaaaaaattagctgggcgtggtagcacgtgtccatagtcccacctacctgggaggctgaggtgggaggatagcctgagccagggatgtcaaggctgcagtgagctgtaatcgtgccactacacactagcctgggtaacagaccaagattctgtctcaagaaaaaaaaaattaggccaggtgcagtggctcatgcctgtagtaccagcactttgggaggccgaggtgggcggatcacctgaggtcaggagtttgagaccagcctggccaacatggcaaaatcccgtctctactaaaaatacaaaaattagctgggtatggtggaacacacctgtaatcccagctacttgggaggctgaggcatgagaatcacttgagcccaggagacagaggttgcagtgagctgagatcacaccactgcactccagcctgggcaacagaatgagactctgtctaaaaaaaaaaatcatgtctatttgatttttaaatttttcttgagacgaagtctggctctgttgcccagctggaatgcagtggcacaattttggttcactgtgacctctgcttctggggctttgacctccacatcccaggctcaagccatcctcctacctcaagctcctgagtagctggactgtgggtgtgcgccaccatgccaggtaatttttgtatttttagtagagatggggcttcaccatgttgcccaggctggtctcaaagctcaagtcatctgctgggattataggcgtgagccaccacaaccagccccatattagtatgttgaagccctacctccattacctccgtgtcactgtatttagagatagggtctttaaagaggtaattaaagttaaatgaggtcactggggtgggtcctgatccagtctgactggcctcgttataagaagagacacacagagggaagatcctgtgaagacacagggagaaggcggctgtagacaagccaaggaaagaggtcctcagagggaaccaaccccccggcaccttgatcctggcctttatgcctccagaactctgagaaaatacattctgttttttaagccacccagtgtgtggtaccttgtatggcagtcctagcaaacgaatacagcccttacgcaaaacgtacagctaatatcacacttaacagtgagaccaaagactttcctccctaagatcaaaacaaggcaaggatgtcttttgtcaccggtcccactaaacattgtactattgaatgcgcaatttgtgcaataagttaagaaaaagacattaaaggcatccacactgaaaagaaagaagtaaaactatcttcatttgcagatgacataattctactgtagaaaatccgaaggaatgtgtaaaaaaaaaaaaaaaccctactagaataaaggtctcagaatacaaaattaacataccaaaatccactgcatttctacacattggcaataaacaatccgaaaatgaaattgaggaaacagttccacacatggccaggcacggtggctgacatctgtaatcccagcactttccgagaccgaggcagatggattgcttgaggtcaggagttcaagaccagcctggccaacatggtgaaacctcatctctactaaaaatacaaaaaattagccaggcgtggtggtgggcaactgtaatcccagctactctactcaggaggctgaggcagaagaattgcttgaacccgggaggcggaggttacagtgagccgagattgcgccactgcactccagactaggcgacagagtgactcattctcaaaaaaaaaaaaaaaaaaaaaaatccatacacataaaactgtaaaacaacattgctgagagaaactaaagatctaaaaaaatgcatagacatttcacattcatccaggctggactgcagtggcgtgatctcttcctactgcaacctctgcctcctgggttcaagtgattctcctgcctcaacctcccgtgtagctgagattacaagcacctgccaccatgtccagctaatttcttttttttcttttcttttctttttttttttttttgagacagagtctcactctgtcactgaggctggagtgcagtggcgcgatctgggctcactgcaacttccaccccttcggtttaagtgattctcctgcctcagcctcccaagtagcttggatcacaggcacccgccaccacacccggctaatttttgtatttttagtagagacagggttttaccatgttggccaggcaggtcttgaactcctgacctcaagtgagccacccaccttggcctcccaaagtgctgaaattacaggcatgagccactgcacctggccaatttttgtatttttagtagagacagatttcaccatgttggccagggaaaactcaatattgttaagatagatggtaattctccccaaatttgtctattaattcaatgcaatgcccatcaaacttccaaaagatttttgttgttgttgtgtttattttaaagcaattgagaggccaggtttggtggcatgcgcctgtaatcccagctatttgggagactgaggcaagaggatcccttgagccctggagtttgagaccagcctgggcaatatagcaagatccatctcaaaaaaaatttgaaaactggatcttaaaatttgcatggaaacgcaaaggaattagaataaccaaaacacatttgaaaaagaataaaactggagaatgtatactacctgatttcaaaacttgctatgaaacttctagtaatcacatctataagatatggaaaaaggacaagacatatagatcaaggaacagaatgaacaatacaggaaaaaactcttacatttatggccaatttattttgttttatttgagggtctcactttgtcacccaggctggagtgcagtggtaccataattgctgagtagcctcgaattcctgggctcaagccatcctcatgcctcagcctcctgagcaggtagaatgataggcacgtgccaccatacccagctactttttttttttttccagacagggtctcactctgtcacccaggctggagtacagtggtgtgctcacggctccggggttcaggtgatcctcccacctcagcgtcccaggtagttgggactatgggcatgcaccaccatgcccggctaattttttgtatttttggtagagacggggtcttgccatgttgtctaggctggtctaaaactcctgggctcaagcgatcctcctgccttggcctcccaaagcgctggcattacagttgtgagccaccgcgcccggctccgcctcccgggtttacaccattctcctgcctcagcttcccgagtagccgggactacaggcgcccaccaccacacccggctaattttttgtatctttagtagagaaggggtttcactgtgtgagccaggatggtcttgatctgaccttgtgatccacatgccttggcctcccaaagtgctgggattacaatcatgagccaccgtgcctggcccttctttttcttttttttagataggggtctcactatgttgcccaggctggagtgcagtggctattcataggtgcaatcatagtgcactgcaatctccaactcctggtcagccgctacttcttaaaatgtttctctgtctggttcatgtttcaaagtctggttcatgactctgctacacttcagtttcaaaagctggtagcaaaggaaagaacatgccaagagctgaggttctgctgtgatgagaccacccaagctccccgtatctataccaagggatctgttgcccaggctggagtgcagtggtgtggtcttggctcactgcaacctctgcctcccgggttcaagagattctcctccttcagcctctcaagtagctgggattatagatatgcactaccacacccggctaatttttgtatttttagtagagatggcgtttcaccatgttggccagactggttttgaactcctgacctcaagtgatctgcccgccttggccttccaaagtgctgggattacaggcattagccaccacacccggcccagatgtcttacttagctcttcaaggcttacggaagttggtaccttgtggaactaggctggggaggtctggatgccagatgttcttctgaggttgctgttcttataattgctgtattcaaatatatcacccagttgagatgaaatgcctagagcacagctgcggagtgggaccagctgggctgaggagggaatgaagtacaaacatccagcgatgttcagggccctgaagcagctgggaagcgcaggcgttcaaatcaccagaggcatggctatatcagctcacatatcatgcacacagatgcatgtcctaggcgtggaaacaaagctccccagaccatggttaactcaccgcatgcacctggagttccatctgcaccaaggcaccagtggttacttttagaaataaacaagtcacaatgaacacagttaaaagatgtcagcactagtggcacttggggactccagcccagctcctgtcacaagcaactggccaccaggtctggacccacatcctttgctcttggcctactgaggtcattcagttttgctcatctcccacaacctggaaacccaagggggcaggctgtgcagttcatcctggaagaataatagaagagcagctgtcgtgcatggaaagatcatgcaatgggtcaagtatttaattaattattttttgagacagggccttgatctgtcacccaggctggagtgcagtggcgcgatcatagctcactgcagtcttgaacttctgggctgaagcgatcctttcacctcagcctcccgggtaactgggactataggcacgtaccactctacctggctaattttttgatttttggtagagacggcgtctccctaagttgcccagacttgtcttgaactcctgggctcaagcgatcctcctgcctcagcctcccaaagtgctgggattacaggtgtgagccactgcgcctgacctgttaatttattttttgagacagggccttgatctgtcacccaggctggagtgcggtggcacgatcacggctcatagcagtcttgaacttctgggctgaagcgatcctttcacctcagcctcccgggtagctgggactacaggcacgcaccattatacctggctaatttttttatttttggtagagacggggtctccctaagttgcccaggctggtcttgaactcctgggctcaagcgatcctcccaccttggcctcccagtgttgggattacaggcgtgaaccaccatgccagtctgggtcaagtattttatattcattacttgagtttcataacaaccctataaagtaggcatcactgtccattttaaaacaagtaaacagaggcctaggaaaggtaaccacccaaggtcgtatacaccaaggaagaggcaatgctggcattcagacccaggccagtaaacccaaagccccatgcccttgacccaccacaacaatctgggattctgaggggcttgagtcaggtgacaccccagatctaagcatctgaaggtccctaactgtggaggctttcatgagaacaagccactggacggtaagcacacgtcgctcttctcaagggagggtgtactaaaggagcctcatctcactccccctgtgccatggaggccacaccaggtgagcacccttgggagggagacgcatagcctgactggggtgctaatgtgtcccggcactgggttctccacatgaacagttgtgtgaatccaggaggctcagatcacgtgccacagcgccacctactggcctgcgaacaacaacatcaggagatcgattccactggcttttctttgttgctctgtgtgatttctttacatattctggatacactgtcagatgtatgtattagtctctctctatatagagaagaattatataaggaattgactcacgtgattgtgcagaccggcaagtctgaaatttgcagggcaggctggaaactcaggtaagagttgatgttgctgctcgtcttgagttgaaggcagtctggaagccaaaatccttcttcctgggggaactttagtcttttctcttaaggtcttcaactgattgggtgaggcccacccatattatggagggctttactgctttactcaaagtctactgacttaaatgttaatcacatccaaaaagtatcttcacaataatatctaggctgatgtttgccaaacgtctgggcaccaaagcctagcaaagttgacacataaaattagccagcacagcatccacttacttgcttgtaaaatgggcagtgacacaccttttttttagacttaactaatgcacattaaatatgcggcctgttgtaaaaatcttcccatacatgacaactgctttttaccttcttttttttttttttttttttttgagatgaagtctccctcttgtcacccaggctggagtgcaatggtgtgatctcggctcattgcaacctacgcctcctgggttgaagcagtactcctgcctcagcctcccaagtcccaagtagctgggattacaggtgcctgacaccacgcctggctgaatttttttatttttagtacagacggagtttcactatgttggccaggctgatcttgaactcccaatctcaggtgatccacccatcttggcctcccaaagtgctgggattacaggtgtgagccactgcacccagcctactttttaaattactcttgcaagacaaactgcatggcctatccccttggatttccaggttgtgacagatgactggagatgagcaaaatgaaatgacccaaggaggcccagaaacattcagctcgagaagcaaataacccaggcccaggtgtgttggtcagttgcttgtgatgaacgctgggctggagtccacaagtgccattggcactgatgtcttctaaccgagctccttgtgtctgtttactaattatgtgggcttagtgtagacttcctctaggatgcagcctgggagttggtgcaatggtctgattgcagggaggtatctttgcatgcccaggacatgcccctgggtgcatatcctatgtgagcagctctcctcctggcccctggggatattggctagcatgggccctatgctttccagcatcttccgggccctgcatgtagctcgaagtttgtgcttcatttcctcctcagactggctggcccactctgctgctgtgctccagaacctctccactgtgtgaccagtttgaacacccaacctctgcacctatcgtctgggttagaacctttcagcagcctcacaggaaagctttgtgcccagtcttccacagcccatctgcacggggaccaactgctgccagccttgcagagcaaaggtggccaggacggctggccacagaaaagggtgcagacatggggaaggctggctagagtctcatccagagaggagagcccatacttgtgacccattccacattctcctttaccgggcagttttttgtttttttgttttttttaaaacagcatctcactctatctcccaggctggagtgcagtgacacaatcacagctcactgcagcctcgacccctgggctggagtgaccctcctgttgacagctattgtgaggccttggttcttgtcttcttggtttaaaagaatttaaacaagagacacacagcaaaagaagtgcagcatagagtcatttactgtaaagaaaagagtattttgaaagttaactatatataggctgggcatggtggctcacgcctgtaatcccagcactttgggaggccgaggcgggtggatcacaaggtcaggagttcgagaccagcctggccaatatggtgaaatgccgtctctactaaaaatacaaaaattagccgggcatggtggcaagcgcctgtagtcccagctacttgggaggctgaggcagaagtattgcttgaacacaggaggcggaggttgcagtcagccgagatcgtgccactgcactccagcctggccaacagagcaagactgcatctcaaaaaaaaaaaaaaaaaaaaagttaagtatggaatagacagtgcactgagaaacagcattcgtaaggatgagacagcaaagactggcgctagggaggctccctttctggaagcctttcatgattattcgtaagtgggtgggaagaggcgttactagtaggcatggtctgggtggtcttcttggtgcacatgtgcagtagttgtacatgcttgtttatacatcgcatgtctctttagcatctttttttttttttgagacagaatctcactctgtcgccgaggctggagtgcagtagtgcgatctcagctcactgcaacctccacttcccaagttcaagcaattctcctgactcggcttcctgagtagctgggattacaagcacgtgccactacccctggctaatttttgtacttttagcagagccaggctggtctcgaactccaacctcaagtggcctgccctccttggcctcccaaagtgctgggattacaggtgtgagccaccgcacctggcatctttagcatcttaaatctccacccaggggtgtattttttactattaaaatgagcagtgtgtcggtttgaggacaggtgaaatcaaaatgtgcatgctctctacaggggcaatcgcctactgaagacagctttgcttgaatgagctcgattacaatgtgaatgctgaggcttattgtgttgattgtacagtcaccacgcttgctgcgttcccagaacatggtcatttccttaactacctatcctgcctcactcccaccccagcctcttgagtagctgacactacaggtgtgcaacaccacacctggctaatttcttttcttttcttttttttagacagtcttgctcttttgcccaggctggagtgcagtggtgcaatcttgcttcactgcaacctctgcctcccgggttcatgtgattctcttgcctcagccccccgagtagctgggattacaggcatgcaccaccacgcccagctaatttttgtatttttagtagagacagggtttcaccatgttggccaggctggtctcgaacacttgacctcaggtgatccactggccttggcctcccaaagtgctgggattacaggcgtgagccactgtgcctggctccttttcaatttttgtagagacaaggtctcactatgttgctcaggctggtcttgaactcctggcttcaagccatcctcccaaagtgctaggattataggcatgagccactgcacccagccactacctgacagcttttaagccaaagcttagtggaatcatgggagggagaaatcctagcgtcagcaagtgaggactcgggcaaggaaaaggacctctcctctccaggtccacttagtgccagagctctgcgcctcacaacacactgcttgttccaggctccactttttcttctcaaaatgctttataaatgcctggtccccatcctctttggagtaagggttaacgctattcttcaggtaataaaataaggcacagactctcttcatatgatctggtacaacacctcatcccagatgtgaaatcctctttgcctagccaggccatgctttcctcctccaggcaggcttccagatctccagctgcagctactcatccagtcaggagccaagagaacgagagaggtagacagggtgcagcctgcagccttctgcaacctccagccccagaacccctcagcaccagtttataaatgaaagaggtttaattgactcacagttccgtatggctggggaggcctcaggaaacttacaatcatggtggaaggggaagcaggcacatcttacatggtggcaggcaaaaggcggccagagcagggaaaactgctttataaaaccatcagatcttgtgagaactcactcatatcacaagaacagcatgggggaaaccgcccccatgatccaatgatttcccttcccttccttacaggtccctccctcgacacctggggattacaattagagatgcgatttggatggggacaccgagagaaaccatgacaggggctctccagagaagcagcccagccttgggcaacttagttctcccatctgaccatccaacccaataaggctgctgactcacataggaccaggttagtgtttttcttaaaggcactacctttttgtggctaatttttagaatttatttttattattatttttttgagacggagtctcactctgttgcccaggctggagtgcagtggcgtaatcttggctcaccacaacctctgcctcccgggttcaagcaattctcctgcctcagcttcatgagtagctgggactacaggtgcatgccaccacaccctgctaattttttgcagttttaatagagatggggtttcaccgtgttagccaggatggtctctatctcctgacctcgtgatccccctgcctcagcctcccaaagtgctgggattacaggcgtgagccactgtgcccggccgctagaatttaatttttatcagatatataaatactagtttgaagtcaagtaatactacaaagcttataatgatgaacagcagctccctgactcaccaaacccttgcaattctcaatcctcaggagtaataactctcaactcttagagctctttcttatggtaattaactattaattcatgctcatactgttattttattggttttcaggtttcagatattctccactaactaggaagatgattttgctttcagaccacacagacactcatcgcccctcttgccacccatcctttaaatttgattgttttttccttctggggttcaatcaatattcattgtttacattgttttaattatgcaaatatcactacttgaggcataccacatactctaattacatttctgttagttttcctttaactgaaaacgtcttaatttcaccttcattcttgaatgatatatttggtggatatagaattttgagctgacagttcttttctttcaacccctaatgatgttctactggcctctatgatttctgatgagaagtccaagtcattcaaatccttgtctgccttaaatttgttgttttctctgttttcaagattttctcagtttgctttttttttttttttttttgagacagagtctcgctctgtcacccaggctggaatgcagtgctgagatcttggctcactgcaacctctgcctcttgggctcaagcaattctctggcctcagcctccctagtagctaggattacaggcacctgccaccatgcctggctaagttttgtatttttagtagagacagggtttcaccatcttggccaggatggtcttgaactcctgacctcaggtgatccaccagcctcggtctcccaaagtgctgggattacaggtgtgagccactgcgcccagactattttgcatttttaatagtttgatcatgaggtgcttaggcatagttctcttcaaatttattttgtttggggcttattgagtatatttatttatttatgagatggagtctcactctgtcacccaggctggagtacagtggcatgatctcggctcacttgcaacctccacctcctgggttcaagcaattctcgtgccttggcctcccaagtagctgggactacaggcatgcaccaccatttttttgtggctaatttttgtattcttagtagagatggggtttcaccatgttgaccaggctggtcttgaactcctgatctcaagtgacctgcctgcctcggcctctcaaagtgctgggattacaggcgtgagccactgcgtctgaccttattgagctttaatctgtaaacttatttactaaagttgggatgttttcagttattatttctttaaatatttttcttccatgttgtctttcctatcaatttttttctgtccttcagatttcattatttctattatccaacttcatcttcactcactcttttgttggtttttaaaaaatttttttttctatttttttcttttttcactgacttttctttttcaattctgttttactagtaagctcattgctctggttttaatgtgtcccccaaaattcatgcattgatacttaatggacaatgtgatggtattaagaattggggcctttagtaggcaattaagtcataaggttggagccctcatggatggggttagggtccttaataaaagatcttgcaggagtgggctcattctcttctgctcttccaccacgtgaggacatagcattcattccttctggaggatacagcaaaaagataccatctcagaaacagagagcagcccatagcagacaccaaacctgccttgatcttggacttcccagtcttcagaactgtgagaaataaatttctattatttatgcatcacccaatttcagttattttgttatagcagctcaaatagaataagacacccatctagtgattatttttttttttggagacagagtctcactcttgttgcccaggctagggtgtagtggcacgatctcggctcactgcaacctccacctcttgggttcaagtgattctcctgcctcagcctcccgagtagctgggactacaggtacccgccaccacacccagctaattgttttcactagagatggggtttcaccatgttggccaggatggtctcgatctcttgacctcatgatccacctgcctcggcctcccaaagtgctgggattacaggcggaaggtactgcgcccagcctttttttgagacagagtttcgctcttgtcacctaggctggagtgcaatggcgctatctcagctcactgcaacctctgcttcccaggttcaagtgattctcctgcctcagcctcccaagtagctgggattataggtacgcgccaccacgtctggctaatttttgtatttttagcacagatggggtttcaccatgttggccaggctggtcttgaactcctgacctcgtgatccacccgcctcagcctcccaaagtgctgggattacaggtgtgagccaccaagcccagccactattggtgttttagctcccaggtgctacagattgtttgttccaagttttgactcccctctgaaaactgcctgcttttgttcagtttccagagctcttgagtagttcttttctcaatattatccagagcaagtaagtatttgaaagaagatggcttgttagctttctcctctaaaatggaagtgataacccatctcccaaatacttcaccttttatatcatcaatcctttttttttttttttttgagaccaaggctaggaggctaaagtgcatcttggctcactacaacctccacctcctgggttcaagtgattctcctgcctcagcctcccaagtagctaggattacaagcatgtgccaccatgcctgcctaatttttgtatttttagtagacgcggggtttcaccatgttggccaggctggtctcaaactcactgcaagtgagcctctggccttggcttcccaaagtgctgggattacaggcatgagccactacacccagcctagagatcagtcttatttatagctttgttttttggtaaaacgtactaataatgaaaagcacaagtgaatcatttctctttttacgtgattttttgggaacatagtgatgcatatgtgtgctttgctccataaggcaatacttctcttaaagtccacctaactaaaaatggaaaattcttatgcctgtaatcccagcactttgggaggctaagcggggtgtggatcacgaggtcaggagttcgagactagcctggtcaacatagtgaaaccccatctctactaagaaaaatacaaaaaattagccgggcatggtggcgcacgcctgtaatcccaactactcaggaggttgaggcagaaggatctcttgacctcaggaagcggaggttgcagtgagccaacattgaaccactgcactccagcctgggcgacagagctagactttgtctcaaaaaaaaaaaaaaaaaagaaaattcttgcttttcttcctctccttccccttggggtttggttttaggctctctgatgatagcctatgatcacaatgcttatgtaaaaccactctggctttatctgctgattgatcagttccaacagccccatagagctgtgggtttcctgtttcatatctgacagtggtcattctcagaatagtcttttcctatcaacatgtaattaaatccttttactgctgctcttgtgaacacttttgaacactgacagttacactgatatgtaactgagcaaacttcgctttgcctttattttaaagttgcctgtgctcatcaggcgatctgatactccacatcgagaagctccaacctcagggttgtgggagtgtttttaattgtttcctgcgtttcctaccaggcattgccaagtgactagacttaaccttctcaggaagactcgaatgctttcccctctcttaccctaccccgtcattaaggcatagcagatcctcgagttgacctttcatactactgactctcacgtcagtctgcccgttggtcagtttatgcttagtgacttgtccttcagttaggagacttatgttttcttgtttgtttttttgagacaaagtctcactcagtcacccaagctgagtgcagtggtgcaatcacggtcactgcagtcttgacctgctggctcaagcgatcttcccacctcagcctcctgagtagctgggactacaggcgtgcaccaccacatccagataaatttttttaagagatggggtctcactatgttgcccaggctgatctcaaactcctggcctcaagtcatcctcccacctcagcctcttttttttccctgcgagttgcaattatagctgagtgaaacaaactgtaaccgaatgaaagcaacgacaacagaatcctccccaggaagcagctgattagacagggccaaacgcacagacatcttgacaacctgtaaccagcaagttctggcaagttattgatggaggctctttgaagttcagccaaagttgggatccacttggctgggcacggtggctcacttgaggttaggagtttgagaccagcctggccaacatggtcaaactctgtctctactaaaaacacaaaaattagctgggcatggtggtgcatgcctgtaatcccagctacttgggaggccaaggcaggagaatcgattgaacctgggaggcggaggttgcagtgagctgagattgcgtcactgcactccaccccgggtgactctgtctcaaaaaaaaaaaaaaaaaaaagggctgggatccacctactaattattttacagtttccttctctgcggcagagtgagagcaacagaaaaccctccactgttagctgttagcagatgcctctcagtgttctctgctgcttggaggagtgacccatacacttgtgtccagtgagtgctgcaccatgttggcctcttaaggaagcgcttcgcttcagtgctgtccaggacttcccactttcctttacaagaactgcgattacatcagtggcccccgttaggggactgggctactgtaatgtgttttaaaaattaggtgccaagaacatgtacaagaatgttcacagcagcattactcttaagagccaaggtggaaacaatgcaaacatctttttttttttttttttctgagacagggtctggctctgtcgcccaggctggagtgcagtggcgcgatctcagctcactgcaacctccgcctcctgggttcaagcaattctcctgcctcagcctcccgagtagctcggactacaggcacccgccaccatgcccagctaattttgtatttttagcagagacagtttcaccatgttggccaggctggtctcaaactcctgacctcaggtgatccacccacctcagcctcccaaagtgctgggactacaggtgtgagccactgcacctggcctgaaacaatgcaaacatcaactaatcaatggataaaaaaaaatacatccacacaatggactattactctacaatgaaaaggaatacatttctgatacatgctacaacctgaatgaaccttgaaaacattatgtgaaagaatccagagccacaaaaggtgacacattatgtgattccatttattggaagtgtccagaatagacaaatccataaagacagaaagtttcatgggaatgaaaggagttggggtgaatgggggtacattttaatttttttgagctggagtctcactctgttgtccaggctggagtgcagtggtgcaatcttggctcactgcaactttcacctcctgggtcaagtgattctcctgcctcagcctcctaagtagctgcaattataggtgtgcaccaccacacccagctaatttttgtatttttattagagacagggttttgctgtattggccagcatggtcttgaactcctgacctcaagtgatcagcctgcctcggcctcccgaagtgctgcgattacaggcatgagccaccacacccggccagggggtacactttaaatggctgaattgaatgaagtgtgttatatctcaataaagctgtttttaaaaaaagttaagatgccaggtttctgaccccacagtggcaggcaacgaccctgttctgtgagcatccgggattatttttggtatggcagctgcccaggatttttgtgcagagccttcatacctgtcactgatggaggctctccgaagttcaagccaaagctgggatccgcctacaaactgttttacagttttccttcttctccaaggtgcagtgaaagcgaaggaacgctgctggacatggtgagacatggaggactttgtaagggataacctttggttccctgattttttgacatgaatctaacgctctgcaccttcctccttcttcttgacagtgacattcataaaggccagaagctcggtgtttttgtttctgttgtctgtattctgtattctgttccactagtccatctgtccatccttgtaccaatacttcactgtcttcacattacagtaactttttagtcttggttcctggtaggataagtcggaggtttgttgttcttcaagatcaccttggatattctaggtcctttacatttccatataacattttagaaacagcttgccatttttccacccacaaaaaccatgctgggatttggttgagatgactttgacaccacacatcagtttgggaagaaccaacaactttataatactgagtcttccaatgcatatacatagtatatccctccatttagttacattttgttagacttatttctaagtatttgatgctttttgatgctatcataaattatattgttttggcaatttcattttctatttgtagctgttaggtataaatacagtttatttttctgtgttcacctgatactcagtgaccttgctaaactaacttattaattctaatggtttatacatttaaaaatttactgtatattccatcaagttgtctggaaataataaaagttttatttcttcctttccaatctatgctttggtttgttttttgagaccggtctcatactgtcgctcaggctggagtgcagtgtcagatctccgctcaccacaacctccacctcctgggctcaagcgatcctcctgcctcagcctcctgagcagcggggactccaggagtatgccaccaaacccggctaattttcgtatctcttttggtacagacagggtttcaccatgttgcccaggctgatgttgaactcctgggctcaagcaatctgcttgcctaggcctcccaaagtgcaaggattacaggcatgagccgccacgcccagccaaaaaaaaaaaattttttttttaaagcttttctcaagtggtttttgttgttgttgttgtttgttttagacagggcctcactctgtcacccagactggagtgcagtagcatgatcacagatcaccccaggctcaggtgatcctcttacctgagtctcccaagtagcttggactacagggatgcaccaccacacctggctaatttttgtatttttggtaaagatgaggtttcaccatattgctcaggctgtggagttcacggaacattgtagcctcaacctccagggctccagcgatcctcccacctcagcttcctgagtagctgggactacaggcgcaaaccaccacgcccaattaaaaaagttttttttttgtagagattgggggtgggtcttgctatgctgcccaggctggtgtttcattttaaaaaatccaatctgacttttatttgaggtattagtctgttcttgcattgctataaggaactacctgagactgggtaatttatgaagaaaagaggtttaattgactcacagttctgcaggctgtacaggaagtgtggctgcggaagcctcaggaaacttacaatcatgggggaaggcgaaagggaagcagggaaatcttccatggcagagcaggagatagagaagggagaagagttacatgcttttaagcaaccaagttttgtgagaactcactatcaagaggacagcaagggggaagtccgccctcatgatccaatcacctcccccctggcctctcctccaataatggggaacacaactcgacatgagatttgggtggagatacagagccaaaccatataaaggcgtttagaccatttacagtacagttgttgacatggtttggtctatgtctttctgatggattgactcctttatattattaagtatacatctttaataatgttttctggtcttaaagtctactttgtctgatatagtatagctacataaactgatatctttatttttatttatttatttttattcaaacagagtttcactctgtctcccaggctggagtgcagtggcatgatctcggctcactgcaacttccgcctcctgggttcaagcgactctactgcctcagcctcctgagtagctgggattataggtgcacagcacgacacccagctaatttgtgtatttttagtagagatggggtttcaccatattggccaggctggtcttgaactcctgacctcaagtgatctgcctgccttggcctcccaaagtgctgggattagaggcataagccaccacacccagcctcactagttttattatccactgactcgacttgcttgagacgattttactatgttggttatcaaatggtaactttctaattctgtaattccttctgtgtttattagctcaaggtctatgggatgcagtgttgacagggttctgtctacttcacttgcctctgttcccagggcctagctctccaagtctttcaactgaaatcccatagtattccccaggttccctccttttgagagatcttgaaaactgtctactcagctcattgcaacctctgcctcccaggctcaagcgattctccttcttcagcctcctgagctgggattacaggcacacgccaccaggcctggctaatttttgtatttttagcagagatggggtttctccatgttggccaggttggtcttgaactcctaacctcaagtgatccacccgccttggcctcccaaagtgctggaattactggtttcttttttttttttttttttttttttttgagacagggtttcactctgccgcccaggctggaatgcagtgacgcgatctgagctcactgcggtgaagcgatctgagctcactgcagcctctgcctcctgggttctagcgattctcgtgccgcagcctctcgagtagctgggattacaggcacctgccaccattcctgggtaatttttttactcagcactgtgactctgcaaaattccgctctgctttagagaggtctaagcttagtgtttcaggtttgcatcttgtgtattcagatttcaccagatggcttgagacctagccatctattcgaggccattcaagcctccaaattttgtcactccggctggtgagactataaaaacataaaaaacctggatcctcagcctctggccagagttggcaaatgcaagtggctgcaggctgtcagctctcctctctacaatcctgaccctttagttactgttgcctctgcaactcacttaaaccaaaacctcacctctggctttcattttcctttgtaaatctccatcttaaggacttcacaggccgggcgaggtggctcacgcctgtaatctcagcactttgggaggccaaggagggaggatcacctgaggtcaatagttcaagaccagcctggccaacatggcaaaaccccgtctctactaaaaatataaaaattacccaggaatggtggcgggtgcctgtaatcccagctactcgagaggctgaggcaggagaatcgctagaacccaggaggtggaggttgcagtgagctgagatcgcatcactgcactccaccctgggcggcagagtgaaaccctgtctcaaaaagaaaccagtaattccagcattttgggaggccaaggcgggtggatcacttgaggttaggagttcaagaccaacctggccaacatggagaaaccccatctctactaaaaatacaaaaattagctgggcatggtggcatgtgcctgtaatcccagctcaggaggctgaaggaggagaatcgcttgagcctgggaggcagaggttgcaatgagctgagattgcaccactgtattccagcctgggtgacagagcgagactgtctcaaaaaaaagaaaagaaaaaaagaaaaacatctgggaaagtattagactcagtctctggttctgtccccaactctctggggccccttgggtgagtcttttaccttctctgggcctcagatccacccgcctacctattacacccagttctgaggctacagagtgaacagaaaagaaaaccactgctgtccttacagaacttaagcctaacttttccatctataaaatggggatactacaacctcccggagagtaagtgagccagagagcttgctctttgggaggtggcagtggcagacaggaaaagcccatggaaacacaatgtcagaggtcagcccaacctttcacctgggcctgtgtgccctgcagtgaaacttgaacagatcttcactgctgtcacctactgctacctggggctgttgggtgcagctcagttctatggcctgatcctggttgctctctgaagaaatccctgctatttggcccaccctaaggggtctcccagccaaatgggtcaaggagcagtccctggctccaagacccaggcaggagaaaggcatagtcctgccagggccctggagtatgacagccaagcactagcaactgcctagtcctcagaagagcggcctgtgctccagcccctacctcctcatttgagccaacttcctcctagtctgctgcccctgttgcccctctcctcctggcttttctcttccacatcgtccaagtgtctccccaagtacagagtgtttgagaagacactgttctgctgtgggttgttgtgggcaagtgaggtagggatttagggccgaggccgagagctcccagggaaggcctgtctggggagtctgcagcatcctgcgttggggatgttcctatcttctcctacaacccaatggcagctggggttttagtttggtcattcattcaggtccccaggctaatctggccagtgagagggacagtgcctggtggggcaggcattcctgggcactgctgatcagctgtctgagaagggcctcccctctctgcacctcactttttcatcaagtgagaattggatgtctaaggttctcctcattttggctaaaactctttaattcctagccccttttgaggacaaatgccaaatgcctctgaggattatgttggccaaggattttttaccagaaacatcttcacacataaaatgtgagggtgggggcgatacattcagactattaaggcttcagctgggcagctgtctccatcaccgccagggcctctggggctgtggcgtccacttatggggcagagtggagctggggtaggtgaaccaaaatctcccttgtagggtgcactggtgacaaggagcctgaaccatggaccccaccttcctaagcttagatcaaagcaggcagcctctccaagacgctcacggacaggctccccacatgcagagactgatggctgccttgggctccctagacagagcaagatctgcagtgatgactcacaaggaccccaagtccctcctccttcttcctcctctactcttcaccttctccccgtctctcctctatgtctgggcccacagcctcctaggtgacaactgcctatgatgggcatgagttctgagaacaaaccctgggtcccaagtatctgcctcctctcgcagcacatctcattcctcaaatcgtagtatggatattaccacttcaagaaacccctgctaccatgcaaattcctgaagccattcatttttaacacgcagacgcaaattaacttcgccgagacaggcagcagcagaaggctcagggaggaggtctggaaaggctactgacgcagggactgggctgctggaatgtgagggagaagactgacaagggggtgatggggaagggtggccactgaagatcaggcgcctctcaggaccagccatccacacgtcagatctgtacacagagctgccagattctgctctccccaggacagagcctcatgatgtgggcttaaacatatcagtagaatgaataattctggacacattggctcaagagtcagaaaaccccagacgtgacttccagctctgctactagcagcatacagaaaccaaggggatcaaggtccctagtcctctaaaagtccttgagtcctactctgctgaacctaactggtcaagaactaaggacctgatcagcaaggtttgtgagcatcagttggcaagttcaaggccactgcttccactagcagagaggtggttgaggttcctcccagtcaccacagagaagatttaacaagtaaaaacctgcaaactctttattaaattctcccatttcatctgtacagaaaaaaatgcacattatgttcagaacatatctcagtaacatctcaaaattacacagcatgaacatgtaaaaacaagggaccaccacgattttatacatagaaaggaaacccatttacaaaagaggcttgttaattgtatttttttctttctttcaaaaacaaaacaaaacaaaaaaagtgaaaagcctaagatctcacacagcatttgctgtacagactgttttccggatggactggtttgggaacactgtgctgggggaagctgcccaggaagcgctcccgctgccggctttccggaggtctctgcccagtgcactgcagggggacctggagggcccatttctaccaccctagcatgtctgacagaaagccctgctgggctctggggtccagatgtcaactctacattggaggaggcaaaacacaatctagaggcactgtctgaactttcccctggcccagggagatttctccactgcacacagcacagtgtcctatacatgtgtcctggtggagcagagggagcgggagaggaccacgggtcaggatcctgtcaccaccagcctgagcagacagtcccatctttgtgatccaggtgacaaataatcagtccctggtccccacaatgacctcaccagatggctttggggagctcttcaccctaaagattcggtctggtttgctaatgacttatctattatctgaagtctgtggaggaaggaccaagaaggggtgcagttagagggatgagcaaccaaagaccaatgggagggaaggcaggcaagaacctcagacccggccccacgccctctaggaaccaaagtctagtggagaggaggcgagtggggaggaaggaagtgtccctcaaggcctgagagagacccacagcaccagatgctgcattttacaaaaccacttaggtgctgcccaaatggtgagaaataaaaggaagcattctggcctttcaggtttttcaaactcacaagatgttgaaatacaagtaaatataccaaaatgcacataattgaggccaaggtgggtggaccacatgtggtcaggagttcgaaaccagcgtggccaacatgatgaaatcctgtctctactaaaaataagaaaaaattatccaggcatggtggtgcatgcccgtaatcccaactacttgggaggctgaggcaggagaactgcttgaacctaggaggcagaagttgcagtgagccgagattgcgccactgcactccagcctgggcaacgagtgaaactgtgtctcaaaagaaaaaaaaaaaaaaggccaggccgggcgtggtggctcacgcctgtaatgcactttggaaggccgaagtgcactttggccgaagtgggccactttgcggccactttggaaggccgaagtgggcacatcatgaggtcaggagatggagaccatcctggacaacacggtgaaaccccgtctctactaaaaatacaaaaattagctgggtgtggtggtgcatgcctgtaatcccagctactccggaggctgaggcaggacaatcgcttgaaccagggagtcggaggattcggtaagctgagatagcgccacagcactccagcctggcaacggagtgagactccatctcagaaacaaaacaaaaaaccaaaaaagccattacggccaaaatttaggctgactgttctagggctggctgacttccaaggttcctggtccagcttccttcttcttagattaagttctgacttagagtgtgttctaaggaggcaggggaggaaatgggaagggaaggcctcttttcagtggcctctccccagatgactcactatagtaggaacttcggggcagaagtcacaccacaggcctggaggatgggaggataggagacacttccagaagccacactgacataagaacagaatcttctcttgggaaggccaagggaagtcagccacataattccctttccagtgtgccttgataaaacgtaaaacatgaatgaagacactctcaccattagattcttctgttagttgatctcaggaaacagaaacaaatgaaatctgacagtaactttctgtagcatcttcagggaaagctgtctcttcaccaggatgcatccccaccctggccagctgagtgactcactgttcccaagaagagtaaggacagcatgagacagccaaaggcctgcagtgtgttcaagtcaatacctgctcactcaacattagctcactggtcaccctagaattctcctagctttgaaggatgcactaacacagaactgcagctgggggtggtagcccggggaagatcgctttcccgggggtgatcccaagcctatggagtgcatggctcccctgccggtgcttcttgctaacgggcttgtctagggacaacagcaacagcaatggaagtccaacatgcacccaggtgaaggcctcacagagctccccatctgtgggagaagctccattgtgaacagttcgtcttgttcttaatagtttgcccagacagctcaccttcagtaccccagagcctccagcctggcagtccgggctccaggtacctctagagggctgtggcgcacactatgcataagtcacagggacactggcatgaactggtaagtccagatgacagtgacccagctgctataactgttagcaagtacctgaagccttagccttggcaaaaccccctaccctctacttctattactgttggtgggctacacatcaggagagtagacacaggccagagtccatcatccactcacatccacagaagggtcattgtttcttttcttgaccatttctcagccagttgactgacctataaggccaggaaccaggggtgccccaggccctgttttgttttgccaaatgagggacttaatgagtgcggccagttcagactttgctggccttggcacttagaaaaacttgctcggggccctgcctggggctctcaagagccagtcattggaaaatgctccaagtaagatgatgaaagacattcttgtaataagtaattgaagatactggcagagctaacttttctattctgaccatttataaagatgacaaatgttttggccaggcagggtggctcacacctgtaatcccagcactttgggaagctgaggcgggtggatcatgagatcaggagttcaagaccagcctggccaagatggtgaaaccccatctctactaaaaatacaaaaataagccaggcgtggtggcgggtgcctggaatcccagctactcaggaggctgaggcagagaattgcttgaacccaggaggtggaggttgcagggagctgagatcgcgccactgcactgcagcctgggcaacagagagatactctgtctcaaaaaaaaaaaaaaagacagatgtttcaagaaccaaattcctcatcaaacttccaaatctgcagacaacgaatgggattttctctcaattcagaaagaacagaaatatcaacacaattagaactataagggtgtttacgcatactgggaaggagactgcagagaggaaggataccccacccggtcaaacagtgaacatccatcctacctgcaaaccacaccaggcacgtccgtaggcacctccatgtacatgacattcctggctcttgatattaggcctcagcggcccccagcccccaggggaacctgcagagactctcgggccgctcactccggctggcagtggcgggaggcagtgtgtgctgctcgcaccctgcgtttccagttttaggagactgaagcatcccagacagctgttgacaatcaggaagaccctacaagcaggaccgaggggactaagcagcttagcagcttcccttggtgacttggcagggggacaatcagttggcttctggaacccactgcctccaggaagggcagcaaatagaaaaaaaagaaagaaaaccacagtattcaaatatatgtcagtcaggttagacaaggagtaacttggatcaactgatccacaaactgacacgccttgtactgaacacccttcagggaagacatgtgtcgctccggtcctgcagtgcacgtggactgtgcagagcagaggcaagagtggggggcgccgagggcaggccttggtctacatggacagttttaggcacgtgatttataatactttgtggacatctaacaggttaataaaatatatattacataaatgtctctcctactgtacacactgctctcttgtgcagccactgtgatctcatgccccaaactcaaccaaaggagtgccacgctgaaccatgatgcccggacccctccctctcacacccagacttgtcatctccacactggaggaatgaggcgggatggccaagaatattgcttctataaagcccatattctgcaaaggttgatgaatcgccaaaatacaacatttagccaatgcctactagagtgggtacacgcagcaaatggacagaaagaaaaaaaacagagcaaatcctccatcttttaatgtgataactttccacaccctctccacgtagaggcacaaaggagcttgtctgggaagtttgtctggagtgtgcagaaaggtcaggctggactgcctgtcacatcctgagaccacactaaacctttataagccattgtctctgacctgtattgtagcctgaaaaataaagcaaagtgagtcaaacctctggctcccacttcctgacccactgctccccacacccatcttcaaggacccctcccgccacagtcctgcctcctgatgaagcgcagagcttccagagtgactgtagcctcagcagggccggtccagacatggctgagtcctgtgctgccctggaggaggaaggttcctgggatcctgctgccccgggactcaggatccagcctctcagtgcagatggatggactgttcaacttcacaaacttccggtcccttcccctccccagctgcccttgtctaggaaggctcatgctttgcttcaatgaagcgaggagaccacagaaatacccatggctgtggggctgtgaccagcagtggctgattagggtggaaactggaaagcgtcactgtctcagcagaagaaagcaggaccccacacagcctggggaacggctgcccacccacgcctcggtgaagaccacggccctggcgaggccccaaggtgcttctgagagatgaacgagacacctcagtcatggcacactgggtggtgtgcttcccctccaagtcctgtctttgttttacacagtcatatgaaagacataaccccattgcccaaatcaagcctggaggagatgcgttactatatacatttttttctttaaaaaaatttttttttttggtggttttcttaaaaaagcctttgagttgcaggtcaggtgagttggttctggaagtaccggaagttctgttggtatgagagagacttgtctacaggcaggtaaacccaagtttgccaaacaaaggcagtaaccccagcgaccagctgctgctgctgcacggtgaggaggaggaggacaccatggacacgagtggaggctggatgggacaacgcagtggacatctgctaatgctctaacacggggttggtgtcacttctgagaagagcgaggtgagtggggatgctatacaagagggctgtacaaactgggcactggataggtagttcctttggtggtcaaggtggctctacctgtccttgagctctcgtgtcactcgcttggtgatccgtccacacatcaggccaatcaggaacaatatacagatgctcccactgatcacagagagaatgtagttcttagatggagacgtcattacttgcatggcaagatcagagaagccatctgctggggccacctagaatgacacaaggcaatgtgattctctgagagagcactgggctgg

SEQ ID NO: 724 - DNA, 12929 bp, Homo sapiens
cccaggagcctaatatcaattcatgtgtcttcatgttaattacaatgtttacaatctcccagtagaggccacttatttaaggagaatggagcaggaagctgagagggatgggggatgacatttttagaggtgacagcttataccttggaagaaagtgttcagcagtctttgcaagcccggcccccaccagctgatgaatttgcattctgaatgcacccttacattttttctggattaaatggtcacacaggtaaaaatctttaggttatagtatttctgagctgagccatgggatgctttgagaactgatgtgtagcattaagtaaaacagaggcaggggccacccctggatattccagaagacagcttcctaacccaaatgaggaaacatctggcttatgaagcacatgtttaaggggacagtgaattagcacatgtgaattttagactgtcctgaaaaatccagtacagaacatagacttcctccatggaatccccacaaagaagcagctgggaacagttcataccaagctttaagtatcttctctgtctggggccatgtgctcgggaccaagaaggtagaggcaatcactgtgcagaagcaggtaagagggatgaaatgagaacaggcctggagctgggcaaatttaaatcccaattcttcactttactagctgggtgaccttcagcaggtgaattcagctttccgggactctttcttctgcagaatggagacaatgattgtgtctctctcaaagcactactgaaagaattgatctctgacaaacagtatgtggaagcttttaataatttttgttatgatttataattcctgcttttgaagacctcacaagctgccaatctctaagagaatccttattacacctgaaatttcaatttatccaaggcttcttgttttctgccacttacttatagccaagattggtcaaggacagctataaagatcctttagcctcatccaggaacatacaagacttaagttgctaatacctaatatagacgtatttctatatgaacctttagcacttaaccctgctagtagccaccatacctgaggcatgtgttgagtcggaacactggggacaggggacctggggacccaaatcagtcagagtatgaattctgccatgtatcttttgagacactctcattggacttgtcctcattcttcagtgggaatccaatttttctcccttcatagctatgtttgaagagcaagtgaaaacaattttgtataccataaagtgtgtattcactagacaatattatgaacacctattatgtaccaagtatcatgttaagcatcagaagaaccaagaataataagacagatgaaataaagtaaaatagagaaaagaaaatatacagaatactctataaaatatggaataaaataaaatgtgaactgagactagagaatgaagaaaaataagtttcaaagacagattagcagaagggatactaaattatagtataaccaggaaagccttctcagaagaggagatatttaagcttgctaagaatacaggaaagcgctggagcaagagtgatcctagcagaaggaacacacagggaagatgagattgagctcattctcagatgaccctgaaagtcaacaagcctagagtcacaggatgtgactggagagacagaaggagcctcatctcacagaaggaccttctagtattatgattgccatgaagctcttaagaatcttcctgtccaagttattttctttttctttttttccttccttctttccttcattcattgtttttttgtttgtttggttttttttcagacagagtttcactccctcaccaaggctggagtgcagtggaatgatctttgctcactgcaacctctgcctcccaagttgaagcagttctcatgcctcagcttcccaaatagctggaattacaggcattcaacaccatgcccagctaatttttatacttttagtagagacagggttttgctatgttggccaggctggtctcgaactcctggcctcaagtggtccacccgccttggcctccccaagtgctgggattacaggcgtgagccacttcgccagccccaagttattttcacgcattattttttgtatacactgggctcaggttcaccaaaaccactattgccttgggtcctacattccaaagcttgattttattttaatcatacgcttttcatccacctaccccatcccaccctaaaattttccccagacaaggatggagatctgaagactcaaattgaaaagctctggacagaagtcaatgccttgaaggaaattcaagccctgcagacaggtaaggtgcagaccttctcagtgccttgtcccaaaggagacaggaaaatttctgggtcaatttctgggggacgtctttttaaaagaaacattgacaaatcaataatgtggccaataagagggccccaatgccgggagatgattgttttaggaaatcagcttcatttacaatcccattctcctatatatgggtggtatagaaataaaaataagtagttcaggaataaatttgaaaagtcagtccatacttattctctaaagagtagtgaaacagaatgaagccagtatgaaatgactaaaatgattagcatttattggatgatagctaagtgcctatcaggccaccaggactctctcgggccacacccagcctaagatgctggaaggacatgggttagaaccgcagcttgccaacagggcagcgccagcgttcctccccacagttatgcagccacatgcgctactgcccaggagctattctccaaggggtgaggaagtgagccatgtgggcaggtttgggaacagccctggtttacaaggctcatcccccaaggagctaatatcctttgtagcaatttcaaaagcaaggtgttgaggttcctcacaagagacctgcctcattacaagttactgccttcagggaagactgaagttacggctttccatcaagtatttataactcccagaccagatgcatgttaccaacctggggtcatttttaccacaagcaatgttgcctagtaacaagggtgacatactccctttatcaggcttccgggggaacagaattagaaagttaaaagacagtcaaatgcttatgcagaaggtgagtttggttcatcctttacccacagtcaggtactagaaattctttataaacacaaatccattaatcctccagcaacttaagctattatgatcctaattttacagatgaggaaaatgaggcacaaagaaggtaagtaatttgttcaagagatacacagctagttaaatgtcagagatgagacctaaacccaggcactatgggctctgaggcctgactctccagtgctacggcctaaaactatctttatgctcagtttatcctgaataatctaaacaatattaccaaggctcagttatctgcttaagaaaatccctgtctctccacatgcaaaactagaatttaattgattgattgattgattgatttttgagacagagtcttgcactgttgcccgggctggagtacaatggcgcaatctcggctcactgcaacctctgcctcccaggttcgcacgattctcctgcttcagcctcctgagtagctgggattataggcacacaccaccacatccagctaattttttgtatttttagtacagacggggtttcactatgttggccagactggtcttgaactcttgaccttgtgatccacccgcttctgcctccctaagtgctgggattataagtgtgagccaccacgccaagcattttttttttaaacaaatatttttaaaaataaatattaaataccatctagttccaaaactcccaaagaaatccaacacagagtagcaagcatgtatatatcagaacagcatgaagtttaaggccatgtcttgggatagggcagacctgcatttgggtagctgtgatctcacatgctgcaaaaattacttcatttaaaaaaatgtggctaggcgcagtggctcacgcctgtaatccaagcactttgggaggccgaggcaggcggatcatgaggtcaggagatcgagaccatcctggctaacacggtgaaatcccgtctctactaaaaatacaaaaaattagccgagtgtggtggcaggcacctgtagtcccagctactcgggagcctgagacgggagaatggcgtgaatccgggaggcggagcttgcagtgagccgagatggcgccactgcactccagcctgggcgacagagcgagactccaactcaaaaaaaaaaaaaaaaaaatgctaaggtgttacaagtaacaacttctctaagcctaaatatcctgatatgtaaaaataggggtaataaaatacaacttcatggggttgtcaggattatgtaacttaatttatgtaaaatgcttagcatgttgtccggcacatagaaaattttaactgttgtctcatcattatcatacttcattccacaaatacttattgctatttgccaggtccagccctagtcataatacactcaaaatgcatcttaatatgttacacttcacatcttcacagtctgtctccgaggcactaaagttcacaagaaatgctaccttgcttcagaaggtttgaagcatttccatgaggccaatgaagactgcatttccaaaggaggaatcctggttatccccaggaactccgacgaaatcaacgccctccaagactatggtaaaaggagcctgccaggtgtcaatgacttttggctgggcatcaatgacatggtcacggaaggcaagtttgttgacgtcaacggaatcgctatctccttcctcaactgggaccgtgcacagcctaacggtggcaagcgagaaaactgtgtcctgttctcccaatcagctcagggcaagtggagtgatgaggcctgtcgcagcagcaagagatacatatgcgagttcaccatccctcaataggtctttctccaatgtgtcctccaagcaagattcatcataacttataggttcatgatctctaagatcaagtaaaaatcataatttttacttattaaaaaattgcaacacaagatcaatgtccatagcaatatgatagcatcagccaattttgctaacacatttctttgggattttgcccttcctggggtataggggatcagaaatattgatccatgtgcacgcagataaaatggcttctgctaaacagactaaaatctttctctctagtctttctcacttgtacaaacccagtttgttttcaaaaaatcacagtagcaatgcaactcatcactctagaaaagcaagcttaggctacctgaaagattttcccttggaagtttagcgtatgtttgactaacaaaaattccctacatcagagactctaggtgctatataatccaaaaacttttcagcctgttgctcattctgtcccatgctggcaataataccttgtcagcccattacccttattttgaattgctccatctcctggtgggacttgtatcttgtctgccatatcagaacacaaacccctgaagaggttctgatttgattttttttttttcttcatgcctaccctttttttggaagtttccagccgcaatttgaaatgaaatgacaaggtgtatatttgatcaattttcattcccaccattgcattacaacctctaacttaaatgggtaaccctaaggcatatcaaagaagcagattgcatgataaacggaaacagaaaaaaagaacctacatttattttgctttagcatccttactctcaccttttatgagattgagagtggacttacatttccttttttacattttcgtatacttattttttttagccatcattatatgtttaagtctattatgggcaaccaatctttggaagctgaaaactgaatttaaagaatgctatcttggaaaattgcatacgtctgtgcaattttttattctgcctagtgctattctgcttgtttaactagattgtacaaaataacttcattgcttaatatcaaattacaaagtttagacttggagggaaatgggctttttagaagcaaacaattttaaatatattttgttcttcaaataaatagtgtttaaacattgaatgtgttttgtgaacaatatcccactttgcaaactttaactacacatgcttggaattaagttttagctgttttcattgctcaataataaagcctgaattctgatcaatagaaaatgtgttcgagtgttaattacagttattcaaaatatgttggtttatattaaacttggcagagtttgaggggaattaccctgaatttaatcaaactggtgattcggatatactcagagaacaattttacctggcaatgaagaggtatggtctggctagaggagggaaacttttaaaaaattttagctgcagaggctgggcgcagtggctcacacctataatcccagctttttgggaagctgaggtgggcgtatcacttgagctcaagtgttcaagaccaacctgggcaacagggcgaaaccctgtctctacacaaagtaccaaaattagccaggtgtggtaaggcatacctgtgatcccagctactcgggagactgagctgggaggatttcttgaactcaggaagctgaggctacaatgagctcagattgtgccacgacactgcagcgtggatgacagagcaagaccttgtctcaaaacagcaaaaaatgtagctgcaattatatctggttgatcttggccaactccctacttccaacgtaaccacagtcttcgtaaaggtaatgaccataatgaaacgggtggacactggtgagtaagtgcattctcttcacatttcaggtactatgctagatcttatataattatcatttatcttgaggaacaaccctgggaatttaacctggagaattaggctctagaatcatttcatattacagaagaagaaaaaaaagagagttaagttgtcctaagtcacaggccaggaaatagtggaactgtcactggaacttaacaagctgactcagatcctgtatacttactacccatggggagcaataaaaggtaaagcccattcagaaaggcaatgggagtggattctaatccagtatctcaatttccttaggtgaagtaacaatctggactaacagctgaccttgagaagcattcagtctgaggctacttcacagaaggtgtttttccttccccctttgcaagggcccaaataaagacaaagacaaccaatgttactgagcatggtggttcaagcccctaatcccaacgacatcagagactgaggcaggaggattacttgaggtcaggagttcaagaccagcctgggcaacacagcaagacatggtctctacaaaaaaaatttaaaaactagccaagtgtgatggcacatgactgtagtcccagctacttgggaggctgaggcagggggattgcttgagcccaggagtttgaggctgcaaggagccatgattgtaccacttgactccagccagggcaacagacagagtgagaccctattgaaaaaaaaaaaaaagacaacatttgaagatgatccattaaataaggcaatccttcccaaagtgcctcaagaagaccaagagagtaagttaatgcaaaggaatagatgaaggttagtgacatcaagatgagggttagcgaatatcaagatcagttagcaagacaaagcacagatgatgggaaacagcaaaactggaaggaatggattaaaagattacctggtttgttcctgggtctaactcatgacctcgactttgttacttagccaacaaagcagatgaaagccacacccacaagattccctaacctagacttctctttggtctgttttgcctgttgggtactctctagcaaacaaatggtcttcaggcaggaatgataaattgttcttaactctcacgccaacttttttttttttttttttttttttgacgcagggtcttgctttgtcacccaggctgcagtgcaatggcacaaacatggctcattgcagcctcaaccacctgggctcaaagtagcagggacgacaggtgtgtgccatcatgcccagctaatttttacttttgtagagacaggggtcttgccatgttgcccaggctggtctagaactcctggtctcaggcgatcttcctgcctcagccttccaaagctctgggattacaggcataagcccatgctcccagcctcaggccaactcttatgcttccataaaagctgtctggactagaggatagagaagcatcctgaagcctggtggaaacaatgacataaagaattagcaatgtctcccctacaaggtcatggtcagaggatgtgaacattgtatcatgtaagtgtcaggtgataaaacttcgaatataactgacatcttcaggaaggtaggcgtttcccgtcttcccaaagatgtcagttacattcgaagcccaaacagtctaggctccccaaaccttaccaggaagctgattctaatcttcagagcagtgcttctccccaaaccttaccaggaagctgattctaatcttcagagcagtgcttctccccaaaccttaccaggaagctgattctaatcttcagagcagtgcttctccccagaccttaccaggaagctgattctaatcttcagagcagtgcttctccccaaaccttaccaggaagctgattctaatcttcagagcagtgcttctcccaattttaaatgcttgcagatcacctgaggcccttgctaaaccacagatcccatggggctgggccgattccaacaagctcccagtgcacaccaaaagtctagaccacagaccacagcatgagtagcaaggttctaaagtttcagctacttgcccagacaccatctctgattaattgtagttctgctgcttgctagcacaaaagggtaagatttacagttcttctgagtaaggaacaatacagacagcaattttctacttaccaaaatgcttccatgcccgtcattaagtgagataacaagaaaaatcagtaagctaaaggaaacacctataacagactcaggctcaattagtattgtgaagaactggcttattgcaaggctcaatggcttctttctctttcccacttatctggttgattttggccaactctgtactccaacataaccatagtcttcctaaagataacgaccctaatgcaataggtagacactggtaagtaagtgcattctcctcacatttcaggtactgtgctagatcttatataactctcatttatttctgggcagcatttcttatctaaaaataaagttctattactggaggccaagaatttgaggctgcagtgcactatgcttacacccataaatagccactgcagtctagcccgggcaacatagtgaggccccatctcaaaagacagtaacaaaataaataaattaaacaaatagaaatataaaatattttcttctctcagattagcaagaacttccataacatcaccaaaaaaggcacatctaacaaatgaaacccccaaaatttagtatttggaggatgcaataaataacatcaaattttagtaagctcagtatcttatttaatctggtgcaagaaattcaaaggctatctactaacggtaataggtaatatggagagacagaaaaagtcagtcatatcacgcaagagagcaagactacctgcgggggtctgtgaagacaatattaggatctataattacacatggcattaagcagatggattactatctaatttttttctaaactgacacccacaaaatggaaaatagtttaaataaaattctgctaaggaactataaagtgaatatacaatagtcaaaaacatgtgcacacatgccagcaagcaaagctgacacttctcctctcagtgtgggtggttcagggaggtatccgcagcccacacagagccaatcagattattttccagtggttgtcacctggaaactgggagcaatggaacactttcccctggacatgttcaataaggacaaagtaaatttagggcttctggcagaattctttctttctagatgagtgcaatgtgcagaatgaagcaaaacaaagataagcagtgatgagaaataaggggacaaaaacggaaggagagggaagggaaagaaaacaacagggagaaaatgtgtgtgttctgatagttcttagtccatcatttcaatcccctaaggcccgggttctatttctgtacattctgtgagctgccccacaatgcctccaaactacagaatacaattcttccttttcatttgtgctagtttcagttggcatattagccaagataggctaggttatgatgcagtaacaatctcaaaacctgagtggcttcaaacagcaaaggttactactgtcccttcatgttcatattcttcgtgcattaaaaaggggctcttctcggcattgtgctcattctagaaaccagcggatggagaagcaactactgtcattctctacagcagaggaaaagagttttggagagactcacagcagccattaaatgatctgatacagaaatagtaaacatttccactctgagagatacctgcaagtgcagttcagccatgtgcccaggaggtagagagctcgaatacttggtggtgatcagcatgtctcccacagttgggtttctgtcacttgcaatcaaaagaattctgattaacataagccatgaagagaaatgagactagaaagacctgtattccaattgaaagagaaaatgggttcatggagataggtagatagcagtagaaacgcatctcatatttggtaaatggaagccgagttcaaagcttcaaaagctggaagtcagtttaactgtttaactgtataaattggaattattacatgcaactccaaaggcaggttcttagcatctgtgatagctttctagaagtgggacatgcatttttaaggggagatggtatgtgcaaattttatcttattaaaagccaattattccagttgtccaatatatttaatctacccaagtagagtgaccatggattacattccaatttgccctggagagtgctgatgaatgacaattgtttaaaaatttatagcaccctttttcactctgaaagtttcccagtttgggtaataaattatactgtcatcctaactataactcaggctttgtttcagaggattgatgatcttgcctattcctacattttaaaattcaccttccattcctttcatggaggagccctacacttgagacaaactatgctactcatgggaacttaaatgcaccattaatttacaccagcagcactctgatcatatttctctttcctctgtctagaactctttcttatcattgtgtttctggtgactttcttctctttatttaatattcaacacaatggtgaccttttctgccctcctgcaagacatatttcttcctctgtgcattcataataccttatataactcacagcccttattgcatttgtctaacaatggacaagtattatcatattatcctcccctaattcaaacctttcaatggctttccaagtttcttaaaaacaaaactttaatgtggcctggaaatgctgcaaggtcttgcccttcatccctctccattctctcttccctttacgtttgtactgccaccctttgtgggcaccaatctcccctgtcacaaatatttgcagagaaactcttccttcgtctgcttaaaccttgctcattcttcaaactttagctaatcaagacttcagggaaactttctctggactcccttcacagcacttaagaatgtgcttggctgcaagtaaataagacatgactaacagtggattaagcaaataggaattattactattacataacaagaagtctgaaagtgaggaattgcagcattctttgtttcagaaaatcagtaaggccaggaatgatgtttctgctattctgtgggccttttcttataatcctaagttgtcttctgcaactccagacatcacatccacattcaaggtataaagacacgtagaatagcaccaccagcctggtttgcccctcttttgaccaacatcctccaggagactgcagtttgttttgttggtcagaactctgctatatggatgccctaaccctatgaaagtctggaaaaggaaatattgttgtatattttgccaccccaaacaagattagccttaataagaatagaaagtttttaagtaacaggctcttccagaatcaaatccccttgtaaattcccatagcacaaacacctcctgtctgtttcaatttttcagatgtgatgttacatttatatttatttctcttattagactataaactccaagggctcagaactagaaaaattgttttttgattgtatttccagagaaatatgacttttggtagaggctcaatatttaactgttgatggaataaatgagttaatgcgctaacatatttcctcttttcaagggttaagtgcaagcactattctctatgccccaggttccaatcatgatgttaagtctcattaaattaatgaattaaataatttgatcaagttattttatcagagaacacaaagctttaaaagaaacttctgttttcactcaaaacaaattatttacctccatacctaaatactttgcattcttctgaagtttggtttctttattaaaaacaataacaagaaccaaaaactgcatcaaaactgtacccagaggagccaaaagctactgtattatcatgggatacgttattggtgatgaatggctaacaaatgcaggactcaacagccaatagctaaactgagatgggaagatcaaagcctctgtaaagtgagagctttctgggctctactccctgaactgaaggaaataaacca

SEQ ID NO: 725 - DNA, 139561 bp, Homo sapiens
ggaattacgatagatacagcatatgacaagcacacagaaaatatgatattccccccgctatgtaagctctacctctgatttgcttttcgtttttctttttcatttggagtccaaggcttaaaaatgcatttgcttcttgaaataattttggaaatagactttgcaacaggtagttagtacctcatataatacagtcttcctgatccttagtttctgagggtgaaaattaatatacataacacctataatagatactaaaaataataatagcactactagttactgaagacttattctaagccaagcattggactggaccagggtgtacaaaaatggaaaaatcacaggcccaaatatcttacagagaaattgggtacaaccaccctatctagacttggaaattctgatttggagatcgccttgggtgttttctatttttagaaataattattcaatgccacgtgattttaaaattattaggttggtgccaaagtaattgcggtttctctcattacttttttttttttttttttttgagacagagtcttattctgtcacccaggctggagtgcagtggcgtgatctcggctcactgcaagctccgcctcctgggttcatgccattctcctgcctcagcctcccgagtagctgggactacaggcgtccaccaccacgcccagctaattttttgtatttttagtaaagacagggtttcaccatgttagcaaggatggtctcgatctcatgaccttgtgatccgctcgcctcagcctcccaaagttctgagattacaggtatgagccactgtgcctggccctctgtcattacttttaacggcaaaaaccacaatgactttggcaccagcctaataacccaaaaggaataaccatattcccccatcaaaagagaaacgcttctgtattattttacaccactctatcttattcttggtgttactgatttgcttttttttttttttttccattaaaggcaccattggtgtatccatgtggtttgtctgttctgaggtttcattcatatcctgctttttttacaacagcttttaattttaacatgattttttgtttattgctttatttccatcctgtattagtctttccaggctgccataacaaaatatcaaagactgagtggcttaaacaatagagatttgcttcttagttttggagactgggaatttcaagatcaaggtgtcagctaatttggttcctggtaagggctgtctctggcttgtggacagccaccctctcactgtgtcctcacgcggtccccactctgtggagtctcttcttataagggcactaatcccatcatgggggcctgccgttatgacctcatctaatccctaagtgcctcccaaagcctccatctccaaatactctaaccattgcattggggttcagggcttaaacgtgaaattagggagaacaatcgttcaatctataacacttcctatattccctagggagagatttagagcattcttacttttctaactaatataagaactttgggccaagaaatgtgctttaaatattgtttgggcaacatatggattccttccttaatccatatttttatgtaagaaaaattttttttcaattgacacatggttgcacttcattgttttcattcatttgtaagcctacttctcttcatttaacacctactatttaccaagcctgggacaaggccatgaagagttagaaaatcaaaatacctcaaggaaaaaaacaactggtggtaaaggagaaatgtaaaccaatgattaaaatacagtgttccacgctcaacaaggagagaggttcctaggaaatactggtgtcaagtaagaggaattcaaatctgactaatgtggttatgaaagacccttataaaacatcccctctctatcaatatattgggcattatttgtatgtctcttgttggcaacctgtaaagaaaattgaatgttttagatgcaccaaatcttgcaataattttcctatggctaaaagaaaaatgaaaacattacgtttgttggcatggcttgattttcttcaaagaagaaaagaatttgaagcaaaatcaagaaagaaaaagcagtagctgagaggagatgcctgaagttattctcgctgctgacctcttctgtttgccgagattccaaccttactttttacacttaaaaatttgacagggaggttttttcagaagttccctgaaggcaccttctgagtgcaaacatagagtagcctcgccacccctgctgagatcatttttctgttcagatccatttttatgtgattgttttcctgcttctggtttccacctagctgctgtttttaagtgtcctctgttgtaccattattcacaagttgatgttccttgttttattttctaggttggcagccttccctgcatcattattctgtttatatcattagctgcagtgtaggtttgttgtgttacagcatcatacgttatttgctttgcaaatatgactcactgtctctgactttcatcacctgtgtttgtgcgtcctctgaagcgtttataagcttatcataggcctgcagtgttgagaaacatggttctaaaaaatagtcactaaaaagagtcaatagctactgcatctctccctgacattccaagcgttctgtcagatctaggaggtttacgcttatatttactccagacttaattttttacttttccttgactaatttttttaggtttctttactcaaaccttctttgatgtttgaggttcccctcaccatcgctcatgaattttggaaggccttggctcacatcaggaactcatttcaccactgtccccccagtaatgagtgttgaattaatggttcttcccagatgtgcttaaaagttctttaaagtaccttctttattcactcatcaaaaagtttgtcacttactctgtgctaggggatgttgtaaggtgaggacagcaaagcccctttgttttaatgttgagagcctggagggagagagatttgatgtttaaactcatttgataattacagtgcaatgtggagacggctttcagagctcctttggaagcaaaacatcaccaggtctggggaaaaccaggcaaagcttcaaagacgatgttgtgcttgacctggttctccatcaccagcatacttaccattttacactgtgacttgcacaataggacagtcatacgattgatggacagatgtcaacacttagtttgggatcgcctcaaatcagagcctgggatacagacttatgtgcaggaacttatttgagaaatgatcccagagagaaaaagtgagggagaagaagagcatctggaaaatgaaggaaggatgggttatcaaaggcagctactgctgtgagtgactggtgtttgatcccaatccctggggaaactacggaaatgcaactcaaaactgtcttcctgaaaaactaaggggggaacggtcactccccattagtcaagggtggctccaaagcaccaactcccagtattttagggttgtgcatgtgagtgggctgccctctctcacatcagagctacctctgggtgaagcagagctaaaggcagggcccaaggaactgccatcttccacatgcaagaagttgatcaaagtctgtgtggatctggccctggcaacagcagctagggtataaaggggcccagaagatttaaagtgatgtagaagaggtgttcaatacagtggattcaatttctttcatgggataagatatagggacctatgaagttggttacatcttgcaggaggcagcagagaaaactcccaattagaggtctacacagtgaaatgctggtaaatattaaatattttaacaaccagccctagcgggggaaaaaaagccctgctgtgtagcattggccaatttccacgctgtaaatactcccatcgtgaccaatagcgggttatcaacatgacatcactgaatacagaagtgggaagagatgtgcacaatcagctatcggagtcagtgccccatacgtattccctggactccagttccacagagttggctgacaatacgatggcctgaagggcagattccaccaggcacagagctcacttttgctggtctcctgtgtgcagaaaccctggctatgtctgtgtttgacaacctggtacaagataactggggaaaatctcagaacattgagaattttttgctgtgaggctatataaagaaatcaatatccaggcagaacctctctcagcagccctaggcaccaggcctgccttaggtccattgctgtataatccttttggtctctgttttgctctcacttcttggacaccctatgcccagctcaagtccctcctatgtacccccagcactctattacttccaacacaaagatatatttttttattgtccatattttccataaagctataagctttctaaaagcaggtgtagacatcatgttcagttttatatccccaacagttaatttacaagctcagtacccaaaacttcatagttctcctcctcccctatcctgcagggaggagtggtgtcaagtgctagatttacccctgagctaggcagttgtggtctatcaaaagcaaaagcccttagctatgtttctcaccatccatcattttagtgcctgtttagagagaatcataataaaagcagagagtagcagtgaaagattgaaatatccacttcaggcaatgatagaaaagccatcaaaagggctggacacgggggctcacgcctgtaatcccagcactttgggaacccgaggcaagtggatcaccaggtcaggagattgagaccatcctggctaacatggtgaaaccccgtctctactaaaaatacaaaaatcagccgggtgtggtggcggacgcctgtagtcccagctactcgggagggtgaggcaggagaatggcgtgaacccgggaggtggagcttgcagtgagccgagatggcaccactgcactccagcctgggtgacagagtgagactctgtctcaaaaaaaaaaaaaaagttcaagaccagcctgactgacatggtgaaattccgtctctatgagaattacaaaaaaattagccacacgtggtggtgagtgcctgtaatccctgctacttgggaggctgaggcaggagaatcttgcttgaattcaggaggcagaggttgcagtgagccgagatagcgccactgccctccaggctgggggacaagaaccaggttctgtctcaaaaaaaaaaaaaaaaaaaaaaaaagccatcacaagcctcttcatgattacagataataggccctgttggagttcagaaaaagccaagaacacttcccgaagctgcagaagaagaggtgctcattgtaggatcgccatgacctgtcagtggctcaagacaggaaaaggaggccgggcgcggtgactcacgcccgtaatctcagctctttgggaggccgagatgggcagatcacaaggtcaggcgattgagaccatcctggctaacacagcgaaacccgtctctactaaaaatacaaaaaattagccggacgtggtggcaggcacctgcagtcccagctacttgggaggctgaggcaggagcacggcgtgaacccgggaggcggagcttgcagtgaaccgagatggcgctactgcactccagcctgggcgacagagcaagaccccgtcttaaaaacaaaataaaaagacaggaaaaggagagtggaattgagtaggaggaaagagagaagcagggggatgtggacaaaggatgataataatatgacaataacatacagcaatgatgataataatcaacacacattgagcattgaccatgtactggacactgtcctaaacattttataagggctgtatttcatttaatcctcacaataaccatgagaagtagatgttattatttatccctatggattacagaagaaaatgaggcacagaggagtaaagtcgcttgcctgaagtcacacagtaagacatgaaagacaaaaacttaaacagcttttgaaaattaggtgatgatattctgtcataagctatatatttcttctaaatcttacctcctctgcacttcttttccttgcctctctgcagtaaggattataaagatttcttggcaggtgcagtggctcatgcctgtaatcccagcatgttgggaggcctaggcaggcagataccttgaggtcaggagttcgagaccagcctggccaacatggtgaaaccctgtctctactaaaaatacaaaaagtagccaggcgtggtggtgtgtgcctctaatcccagctacttgggaggctgaggcaggagaatcacttgaatccaagaggcagaggttgcagtgagctgagatcgcaacaccgcactccagcctgggcgacagagggagactctgtctcaaaaaaaaaaaaaaaaaaaaagacttctcttgagctactgagtgctgagcactctgcctgtatcttttcgtgcaatctacccacaaccaatcaaactttggtaggtaagggggcaacggttcagagaggtttaggagcttgtccaagatcacatatctgctcagtggaggacctgggatttgaaccgacatcactggggctctgaatttttccatgcctgcatacattcctgcccttcaacccagtccagcctgctcgccctcccttcttgcctcgtaagaacggctcctgcgagaacaccacaggcctatagaagaattcagtttgaaaccacttttcaagaatgtgacaacagccaaattgctagagagggcagttttaggaaacttctcatttctctttagaaaacaagaatgccctttaaggtgaaattcaattagagttggaatattatttgcaaacatatgaattattctcataagggaaaaaggcatccctgaagtcctacttgattccctaagactctggctagggccccagaacctgatgtgtaagcatggatagcatgtctgctttgaggaaagagaaaatgaaaacttgggaaatggcagctgctctttttctcgtgaagggacatttcacagatgtccagttaaagctaaaaaacgagcctctcaggatatgtttcacaaacatgaatcctagtagtttggaaattcattatacagtatcacttcctaagaatacactaggtggccaggcgtggtggctcatgcctgtaatcccagcactttgggaggccgaggcgggcgaatcacaaggtcaggagatcgagaccatcctggctaacacggtgaaaccccgtctctactaaaaatacaaaaaatattagcagggcatggtggcggctgcctgcagtcctagctactcgggaggctgaggcaggagaattgcatgaacccgggaggtggagcttgcattgagccgagatcgctccactgcactccagcctgggcaacagagtgagactccttctcaaaaaaaaaaaaaaaaaaaagaaagaaaagaaaagaaaagaatacactaggcatcaaaacatttaaaagactctgagaagccctgcattaaagaaatctccttgacattagttaagctactacttctcaaaactgtcagtgcatcatcataattattagacatttgttcagtatgtgctatatgccaggcattctaagagcattacgacagtacatctttaaacaaccccataagatgcaattgctatccccattttaatagatgaggcaaaagaatagagagattaaataactttcccagagtcacattgctaacaagtggcacagcagggatctgaacccatgcaaccttgcttgtaaccactacatgcaaacatttactatcatcccacaggcagggacccagaactggtttgcagtaacctgccagtgtacaccaactgtaccacccagtaagaccagtgttcaaaccagaatcctagctgattcacaatgaaaaacataacctccatctcagaagtgcaatatcgttggttatcccagtgtcccagttgggaagaaaaaggaaaatacacattgtaagcagccaaggtccttggttatgataagggagcagcaaaacaatgaggtgattggtggctttaattacttgatcattttcccctactatcagccctggggagaccagaccttctcatcctgtggcatagtgtcctgtggggtactaaggattcagtacttctcttaaattcataaaaacaggcccctgcccaaggccctgggcttcataggaccctatatggaccctccctcggcctcacccttgctattctacaaggccaagaggatataggcctatccaagacttcagcatcccctgaccaaatggccctgagccctcttgcagtgtcttcacaagcttcttttctaggccatcctcctgtgggtcaaatgtgccaccagattgcacttcccaaagcctgaggagtggctgtttgtgggaggtggggaaggagcttgcacgtgcagactctgggtccacacgagtgtacacaaggcaccccaaggggatggatggggctgagatatgaagaaagggactccccagggagtggggtcagctgtcctcactccccacctctggcatagaactcgggaggatgagaattccaaatgggaacctggtcctcctgggcttgatgatggtgtatttgtcaagggaggaggatagaaatagttcacttaaaacaaactgacggtatgttaggttgatttatgtccactgaatatttagacatatgacacatgggcccacatttgtactctttgtagtctcatcttggaccccacaatataaggggtgggcccaccatacctcttcagttcctctaaggcagtgtgacatagtagaaagacaaacattcagtacacatttacagaatgcctacattttaccatgagctgcctagaaagagtcaagcctgagttaaagtcctgactctaccacttcccagcataagtgagttctctttagttgttttcaacatcagttgccttatcagtaaagtggggttgatcaccctcagcaagataccatcaaggtaggggtgaagttaacataagtaaagcgcctgggattgagtctttcatataatatgagttcaataaacaaaataacatgatgaaaaacacaacagaaatgggaaaatgttaataatggttgaggctgagtgaatggggacaaggtggttcattatacaagtctaccttgttttttttctgcacccaggctggagtgcagtgacatggtcacggctcactgcagcctcaacctcccaggctcaagcggtcctccctccttggcctcccaaaatctactttatgtttattattattattttttacaatagaatgaaattttaaaaattaaacatagcatccaatttcaactggcttattctcactggcaaggcaaacatgttgctatttctcctattgtaaagtatctcttgacctcaccccacctgatagctattgccttagtctgctcaagatgcttgaacaaaaaaacaaagactgtgtgcttaaacagcagatgtttctttcccacagttctggaggctcgcaagttcaagatcaaggtactagcagattttgtgcttggtgagggctctcttcttggcctgtagatggccgtcttctcactgcttcctcatatggcagagacaggaagttatggtttttcttcttcttcttctaagggcatcaatcccatctcgaaggcttcatcctcattactttatctaaacttaacgccctcccaaaggcctcaccccctaataccatcacatcaggtgttacggcttcaacatatgcatttgcgggggtggggtcataggcattcagtctatagcagcttttgctgtttctccgatcccctttgctacaaaacatttagaaagagttgtctatgctttatttggattaaatgatttaattttaatttcatttgaaagtaatatttttattgtggcaaaaacacataaacgtactgtcttaaatttttaagtgtatagcacactgttaactatatacacaatattatataacacatctctgtaacgtttttgtcttgcaactctaaaactctatacccattggagttgtctatgctttttgtctctaattctttccttctattctcatttaaatttagtccaagcaaactcctgcccccacattctaccaaacccactcttgtcaaagtcaacagggacccccctcccccaacaaagttaaatccagtgatcagctctcgatcctcatcatcttgatacagagacccccctccctctactatgatgcttccttcagttggcttctaggatgcccttccttgcttgttagtctccattgttggttcttctccttgaccgctttatcttgcaatgtcccagggctccgtccttgggactccactctgggacatgttggcatctggactgggccaggttattctttgacatggttggagggggacagtctatgcataaatgtgtattgtaacaaaggccaggagctgcctaagacaatattggacatcagatataaacagtaagtttaagatcctagtcagacatagaattaggacataaaaatacaataaatttggggatgtaagttaggggaggtgaaagagccaggaccaactctacgaacctcatgaggatatgcagggctccctcttggtagagaggctcttattcagcaacaacattgactgataaaatgcctgaaggctgccttattttctcaagctctttggtcatctgttcttttgaaaaccaaagccactcactcacacagcaagtattcagagagcttttactgcagcccagaatcacattagacaatctgaattacaaaatagatgcagcgtatgctggagctggctcataccagctcacaagagccaattgttaaataatcaggaattttgtgagccagtcattcaacaaaactattatagttattaaattatataaactaatgatttaaaatatgtattaaaaacaaatggaataatcatttataacttacaactttttagttatattctcatttggctatctatgcttttgaggttgtatgcattcattgtacctgtatggtggagtactataaaatagcattaccatgcattgtgtcccaaccccactttcagttatgtcattttggtaatttgaaaatcagccatggtgtgagcattcacaccaaagaaatcagcaaacgctacaatccgggcttgatttatcacttggtttattgtgtagatgaaagaaagtaatggaaaaaaatgtaaataacgcaaattaaacttgaaaatacaccacgtatattactgaagctgaaagaggttacagttcattgaatgaaatttgtatgatggtaagaaagagtgttaccatagatcagttatcagtcacgtatcagatttaataacaccaaattgattgggtaaagagttgttgggccggttattgaagctgaaagaggttacagttcattgaatgaaatttgtatgatggtaagaaatagtgttatcatagatcaaatatcagtcacatatcagatttaataacaccagattgattgggtaaagagttgatgggccggacacggtggttcacgcctgtaatcccagcactttgggagactaaggcaggcggatcacctgaggtcgggagttcgagaccagcctgaccaacatggagaaaccccgtctctactaaaaatacaaaattagccaggcctagtggcacatgtctgtaatcccagctactcgggaggctgaggcaggagaatcgcttgaacccgggaggcggaggttgcggtgagccgagattgtgccattgcactccagcctgggtgacaagagcaaaattccgtctcaaaaaaaaaaagagttgttggattggaatgcaactcaatttgtcaaattgtgattgaatcgtaaccatagattggcaaaactcaacaaaagcattctctggaaacagactacataggctttacagtaaagagtattgtatatttttattaccattcgtaaattgtgtactacacatcctctatgtcagtaaaaaattatcataaatgtatgcatatacggattttttcagagagtcagttattaaacatttatctgcacaccagtggctgtgagcatgatcttgatacacagatgtttagagtccatctggggggaaacaaatggtatggataaaataagaattagaggacaaggcagtatatgacattgtttagtgtagggaaatgtcacagaaggcctgtgagttggtctacctatttgtgagtcaccaagaaggcttccccagaggagtgggacttgagcaaaaccttgaaggaagtgcatgggttaaaactgcataaggaaaggcctagaggcaggaggccctgttgttggtgttccatcactacagcaattgcaagaccaagcctgtgggaatgaatgaaccaatggagaactaatggcaagtgaggttggctagaagacggagccagatagagggtctcacaaagcagcagctgaccctgagacagagaatcatatacaagatgtgtatttgggaccccagaacacactggtggaagagatgggaaagttagacgaggaagggaagacaactcctgcgaagtgcattgtcaagccagctactcctgtgggtaaatgaaggctaatcctactggggcgctatgagaagcagtgcacaacacccagctcggatgaggagctggcatacttaagcatcaactcccaaaagtcattcattgagagctgttctgggaatgcggaacattaattccctggcacttctggcctgctgtgcaggcagcatcagcaagagaaagccttcagacgaagaaatgggggtagtagcacggtagggtctgtacgaaagggggccaagggcagggaaatcacaacctctgctgtaattcctggaagtcagtttgggtttcgtgcactcaacagtggggactcactgtgtgttcttgagcaaagaagtgtccttggaaatgctgcctcctctagaactctccctgcaacagcgtccttacaacatggtatggcgcaaggggctcaggttcagaagatcagaattcaggccctacctgagccacgaagtagctgtatcgttgtgaagctcttgtcttctccgcttttgtaaaacaggaatattactactctctctccactgggttttttgtttttgtttttaatttttgtttatttgttgttttagagatggagtcttaatatgttgaccaggctggtctcaaactcttggcctcaagcaattctccccagtcgctgggactacaggcttgcaacattgtgctttgctcccattaagttgttctgagcgttaaaaatatacataagagcgttttgtaaattgttattttgttatttttatcacctatagaatgtcaaagaaagaatgaggttctctaaagaatctatgctggaatcgtcttttgtcattgctttttaaatttactcctacagggagcctccttatactacactgcgctttgctcttttttttttttttttcctaagtcagacacatcttcaaagcaacccctgtcattctcccactttgttgttggcaaagagtgccctctgattagtagcgattgcactcatggtaatattagtcattttcacagcaacagccatgccagttgggagttctaatagacattgttttgacttctaaaaaaatcatctttgtgtattacttcggtgatcaaagtttattattcatccaccagcacttgaaggatttagataagagatattgttgagttaatttgtcccttggcctaatggagcctctgaaatataagctagattctcagagtcaccatgaaagcctcacttcattaattgaagaccaatctagagagacgataagaggggagaaaaagaaatctaagctcatcttcccagttagcagtaagacaagagacaggaggtaggaccagaaggggagaaaaattggaagcaacgaaaaaggaaggggcaagccatcctgagctctaagatgtagccattatgtggaaaggcatagctgtgctccataatttcccggaaattaccttttattaaagtactgcccttaaccacattacctttaatattgaaaaataaaaattgctaaaggaactcaggtttcagtgcaaatgtaacagagataattaaattcatcctaattcagtcccaatgattcctgttcaacttcaaatcattgcaattaagaaagcactttttcattcagctcagagaataaaccatagtttctttatgttttgatttgtttgtagctgccattaatagccagtttacagggctacagataagaaaacggagactcgaaagaactggtagaggatggagtagcgattaagattctatctgaataatctaaggttccctccactctgctgccttgcctttctggttccagtaaattccagagaatgtaagagagattattaccaaagtacactaaagaggaataaggagagtgtatgatttcttctgcctttgaggggaagatacatgatttacaaggattctgaatccccagacctccctggtctttgcttaggggagccccagagatggaaatcagttgaagccagacactgaagttctgtatatgcaagactctcaaggtctgggctgccccttcccttcaccctaggaaaacatcaattattcgtcccccaactaggcagggaaatagggaaagaaagagcagagacacagcctgaatcttttctatcaaaaagaaacagtttgaagaattccatatccaataaatgtgtgaatggggaggtgtcgggatgcaaattaaaggcattaaggaacttgctaattggctcaagaaactggaagtttctctcactgacactcaccagctggcccagcaagctgtttattctgtggtgtctcagaggccaggaaaaggtgatacagtgagcccaataagctaagtactgattcaaagatttagaaacatttttcttattacatcccaattaatggtgctaccatccgtgcaggaaaccaaggtagaaagttctcctcagcaggcacatattcaaacacatatatctttccttcttccccccaaaagtctcttgaatctagtcctttctcttcattccacagggcctgctgtaattccacccaccatcatcctgccgttagactccttcactggccacctgtctccctccctccttgtccccttcctcaacccttgctctcctcatgtcgctgtgatcaacactagaatgtcaggccccagtgtctgctgggagggtgcgacccatttggctgatccatgctgtaaggaggatggaaaaataccatcttccaattggttctcaatatccagcttcatcccggaaactgtaagtttaatatggaaaggcaatgaatgcatcagccctcccaagctgatcattcctaaatcttactttgcccatttttctcctccttccaactctgagctccctggaggaaggagccttcccttattgatctcaaggttcagaacgcatagcagaacacccagcctaagataggctcccagtaaatgtttgttcagtagaataagttctctctctcctgagcttaccatggctattagttaaaattaagttgctcaggaagcaggcaccatccatcattccttcctatctagcttcttgtttattcaagagagtcgtggctatgtaaacagtgctgaggcattctgcagtagaggctgtgccaataggggagaggaagtgcattgaatccaactaggcactaatgaaaggctgaaagtccttctggagttttgagggtgtgtgtgtgtgcatgtgtgtgcatgcatgtgtgtgcacgcatgtgtgcatgtgcatgtgtgtgtgtgtttcagcagctttctctgcaacctaggtgtccaggggaaaacagagagccccttgtgcttcctgatttgcaaaccagaccggtgcctttcattgacaggtgttgtgcctagaccaggatgctgttttgattggaaaggatgctggactgattagttgaaacaaaacattctccaattaacagaaatagaagctggagctggaatgtgaagtgttcagcaacagtgttgccaggcagcctatttaaaattaattagaggtagagatacatggaactgaaaaacaccacccgcttccctgcttaagagagctggggtaggatgaatgatgtgggaatttgcaagcgttactgagcgagtctgaactgccttctcagatcccattttttcaattggtggctctcatgcagatgagtgagtcaatgtgtgaaatagaggagagatgactgtgatagagaaggacaaagaaattacaaaatatccctcgctttctaaatgcccttagctcctgagtttgcagagcaagaattcagaaattcagaattcacagagcaagagatacctattactattaataaaggttcagtatatctcatttatctaaaaaacaaaccttggccgggcgtggtagctcacacctgcaatcccagcactttgggaggccaagggaggcagatcacttgcggtcaggagtttgaggccagcctggctaacatgtgaaaccccatctctactaaataaataaatagccgagtatggtggtgggtgcctgtaatcccagcctcttgagagtctgacatacgagaattgcttgaacctgagaggcagagattgcagtgagtcaagatggtgcccctgcactccagcctgggctacaaagactctgtccaaaaaaaaataaataaataaaatcaaaccgtatccggatacaaacaaaattccagaaggaaaagcaaagtgattgctgtaaggattgcacagagctgccaagcattcacccattcaaacaggacctagtcagtccctggaaacttttgcttttcattcaagtctggccattgcaaatcttggctgtgtctaatctgatctggtgtgagttacgaatgttcaaaaggtggaggaaactgatagaggcaggtccatttaaaactgccagaagtgatagcctgtatcccagcaatgcaggagaaggaagcagatgagacctccaaaatgccctctcaaggactcagcgacacatagctgccatttttagtaggaacaaaacaactccacacacctcatcagcatttgaaaacaccccctgaattatacttagaagactgaatatcgaaatatgtatgtgttcatatgtcaatatatgtatatgaatgtatataatatataaatgtgtgtggatatagtcatgctctgtataatgacatttcagtccacagacgtttgcttaagacagtgatcccataaaattctaataccatatttttactgtaccttttgtatgttgatgtgtttagatacatgcttaccattgggttacaattgcttacagtattcagtccagtaacatgctgtacagatttgtagtctaggagcaataaactgtaccatacggcctaggtgtatggtaggctataccgtcaaggtttgtgtaagttcactctatgatgttcacacaataacaaaaccccctaaccatgcatttctcagaatgtatcctcatcattaggtgtcatatgactgtgtgtgtgtgtgtgtgtgtagtgtgtatgtgcatatatacacacacacacatacatacatacatgtagataattcatcagaagttaacacaaatatccatttcattagatcagcagtggcaaatcagctttatctcatttgccagtttcattgcctcgaagggctacctggaaatctgtttgcacaaggactctgatgccaaatcttatcttaatggtaagaagggccattactgacaggaatagcatcatggggctgggcaaggaagcaagccagtctttctttccagctggaataagccatagcccaagaacactgtaaatcgggactattcctctgactcctcatggaattgcttttactgaacaatatgttgacattcccctatgtttgcactgagacgtgttgcattaagaagcagctctattgtgtatctcatacgggtgcttgataactttatccatggaagtgactctcctttaggagaacccatggaagaaatacatccagtgggagagaaaactatttctcttgagaaatgtgtttgttctgatcttctggggaccacagatcctttaattagttacattcctatttttgcatcggctgtggaagtcagatatgcactctcctgtaaacctatgcaggacctttcgtatctattttatctgttcctcttacctgtgacttaattttatgtctctactaatattttccctttgtcctaatttggtcactttatttgtgacttttaggcacttgtactaagtcacctcaaatcctacttgaataagtaacaatcaaggaaacttgtacacttttttttctttttgagacaggatctcactctgttggccgggctggagtgcagtggcacaatgacagctcactgcaacctctacctcccaggctcaagcaatcctcccacctcagcctcccgagtagctgggactacaggtgcataccactacacctgggtaatttttataatttttttttatggtgacagggtctcactatgttgcccaggctggtcttgaagccctgggctcaagcaattctcttgcctcagcctcccaaattgttggaattacaggcatgagccactgcattctagccacatatactttagaaaaacctttttttcaggttagcacctactgagacaagttactttctggaaaatttaagcatgtggaatattttatttcataaatgaagaatctctcgctgtgtgagtttgggatggcgggcgggggtggaggggcagtgtctgtatgtgtctctgtgtatctgtgtctatgtctgcgtgtacaaatgcatgtacaacatccatgtggttcttattaggtcttggaattaaaaggtactctgttcaagctgagtttctcagagccacagaattatagtaattaccaaggccagttccatcaaggcagcagagtcacacacgtttcaaatgaacagacaaagggagcctaagccactgttagaaatgtgctgcttattaatggctgcaaaggaaaattcttttcctgccttggcctcagaatgcaaggagattaattcttaacaatgaaaagacaggcagctgtcagcggcttgtcacagctgggcatgtgatgaagagagaggtgctgtgacatgtgccagcaaggacaggacttatgcagtggagaagtagggaaacagcctcgaaaatagggcaaagggagaggacggtattaaagtgaatgccactctatgtgcctggcagtgttttaggcactttttagaaattccctttaagcttgcacactcccaaacgcttcccatttgatggataaaaacggtgaggaacagagggctgaaaccccctccccatggagccaggatttaaacctaagtttgcctgactttccaacccatgccactctcactgtgccagtggccctcaaagtgtgcactgtgaaccacctgagttggaattcctggggagctttataatgcagattccgggacctcaacccagacctgtttgttcaatcttcgttgacgtctacaagcactaaatcttcagagccaccactgtaccttgcagcctgttaaaagtcagcagttccttgccacagtggtgggctttggagagttctcccagctctcaattcctccttcagcaggagaccctgcaacctgtgtgaccccccgaacctcggcttctggaggacaattctgaacatccgttaaaaggaataactttggctgggcgcagtggctcacgcctgtaattgcagcatattgagaggccaaggtgggtggatcatgaggtcaggaaatcgagaccatcctggttaacatggtgaaaccccgtatctaccaaaaatacaaaaaattagctgggcatggtgccgcgcacctgtagtcccagctactcaggaggctgaggcaggagaatagcttgaaccctggaggcagaggttgcagtgagccaagatcatgccattgcatcctagcctgggagacagagcaagactctgtcatggatgaatgaatgaatggaataaactcaggggcccagaatcaggtcttaaaatcttggtccctggaaagattgatgttaacaaaattaagccagcatcctcacctatcaggttttttctactctctgttggacttctgtagaatttctttggtatttttcagaagccagcctcctgcctagtcacacagctttctcctccgggcctcagtttcccaatctgtaaagtgagggagatggacaaaggcttctcccaagcctgcttctttctcaaagttggtacccagggtggcttcacacagtttttgaaaacaaagtgccttcactacactggggagagaggaaaacaaaacaaaacaaaacaaaagctgctgtgaaaaccatcccaggatagctcatatgagcttagcagccgacacactggtgtgtacaggacccatttgtcaagctgactgtctctccacaagcttggatttctccctcatggtctggggtctgccttccccccctcccttcccccagtaaagatgaggaaatctatttatgcagctctgaaactagacacacaagaagttgcatccccactggttcttaccagctgtgagacactgagcaactgattcaacatctctgaacctccttgtctccatgtgtacataatacagatgtcagctggcatccccctttctcccggagaagctatattgactcagacacccccgagtcaatgttgtggtctttgaaagtctgaaactcttccttcaatatttgctattttctagggcttatgatctggaggttttcctcatgactgcaggcaggatctctttttcatgcaggaccaccccagcatcaagctcagcctcttcactgggtcccataagatgcccctccctggcacacatatcaggcattttaagctttagtgtatgagagccgggaatgagcacatcaaaatgcacaaactcccagccttctccaagcttccacccacttcttattttccttcctccccactgtttttttttcctgagacagagtcttgctctgtcatccaggctggagtgcagtgacacaatctcggctcactgcaacctccgccttccagattcaagcgattctcctgcctcagcctcccaagtagttgggattacatacgtatgccaccacacccacctaattttttgtatttttagtagagacggggtttcaccatgttggccaggctggtcttgaactcctggcaagtgatctgcctgccttggcctcccaaagtgctgggattacaggcgtgagccaccacgcctggcccatttacccttattttcatatcccctcaacccagactccaagaccttcaatttttccccctctgtctagcagggtaatgtctcaagaatatcagcaaataaattacctaagccctgggtagagagatagccagctcagtctctgtaccttttcattttactaaaggatttctttccaaatacatggccctttccataagaattaagatatgtaaaactatctctgtctaatagtgtatgcattaaaggtaagaatactcacccacaaggcttttgagaacatgggtggtccgttatgtaaagctcctcatggaatgttcagcttataggtagtcctcaaaattagtagcttttgccttccctaccaccaagcaatggttactgccagggcacactagggtcaggcaagcaaggtacctagtgtacacaatttaaggaggcactcactctcaggttcacgtgcagcctggagagtgagggcctccttaaattttacaccccctggtctttctcttgcctagtcctggccctggttgcagaattggccaaaccatctaccccttctggttatctgaatctgacaaatgtgaatttgatcccagctttaccaaatagtcactaatttcacctcgatcaagtggcttgagtttcagcctaccatttacaaaatcaagctaataataccccttagtggaaagggttgtttcggggtattaaagaggtccatatatgcaatggcgcttcaatcaatattgcttttctctgcccagagtcaatataagaacaaaagattatttcagctttccacgttctagcgttttcactgcttcctttaataaaatgaactcagcaggagatgagactagctagcccagaactgtttttacagtttcccttcctaaaatcaattttgcttttccctcgttctgcagatgacgtaaaatctagagagactacaggaaattgaaagaataaaatagatggtgatcctgcagagttgttgctgggttacagaaaagtgccttttgagaaatctaccaaacaacataaaaagccagaagcagcatcttcctttaattccccccacctccccctgcttctggctttgaaagtccttgaccatgaagctgcctagatgctttattgggtccttgagtgatcaatggcatgtatgcatttgatcctttactgctgataatctgtcattaaaaaataggagtcggggccgggtgcggtggctcatacctgtaatcctagcactttgggaggccgaggcgggtgggtcacgaggtcaggagatcgagaccatcctggctaacactgtgaaaccccgtctctactaaaaattagccaggcatggtggcgggcgcctgtagtcccagctactcaggaggctgaggcaggagagtggcgtgaacccgggaggcggagcttgcagtgagccgagatcgcaccactgcactccagtctgggcaacagagtgagactccgtctcaaagtaaaaaaaaaaaaaaaaaaaataggagtaataaaataggagttgggccaggcacggtggtgcacacctgtaatcccagcactttgggaggctgaggcaggcagatcgcctaaggacaggtgtttcgaaaccagcctggccaacatggtgaaaccccatctttactaaaaatacaaaagttagtagggtgtggtggcaggcgcctgtaatcccagctactcaagaggctgagacaggagaatcgcttgaacctgggaggcagaggttgccatgagctgagactgcaccatgcactccagcctgggtgacagagcaagactccatctcaaaaaaagtagaagtaggggtaagagctaaaagatacggtggttgattaaggacatggaagtgtggccaggttttctaaagagtatttcaggataaaaactaaggttgacttcacagtcctcaccaacctctatgccccactaatgactcttctgagcaaatcactgccccctctagaactctggctgagcctttgtttccagcactgagacacagacatgtcccattccgcttgcagtctcccttggtggggacaccctccctccttccacatgtgacctagaaagagactctggcttcttgggccactctatcgtggctacccctgaagttagaaatccaccaatcacttcctccagattgtcaaggaccattacacatttacatatgctacctctctggttaggaatgtagaagacaacataacagtcataggctatttcctgaggaattagtacacatcaacactgttatggcccggcgcggtggctcacgcctgtaatcccagcattttgggacgccgaggcaggaggatcaccaggtcaggagattgagaccatcctggctaacatggtgaaatctcatctctactaaaaatacaaaaaattagccaggtgtggtggcgggcacctgtagtcccagctagtcaggaggctgaggcaggagaatggcgtgaacctgggaggcagagcttgcagtgagccgagatcgcgccactacactccagcctgggtgacagagcgagactccatctcaaaaaaaaaaaaaaacactgttgggagggctttgcatatagtgagtactactgttgtccctactttacagatgaagaaactgaggctcagcaactagtaagaagtacaaacaggatcaaaaccaattgatccatctccagaatctgcactctttagccactagcttttgctgtcatcctatggccaccctaggtacacccattcatttgcatcaggccgcctgtcctgatttgcacctcaaaaaaattgaaaaactttggccaggcgcggtagcttttgcctgtaatcccagcactttgggaggctgaggtgggcggatcatgaggtcaggagttcgagaccatcctggctaacacagtgaaaccccgtctctactaaaaaattagccgggtgtggtggcacacgcctgtagtcccagctactcgggaggatgaggcaggagaatcgcttgaacccgggaggtggaggttacagtgagccgagatcacgccactgtactccagtctgggtgacagagactccgtctcaaaataaataaatataaataaataaataaacttttcaatttcctttgaaaattcttaccactagtatccctgatctacagttctgactctctttctgcatggaaatcaaaagtcatttgacctctaattcaatccttcccattaggatgggatgcctcttccatacaatatcagaataataaaacaatgcagtatcttcagtgtctactgggctcaagtgggccattttcacagcaggccttattgacaaagtcattttaatattgtttagttcaatcaaagaccccagagctggcctccttttgtaaagatgaaccagagcaagacctggctctggttcatttgtgacctgagaagtcccagggaagccaacatctctctggtcaccaggcttccctctagcaaatgtgtgtgtggagaatgctaaatgagaaaaattacataattgcttaacacacttgtaaaaactcagctgtttgctaatcctgctattgtgactgctattatttctctcttatgattattccatcatggttgggggagaattcagggatggagggagatggtcactcatcttttaaaagatcaagtattgagatttttcataacactatcctgtgagagacaaaagtcatagctgaatcttccataactgtcatctcagaaaccgctatcttggatgtgatgtgacaaccaacatttcctcttaaataaggcatttgtagccctccccttgaccatagtgatatttaaagaaatttctgtaatcaaggaaataagatttgaaagcaagcccctcgtaaatgacgtgtttcatattactcaccaaaatcagtaacaaaaacaattacacaaaatgtcttaaattgatgggggtgtcaggagagtaagaattttttttttaaatgactgttgaagtcttctaagtcactgtgccagtatgctctattttcgtttgtttgtttgtttttgagatggagtctcactctgtcaccaggctggagtgcagtggtgcaatctcagctcactgcaacctcccctttccgggttcaagcgatcctgcctcagcctcccgagcagctgggactacaggtgcgcaccaccatgccccggtaaaagtttttgtatttttagtagagatggggtttcaccatgttggccaggatggtctcgatctcttgacctcgtgatccgcccccttggcctcccaaagtgctaggattacaggtgtgagccaccgtgcctagccgctctattatttttatgctgtgtgatactgatgtactttgaatgctctctatttgagctctgcattctctggattgatggaacgcgacatttttctttgtctccagaaattccccctctccttcaataatgagtctctagacttagtactgcctgaacagcgggatactctcttccaggcagggatcattagtgaaagattggcaacattttctcaacactggtagaaagaggagttatatgagccctctgtgcatgtgtttttaggtacatgtatttgtattaggccctagggagtttcaagacaagctgaatttccttcagtgtttaatacttcataaataaagccttattagcaattctcagctccagcaaatcatggatgtattccagagaacatttaaaatataaatgtaatttcaagtggaagaaaagagccccatttttccaaatagtcaacatatctcaagacactaacattttcaggacggagagggtgacagatagggagtcagatgggaatgctttggtgagatagagagccctcacagaaagaaacaaaggccactctccccctcactacatgcttaaatactcacaaggtgacatgaggtaggtgttggaattatccccattttatatttgatgaaacatttacaggttaagcaaactgtccgaggagacccagataataagtggaagaactggtatcggaagttagcacagtaactcaaaaactgccctctggctgggtgtgtaatcccagcactttgggaggcctcagcaggattacttgagtggaggagtttgagactagcctgggcaacacagcgagttctccaagtcactgtcctcttcaacatgatatatttttcttcctgcgtgcctttccagaaaagatgtcttatttccaaatgaacctccaaccaatacccatagcccatactccttatcccttttagaaggacctaccttccagcccaaacttcgtatccttcttgaaacaaaccacccacacccctctttccagcccatattccatgtcttccttggaatgaaccacaagcacccacccccaacacatattccttattgttgttgagatgaaccactgaattcgacccctagcctgtattgtctgtctttcctggtcatgcatggcctcagtgaaagccactaggtctctcccatgagtatcattactgatgttctttggggggacatggcttagctgtttccaaacaatggccaattccacctaccccatccattgatcctatctcttacctcggggagaagggcccacaggaatttagtctggccctgtcctttgaatggctctctgcagtggcaggtaagactggtacggaaggaggtgtgaggtagataacccctcgctgaatcaaactcaaagagactctcaatccggactcaacgttcttgacaggttccagggcccgtgccccgcttatatctcaaggtaggttccgtagcactcaataaaaccctctgcaaggtatggatcatcatttggtggttggataatcctaatctcagggtgttgaaagcccccactgttaagaaaaccttcagtcttcttcccaggaaatggacatctcctcttggcctgctccaacatgcagagttgttcaagggggcatggagagaacactgttctctctcctacccagtgtgtttgtcattctggaaagagcaggtggagaaaagcaggctgttctcttgacactgcattctttctggctttacactaatttaatctaagacacaacattcaacataattcattgagtagctaggatcttccaggcgctgtactaagaatcttaaattttatctcatttaaacctcaaaactctaaaggtggataatggtaccctcctcattttacagatttagctaaaaagtaatcacttgttcaagagtgcacagccagtcagttagtggtggacctgcaattaacacccaggttattctactccacagccaatgtcttaatgctcttattagattgcctcctcgatagaattatgactctcagaagaagttttaataaactttctttcattgaacgacgtgggtgggcattaggcagcctagctttatataaaatgacgtcagcaccctcagaatgaaagaatgttggaaatgaaaggctctaggctttaactgtattagtagctccttttaaataaggaaactgagacccacaaagaaataactcagccaagatcacaaattttacctctgggaaacaaaagcagcctacatagaaataacttttacatcagatattccaaaatgtgtttcatggaggagtaaggtctgtgagatgttaaaaatagctcagggaagggggaaagaagggttctgtggtgaaatactatattttctgatgtgtaaaattcaccagttatatgagacgtcacccaattttatacagaaattatatgcaagaattacttttcatcatacgttttaaaaagtgattttataatggaaaattatttttgtaagcatggattgttgtacagtggaatcctagtaggaaataatgaagtctgaatatgtagtgatatcttataagcccctaggcagggggcaatatgaaaatcacacagctggaaaaatatatattgatcttactaaatgctagcacatgctagagttagtagggttagtagtaattatatttaagttcaaagtgttaggggaaaatcacctaagcaactatgtgaactttgacttgctattttttataggaaaactttgatgtactgtgaaaacattgtatctttactgctatgttttgggattgcctgttttaccactaagggagtagacatgtattattttgccttggattttcattcattcatccacgcctgagcatttagttcatgggaatgtttggattcttattctttcatggcaaggaaggaaatgcattatataagcctgaaatacagtaatttttttttttttttttttgagatggagtctcgttctgtcacccaggctggagtacagtggtgcgatcttggatcattgcaagctctgcctcctgggttcaggccattctcctgcctcagcctcccaagtagctgggactacaggcgcccgccaccacagctggctaatttttttgtattttttagtagagacggggtttcaccgtgttagccaggatggtgtccatctcctgacctcatgatcctcccgccttggcctccaaaagtgctaggattacaggcttgagccaccactcccaaccaaaatacagtaaatttttaaaatgccagattaaactaagttagataggtttctttcctgcaggacttcttgttgacagagtatacagcattttcctacttatttgactgtggaaactcttttcttcatatctcactgaatacaagttcacaagattttggtgtcccatcctatatcccatcagattatcaaatcgtagcaacacaatatcttacacttgagagaaaagcaggacagtcctttatgatttggtacctgcagtagaaacagagtgtctggtgaaaggaatgccacctcctaccaattcagcaatccctgagatccactcatttgtgctggccacagtacctccaagcttctcttcctctctgttctgcccacaaacctgcattcttgcctgcctcctggattcacagaaatccaaagggaaaaaacaaaggaggtctttctttaccaggagtgctgagatagctcgcaggagaatgaatggtaggattcaagcatgttagaactctacagaaacagagggacattggtatgattccaagcacttggggacaattctcccccacacatttcattggctagaactgatcgcatggccccacctgactccaaggaggctgggaagtgaagtcttcctgagtgtttaggaaaaagagaaccagatatggaaaagtacaaatctttccacctcaggaccctaagttcttagtcattccagtgtcagaagaaattaatgtgatggaatacttcaactatcactccttgaagtttcatcactctctctcatttggacttatagtaaacccctatcttagttcccattgtcgcctaagaaaacaatagttcagcatggtagagtaacttgtccaaggttcttttagctaataagtgacaaagccagactcaaacccatatcttcctgactccaaaaactgtatttaccttaaacagttgttgtgaggattgattaaatcagaaatccattcattcatttgaatattcattaaacacctacctgaaccatttactagtcagtatgtagagaatttggcagacactgctctcctagaatttaaaactgtatgaggataaaataacaaacaagaaaaatggtcaaataatttcaacaatggaaaaatttcagaaagaaaaataaaataagctaaaggaatggagtaaaagggatggggaaggcaggtattttgaataggggagtcaggcaaagcctgaagaggtgatctgaggagaagaggctgaagcaaaggaggagaggtcttaagcagagctggaaggagggggattaacaagtgcaaaggccctgaggtgacagtgggctgggtacatttaaaaaacaacaacaataaggcaaatacgactggagcaaggaagtgaaggggacaacagtaaatgaggtcagagaagtagtcagatggcacatagcctaggtcagagaagtaagcagatggtgcataatctgggagagggaggcacaatcgggaatctggaaaatttctagccatgatgggaagaaacccactggagtgctttgggcgatggaatgacgtggtctgtgttctttttcttaaggttccttttctattattatttctgtgcaatagactgttctgctagagggaggagtaagaatagaagtaagaagaataattagggagctactgaagtcattcaagcaaaaattgatggtagcctggataagactgttcaaaagagaaggtgaaaagtcattagattcaggatatattctggatgttaaaccaaccagatttattggcagattggacgtaaagattgaggggaagaagagaatcatgaaaaacccctaggtttttggcctgaagagctgtggttctgtggttttggtagacagaatgatgctccccacacccccaagatgaccctgttctaatcccttggacctgtcaatatattactttgcatgaccaaaaggattttacaggtgtgattaagttaagagccttgagctggggagatttgagccaaggaatgcaagcagaatccaaaaaacaaacaaacaaaaaaaaatggattcttccctagagcctccagaaggaacatggcccagctgacaccttgattttaggccaatgaaaaccattttggatttctgacctctagaactataacataataaacccctgttggtttaagccactaagtctgtagtaatttgttataggaaccatagggaactaatttagtgggatgtgaacagtgccttgaatcttgttaagacactaaagggtgatcaccacagcaaactaggagttagagcagagaacagagggagacagggtaggtttactgttcaatcttaaaatggaaaagtacttaattgtgtgatatattgagtttcactaacaagcaggaagtaccaatttgtgccaggtcttatatcagacaatggagacatgaggatgagtaagatgcagggcccggtctggtggatgaatttgcaggatggggaacaatttcacagcagcttaatggacctgcctgtcattttaccttgaaaagggaccctagtctagttttcatctttgagtataggggggataaaaaggcctcttggtgctcgatttcctctggtaccacggaatgtttctttgggcaggtctcttctgtcttttacatctgacccacaaaatgcactttattccacttggtctggactttctattgaaaccagcaaaatgatttacagaatgtacagcatctctgaaaaaaatagtaaaagattcattggaagagtgaaatctcttttaggttgtaggagatgtctcttcactcatctgatatgatacagttttaaagtgataattgagacttttttatggagtgcagttaagaaatgtcattactgtttattacagaaaatgaaataaattggtagtgcgggtaagagaactcatattgtagagaattacaactctttgggaaatacgaggtgagcatcttctttgggcacgagaattttttttcaaataccttccaattagcacaagccttgtgctcagtatttcctccactccccattcaatgacggtttataaaaaaaaaaaaaaaaactacccttattccaaatttaagaggcagagagagatgggggcggtggcggggaagggagaaaaggagaagaaaggagtgagagggacagagacggagagggatgagtggggggaagagagagagagagaaggggaaaatgtgggaaagaggttcagactggttggatcgtgtctgcagtgattgctgactgcagggttgcacagtagaccagcactggctgtaatgttaagctggccagaatttaaagctcatctctggcataaactacctgtgtgaccatggacaaaatatctaaaccctatgagcttcagtttttttcattcattaaattggagaaatgatacctgtttgcagggctattgggaattctggtgtgatcatgtatctgaagtacccggcattgtctaaaacatggtagatgcctaataaatactcacttcattctccagagcatcctgcttctctctcgttctctttttgacactccttaattttcctcttttgagaatcagtgatacatacctggggagaaaaaaaaggaggtgggaagaaatgggaaggcatgataaggttgtggggagactatcgcaccactgacttttcttataacttcccaggactggctggggaaagacctggtaggtacagggggagccatggcctggaatagcaagctggacattcctggttatgttactatactgagacttaaggctgcgaaacacttgtccatcttcagctatatttcttcctcacttaaaccctctgggacaattttccactttagagctaaagaaactgaggctgggagaggctttctgacttgcccaggatgactacagtgagtaaggggagcctcagtctcctcaagtcaccacgcaggcagccctttctgcctcattgcacctggcacccacctttatgtaaaagccaacatcaaagaaaacgacccaagtgctgggggacttctccttaagtcaactaaagatgaggtccttgtcacatggccacgaaaatgtaggcttgcagacgattcgaagagtgagaaaaatgggatttactcggcaaaaaggaaaaaaaggggaaacagagactcttagtgaagcgagagagcgtgcttcctacctgtgcacttcctgcctcacagtttgaatcccaggttccacacaggaagaggaggggccaggctcctccctgctgcaaacagcattagttactgtggctccatcttgtaaggattaaagaaagaggagaggaaggagagggaggaagagggagcaagggttagggagcaaaatcccacttgcgagtggtcaggggtggattcctaagacctgagggtttgtttggtttcttgtttgtttgtttgtttgtttgtttgtttttgagacggagtctcgctctgccaccaggctggagtgcaatggcacattcttggctcagtgcatcctccacctaccgggttcaagcaattatcctgcctcagcctcccgagtagctgggattacaggtgcatgccaccacgcccggctaactttttatttttagtagagacggggttcaccatgttggtcaggatggtctcgatctcttagcctcatgatctgcccacctcggcctcccaaagtgctgggattacaggcgtgagccaccgcgtcctgcccaacctgagggttttgagagcccacctgggagtagccccagcctgagcctcacagttcccttcaggttcatcgtcctcctcacgcaaatcagttgaaaatgaagtgagggaaaagatgggcgggtggccagagaccttcaggatccagaggttaactcacagtgagccgccgttgcccactgcttcctgagttgcaagagagcctgtgctcccaacacccattccaggttttggcaccaaatgtaagaattaaagaaagaggagagaaacacgaagggtggcttgacagttacccaagagactttcccccactacctccctttgtggccgagctgttttatttgtgttttactatttgctctttctggctgcttatagttagaagagaagtgatttccttgtaatgcttgaggctagaaagggagctggaacttaaagtggtgatgcttgtctgaaatgacggtgctcctgctctgttacatcccagtatgcactcctcccagtgaataggccagttggagttttgccagggggcccttcccacctgactgtctcacaaattctcagaccgggagaaggacctccttgaaaaggcgagttgaatcccttgaattacataaggggaggagataacctgagccttaaactcacagtgaagcccactagttgggaattcagaagagacagagagttgaaaattaccgaaggaaacttgcccaaatacttaagatagaatcacagtgctctgaaagaatatgctaagtcactgtatttttaagaactgggaaaacgtgtttcctgctactatttggaaagaatgactctaagagcgtaaagggcaaaacccttctttttatgagcactgtttactgttgctgatacctcctgactaaatagactgtgtctacatgtggaccacttgggaccagttcctgagctccactttggacctaatgaatcagaagttattagggatgggccccagagttttctgttttaatatgctaccatagtggccctaatgcacagatgaactggaaaccactcttctaaatgtgtcttatgtctcccttgcctgctggatcctgattcaacagatatttattgaattccaactatttagctgtctgtgttgtatgcacttgggatatacctataaacaaaactgaacgctctgtcaaaaaaatctgttttctagaacttatagtctactgtgtgggtgacattgtttaaatatgtgtcctcatcaaatctcatgttgaattgtaatccccagtgttggaggaggggctgggtgggaggtgactggatcatggggattagcaccattccctcttggtactgtacagcgagttctcatgagatctggttgtttaaaagtgtgtggcacttccccccttattctctctgttgcttctgctctggccatgtaaagacgtgcctgcttcccctttaccttccaccatgatggtaagtttcctgaggcctccccggaagccaagcagatgccagcctcatgcttcctgtacaggctgcggaaccatgagccaattaaacctcttttctttataaattacccagtctcaggtatttctttacagcactgtgagaacagactaatacagcaaaaataggtgagtgaggaaagaaaataagcaataaacacaacaaatcattttttactttatattaaaagatcatcattgctttttctaaagaagaggcagataaaaggggaaacaggagtgtggggatgggagagaggagtgggttgggtggtgtgaccctggatcttctgtctactccaggaatgagactttaaacctttcctgcctgcatcaacctggactgctcagatctgggcttcccacttctacctgcctcctgattctcagtgctctgttgccctgttagttcctaggtactccacccacagtgcacggaagtaaccttcctctgctagctaaacagaattcgtgacgacctctccaggctaactctgggaaaatgcttgtttaaacctccctgtaggactaaacgcttaaccaattctttgaaacaccagaaagactggagatatatttgagcaacactctgtggggtgctggagccagtatgcacgagctcctgagagccaattgtgtgcatgttttttccagctaggcatcagtggtgttatatcatagctcaaaccagtggggggccggaggcgggcggggtggggacggtgggagtagttagttacactgagaactgtgataactcagcaagtgccacaaatcagggctccctttagagatctgttgttacatattgaccatcacatcagtggtaacagttatgtgctagaaatagccccagaagaacataactccaaagctctctccctaaatccagtaacctgggtttggctcttctcttgcttcctgggtacaagaaaatctcaaaccctcttgctaccgaagggtttgagattctagaccaaaaagatacacagagaggcttggaataaaatagacagtagtgacttgaaggaatacaaagggtgaaaaattcctgcactcaatttattgtcttatatcttgaggtttatttttcctaataatcattacaccctcagaaactgatgagtttccagggcattataaatttaaaacatttagcagggctagcactaaaatagctcattaaagagtgtgggttggaaaggcttgttagtctgctttatatacaatgatcaattacagcaaatttctcagcagtagtttctatcactcttctttaagatgcagtaatagaaatgagatcatcagacttaaggaagttaatcagtgcatcaaggttttccacagaaattttccaaggcaggagaaagaaaatggacattccagatgcctaagactatggtttaaagagtctcaacaagctcaaaatgtcaagaaagctttggccagtgatacgctagtgaatgttttaacaagcaaatcttaggggtggggaactgtgatttacagcatttgccaacttccattgcatcaaaatttccaccatggccaatttcaagctacaaatgtgctatcaactgacttactgtattcctgaaaatgtagctattgattctcatgagcttagtacaagccaggtctaacataccacttggttttttttttttttttttttggagacagactctcactctgtcttccaggttgaattgcagcggcacagtcttggctcactgcaacctctgcctcccgggttcaagcgattctcctgcctcagcctcctgagtagctgggattacaggcacgtgctaccatgcctgggtaatttttgtattttttagtagagatggggtttcaccatgttggtcatgctggtcttaaactcctgaccacgtgatccgcccgcctcagcctcccaaagtgctgggattacaggcatgagccactgcgcccagccccacaccactgtctttagctcaaaagttaatatgaattttgcacccagctcaatgatacatccataattaatttaaaaataatagtggttttctgtctgtcttcaaattttccagcatcacctaatgtatgtttcccaaagacagctctactcttatgtgagatgacttggtggggggctgggacatggaatagccttacattgtttcctttgcatttctccctctcaatcttcccaattatattaagattaaagtctcagtgaggtactaatctgctttaacacctcttgaacacatccctctcccttttcaacaaagagggagcaggcttcaagttcagagtcttcaggctggcaacagtatcaagttagaatgtattagaattgtttctttacattttgcttattatgttcagctgtctatggcaaataatactgatttttttcccatttatggatgcagagtgggcttttcctttaaatatgttattagtatgtcagttaatatgtttcttgtactaaggtggtacctggaataagcaaaagtcacttgcttctcagaagataaggcccagcttcttgtgggacatgctagtggggccttttggaggcagaaatacccagtggcagcttgttgcattagcagtaactctctacctttagaatctcctgctgccattcatcctactcaccgaaacagattttgattcaagttatgatgtgctgtcatatgttgatttgtatcagcagttgctcacttgtatctattgccaatttccatggtgtaaatcttcccaccatggctgatttcaagctatcaaccagacaatgaacatatgcatgcatgtatcttcatgacagaatgatttatattcatttggatatatacacagtaatgggactgctgggtcaaatggtagttctgtttttagctctttgagaaattgccacactgcctttttttgagagtcttgctcttgtcacccaggctggagtgcaatggcatgatcttggctcgctgcaacctccagctcccgggtttaagctattgtcctgcctcagcctcatgagtagctgggattacaggcaccatgccaccaagcctggctgatttttttgtatttttggtagaaacagggtttcaccgtgttggccaggctggtctcaaactcctgacctcaggtgatccacctgcctcggcctcccagagtgcccagattacagacacaaaccaccacacccagcctgccacactgctttgcacaatggttgagctaatttacactcctcccaacagtgtataagtattcctttttctctgcaaccttgccagcatgttatttttttactttttaataatagccattctgactggtttgagatgatatctcattgtggttttgattcgcatttctctaatgattagtgtattagtccattttcacactgctgataaatacatacctgagactgggtaatttacaaagaaaaaagaagtttaatggactcacagttccatgtggctggggaggtctcacaatcatggtggaagatgaaaggcatgtcttacatggtggcaggcaagagataacttgtgcagggaaactcccctttataaaaccatcagatctcatgagacttattcactatcacgtgaacagcacatgaaagaccctcccccatgatttagttacctccccctggttccctcccacgatatggaaattgtgggaactgcaattcaagatgagatttgggtggggacacagccacaccatatcaatcagtgatgttgagctttttttttcatatgcgcatacaattgtgaagagaggagaattctttgaatatatacacagtaatgggactgctgggtcaaatggtagttctgtttttagctctttgagaaattgccacactgcctttggagaaacagaaatcttgcatccatagttgcctcatttctctttttcaattactgactctcccaacatagaaggatcgagttgagggaggccacagggtcacttacatgtgcagatagagcagtggtttgaattcagtaaccaccctgttttttgttgttgttgttgttttttgttttttgtctttgtttttttgagacagagtctcactctgtcacccaggctagagtgcagtggcacaatctgagctcactgcaaactccgcctcccgggttcaagcgattatctcacctcagcctcccaagtagctgggattacaggcacccaccatcacacccggctaatttttgtacttttagtagagacagagtttcatcatgttgttcaggctggtttcaaactcctgatctcaggtgatctgcccgcctcggcctcccaaagtgctgggattacaggtgtgagccactgtgcccagcccaccctgtattcttttttgtttgtttttttgagatggagtctgcctctgtcgcccaggctggagtgcagtggctctatctctgctcagtgcaacctccacctcccgggttcaagcgattctcctgcctcagcctcctgagtagctgggattacaggcactcaccaccacacccagctaatttttgtatttttagtagagatggggtttcaccatgttggtcaggctggtctcaagctcctgacctcaggtgatccacccgcctcagcctcccaaagtgctgcgattacagattacaggcgtgaaccaccgcacttggcctattttctttttctttctttttttttttttttttgagacagagtctcgctctgtctcccaggctggactgtagtttcccgggctggagtgcagcggcaccatcacggctcactgcaagctccacctcccgggttcacgccattctcctgcctaagcctccctagtagctgggactacaggtgcccgccaccacacccggctaatttatttttgtatttttagtagagatggggtttcaccatgttagccaggatggtctcgatttcctgacctcatgatccgcctgtctcggcctcccaaagtgctgggattacaggtgtgagtcactgcgcccgacccaccctgtattcctaaagtagccctagcattcactagctgtgtggtctcagacaagtcacttagcctctaaggaatgaaatttctaggagcacaagagcatagggctctcacatagcatgtggcagttattaggatgcaattagcatcaccatttctttcctccacacccacaggtgtagaaccagggcacgtgagcattgtttaaaggagagcttcaaagatgatgtatctttagagcttgatgccacctgcctttgcctacctgttgcttggctacagacctggctcccctccaacctcccatttctaacgctacatcaaaggctgtgcttctcagctgggagcagtttcgtcctttgaggggcagctggcaatgtccggagacatttttgattctcacaactggaaaagtatgactgggatctagtgaatggaggccagggattgtgctaaacatctcaagatacacaggatagccccctgcaacgaagaattatccagccccaaatgtcaccatgccaagaataaaaaaccctgctctaaggattaagtgagcttggtccctctaaaagatgtgtttactctactggaatactagagaaattccttaggctaccatcctaagaaagagtagcatagcccctaaaaattgtaactaaattttacactccccaggcagaggtataaagatgtctccgacttgttaaagcaataaatgaccgaaggataatgggcatgacagaatagatttttaacagtcttattcccatcattaaatcctcgctcttccacttttttagctctgtgaccatgagcatagtaagtgctaggatcctcaatttcttcaactgtaaaaacagaaataatgcacctgtcttgtataaaattgttgtgaagattaaaggagataatgcctgtaagccagttagccagttactgctggtatattgttatgttctcaacaaacataatcattatcatcattactcttgctattatactgcctacagtagtcagagctcaaatagatattttcatcattattattattttaggtctattttagttccttaaacagttgtgggtggctgagaggcacatgtacctgtctcttctctgtgccaagactctgcagagtggtgaacggcaagaaaggaaaagagtccaaacagatggaaacttcatggggcaggtttctcctagtctgccccccgccacacacacacacagaaactaaacactcttccaagctgtcttcatccatgggataatttctttaaagcctgcatggaatcccagataatgaagaatgatgaggctaattatagactcaccatggtacaaaaacctgtcggttgtatgttcatacagattatccagcttaagtcacaggccattcagagtgttcaatttcagaaccatccagaagctatcagacctagtctgtccaatctgtgggggcacaaacccaagaactgttctagcacatagaagagcacaaaaaacatggcttgtggtatctgtgcttagtgaggccactgactcacttggaatggccaattccagattgcagaacttttttttttttttttgagagagagaaagagtgtgtctcactctgtcgttaatgctggagtacagtgatgcagtcatagctcaccgcagcctcaaactcctaggctcaagtgatcttaccacctcagtctcctgagtaactgcgattacaggcactcaccatcatgcccatgtaatttttatatatatagtttttgagacaggctcttactgtgttgccaaagctggtctcgaattcctggcctcaagcgattgtcctgcctcagcctcctaaagcactgggattacaggtgttagccaccacacctggccagaacttttttcaattgttattttctcctgataagaaaagtagcacatattcaacagagacatttaaaaccatgtcccttcaaagcaagaaaaatcatactcccattaccaacagtaacccttttgtatgagttgtcttttctttcagtatttcctttttggacagatggggatttgttctttgttttgttttctttagtggcttgacttttttttttttttcttttttttgagacaaagtctcgctctgtcgcccaggctggagtgcagtggcacgatctcagctcactgccccctctgcttcccggttcaagtgattctcctgcctcagcctctggagtagctgggattacaggcgcatgccaccacgcccacctaatttttgtatttgtagcagagacagggtttcaccatgttggtcaggctggtctcgaactgctgaccgcatgatctgcccgtctcggcctcccaaagtgctaggattacaggcgtgagctaccacacccggccagggcttgccgttttttagacattatcacattgtacaaaaaaatttgtggactgcctttttttccctcttgtacactcataagcattttaaactataatggctacataatattctaacaaacagctctaacagagtttactcaaccactctcctgttctggacatctaggttacttgttcttttttttttttttttttttttgagacagagtctcactctgatgcccaggctggagtgcagtggtgagatctcagctcactgcaagttccgcctcccaggttcacaccattctcctgccttagactcccgagtagctgggactataggcacccgccaccacggccagctaatttttgtattttaagtagagacaaggtttcaccgtgttagccagcatgatctcgatctcctgacttcgtgatctgcccgcctcagcctcccaaagtgctgggattacaggcgtgagccacagcacccagcccgagaatgtatcttaaagaaataaacctctacttggaattttatttaaaaagtatttatatctaaaatgtttgttgtagctataccaacaaaaatgaacatgtcactctgggaagatgtgacttcaattgattcttagaattgccacctacctccccaacttaccaaactcttggttatggagacttcttagattcacccttccttgtgactctagaggacctgactactgttcatagccacccctctgggatcagtcccatttgagatcccagtgaagcccaggctgaaacaagaatggctgaagtctggctatccatccctagttggcctctgagcaggaatggaaagttgctggaaggcaacacctccctcaaccccttactttaattccctgtctgttgagcctgtttttatctcgttaccatggcaacacagcctcaaggctgatagatattccttgccacttagaggaaaacactcagctaataggcaagtgggaaggacacaggaaagaaagggtgagcccttttctgtttcccttccgtgcctctgcaaatgggcagagataattaaaaattagattttaaagtcacactgacactgacggaaggaacataaggaggattccagcgctcacaagaccatctgcttctagtgctaattaaagtggatgaagataaatcaaattacctcagatctcatgtctccttgatgaagaatctttgaaagcataggtcattttagggactcttttcaccctttggggaattacctggcttctaaaaaacctgaagcaatcgtaaagatcaagtgggttttaacagcatgtctcagcatcctacctcaaatcttggtctcaccccgccagcctccataattcccagttgtcattggtctcccagtttctccccatccagggcccactggccaatattactctcagggttatcttcccgaaacacacttctagctgtgtccaagtgaagaccatgcccagctccctcctgctcacataagaggggccagctgacctggcccagcacacaacatccccaggacacccaatagcactgtcactcacgcccagtcccctgaatgagcaatgcattcagtcctttcagaactctgttctcttgcctgagtgtatgcagtttctcttcctgaaaaatgcctacctccctctgtttttgaggtggagtttcgctcttgttgtccaggctggagtttgcgcaatggcatgatcttggctcaccacaacctctgcctcccagattctagcgattctcctgcctcagcctcccaagtagctaggattacaggcatgtgccaccacgcccagctaatttcgtatttttagtagagacagggttttccccatgttggtcaggctggtctcaaactcctgacctcaggtgatccaaccacctgggcctcccaaagtgctgggattacaggtgtgtaccaccgcgcccggccccatctccctcttaaaacccaatggaaaagtagttcttctctaaactgagtaatttcctccactggactcacatgcctcttcattcatagctaggatatagctcctcccacactctgttggaattgactgtctccatggccaccttccctcttctcctggcttcaagggcagaggctgcatgtgctcatctctgcatgctgcctggcacatagtaggtggaggttattaccccacaaacacaggccatttgattgaaagggtacacttgtctatctaggaaatgagaacaacacattgaacttctctaacacctaactcctaggaaatccaaacccctcatttgcaacaccatcatcaaacatatgctgggtccttagcaatacggtgtcacagttgagcatttgagtgctggaactgtcgttatagttgtcatttggggaagaaagctcaaagttcacattttgtaaactttttggaaaatttcaaacatataaaagcagcaattataggatactgacaccccctgcccccatactccttccctgttacccggtttccacaatgattaatatttggttgattttttccttcattgccttccctttctcactatttttctggagtattttaaagtaaatcccagacataatattatttcatctgtaaatatttcataaacattctaagttaaaatcctagctctttgacatactatgtttatgaccttaggcaggttaattaatgtccctaatgttcatcttctacatatgtaacatgaggataattatggtacattcctcatagggttataatgaggagtgaagggactattccatggaaagcatttgacacttagcatgcactcagctggtgtgctaaggggtcggtgtcagccattaaaatcactgtcacttatcattactgaatttacagcacagcatcaaacccttgggacatgaaagacataagatctatcagtaatctgtatctatcagtaatcatgactgtggcagcaggatgggggcagattggagcacgaagaagctgggaccttcagagaacaaacaggaggctagaaaaagaatactgtagggagatgatgagacctcgaatgatgcagtgacagagtggagacaatacacacgtggagattagagccaagatctctgatcgactgcctgcagcagggagatgtccttctgcaattaaaggtcaagtctagattctggtggcctggagcgagtaagtcaagggaggtggaggcaatggcagacaatgagtttcttcttcctaggatcatgatctctggggtactgacagggcatcctatgctggggcatcctagaaaaaagaataggcaatgtgctaagagtttggatgtttgttccccaaacctcatgtggaaatttgatcccagtgttggaggtggggactaatgagaggtgtttgggtcataggagtggattccacatgaatagattaatgccctccctgcaggaatggagagtgaattctcattctagtagttcctgccagagctggttgctaaaaagagcctagtgcctcacctctctgtcttgcttcctctctcactgtgtgatctctgcacgtgccagctcccctgcaccttccgccatgagcagaaacagcctggggcttccaccagatgctcaatcttccagcctccacagtcatggaccaaataactcttttttctttaaaaattacccagcttcaggtattcttttataacaacacaaagggactaatacagcaggtgaggctgccgattatgacatggcaatgcttgtcctgccctttgtgaagcacgtggctcttcctagacagttggttgtcacttttattttggtgttacttacacagcttctaatgaaagattccagatgactgtacccttaagttttccctcagccatggctctgtagcctcgtttcactgctgtggtgatcaaagtgagctggtggttgcctcataatcacttttaataacttattatccaatgaacatgtgctcattgtgttcattttttaaaacacaaaaacattggccaggtgcagtggctcacgcctgtaatcccagcattttgggaggccaaggcaggtggatgccttgaggtcaggagttcaaaaccagcctggccaacatggggaaaccccatctctactaaaaatacaaaaattagccaggtgtggtggtgggtgcctgtaatcccagctactcaggaggctgacacagaaaaatcgcttaaacctgcaaggcagaggttgcagtgagctgagagcatgccactgcactccagcctgggcgacagagcaagattccatctaaacacacacacacacacacacacacacacacacacacacacacacacagttataatggagaaaatgaaaactagccctaaccctattactcagatatagccaaggttgtgaggttgatacaacctataatttgcattaatatatattttatatagataagcagaataagaaattgtatgttcagcgtgatcttatcatgttaatgagaaatgggaagcagtgatcttcagggatgttctgtgttgcccttaatcatcctaagcctgatggacattttgctccagttttttgcttttaaatattgaataacatatagtaactgttaaattagtgaatgttatacagctttattccatttctttaatttttctccttttaaaaggctgtttctactggcaaacataaggaaaggatccattgtttatccggcctttcctatacaaactgtttatcactggtaatcaaataatggatgaagggaaatgtctccttataaaattatggcagctaataaatgaacacgactgtattcatcctccggtaaattactggatctaggcattaagttagtatgctggaaagagagccagccagccattgtataggttttggagaaaagacacagcagcgcccgcggtcttggcaaagaaaatatattaacctgatcaaagcttccatccacctgaaggaaatacagagaatggaaagatacgttggctgcactggctgttcaaaatccgtaaagtccagacggtatgcaactccacaaagctcaacaatgggagctcttcagtacaacttgcagggaacagcagcaaagtggaagggtaatttgtagttttaaaatgactcaaggtccgggtgtagtggctcacgcctgtaatcccagcactttgagaggtggaggccggcagaccacttgaggtcaggagcttgggaccagcctgggcaatatggtgaaacctcgtctttgctaaaaatacaaaaagtagccaggtgtggtggcgggagcctgtaatcccagctactcgggaggctgaagcaggagaatcgcttgaacccaagaagtgggggttgcagtgagccgagattgcgccaccgcactccagccagggcaatggagtgagactctgtctcaaaaataaataaataaataggacttaaaagtatgagtgcgtgtatattcttttaattagcaaaacaaaactataatgcctgggatgcagagttgggtgaaattaaggaaatttaaggaagcgattactctaaaagtcaggactgagccagcgacatttgagggaggggaaggaggtgagattagcacaagggacacagaaaggacttcggggtggctgacaaagttctactttgatgtattggttttgtgtagttttctgtatctgtgttttacaacttttaaaagtttaaaattaaaaaaaaaaaaacacgaaaaaacaaactgaaagctgttactaggcaagattatttcaacagggcagagagattgaactcaattcctttgaaacaaaaggtagagaatttttgagcactagggggagatagtggcaaagtcctaaaggacgtttcaggaagaaggcaggtgagctgaagccatcaagccatctgtgtttgctaattggtgcttatggaagttaggctcttatccttcccagagactgggagatagggatgctatctttcttgattacattttgaagggatggttcccaagtccttgagaaagacattcctgggttgtagaagatttatgtcttaaaggagcaaaaataatttacaatatcaagttttctaaggtaaatgctctaagggaggattagggacctacagtcaggaagaaacctgttgatacagtttggatctgtgtcccaacccaaatttcatggtgaaatgtaatccccaacgttggagatggggcctagtgggaggtgttcggatcaggggagcaggtccctcatgaatggctcttgctcagagttcacaccagacctggtagtttaaaattgtggggcccctcctccctgtgaccccccaccaccacccctcgcctgcatctgcttttgccatgtgacatgcctgctccccctttgagacctccctagaagctgatcatatgccagcactatgcttcccataaagcctgcagagccatgagcccctggtgactcacacctgtaatcccagcaccttgggaggccgaagtgggcagatcccgaggtcaggagtttgagaccagcctggtcaccatggcaaaaccctgtatctattaaaaaatacaaaaattagccaggcgtggtggctcatgcctgtagtcccagctactcaggaggctgaggcaggagaatcgtttgacctgggaggcagaggttgcactgagccaagatggtaccactgcattctagcctggggaacagagtgagactccatttaaaaaaaaaaaaaaaaaaaagctgttactaacaatattgtgttggagagtgtccccctaaatccatgtttctccctgaacctcagaatgtgactttatttggaaacggggttgttgcagatatattgcaacaacattgcagatatttaaaacgaggtcatatcagattagggtggacccttaatccaacatggtgtacttgtaagaaggaaaaaagagagagagaatgccatatgatgatggaggcagagacaggagtgatgtgtctccaagccaagggccaccaaagatgccagcaacctccagaagctaggagaaaataatggaaaagattctttctcagaacctccagtaggaaccaatccggctgacatttggatttcagactaagcctcagaacttgtgagaaaacaaatttctgttgtttcaagccacctggtttgtggtacttagacagcaaccctaggaaactaatatactacccaaacattattatgtgttcctaattttaatgaaaagaatgattagtttagctcaagactgggtatgatttgttaaagcattatttctagtccttgtctgtatgcaaacaattgtttacttggttgaagttatagcccaatacagttttatttctggactttttttcatttgacagaacacctatttacatttctttttgtttggttttattttgtttttttgataaagggtctcactctgtcacccaggctggagcacagtggtgcaatcacagctcactgcggtctcgaactcctgggggctcagcctcccaaatagctaggattacaggtgcgtgccaccacatccaactgtcttttcattgcccaagctggtctggaactcctggactcaagcaatcctcccacctcgacctcccaaagtgttgagattatgggcatgagccatcttgcccagcctgatttgcatgtcttaatttgagcacgtgtatctctagtaggcattggttcacactagatcctgatgtttccttccttgaaaagaaacaagcccacctactgcatttccagcatgcaactttgcttctgagttttctgctcatgttgcactaagatctggctcattagaccatgaactgtgggttgctcttgtaacctgctaattctaacttctcacacacatcctgtgtgaccccaccaccactgagattcgtccctgaaaccatcagcagatgaaactcagctgctgggtcttttgagcggccacatggagacaatgaataggtataattaacagaaaaacaatatcctgaaggtttcttcatgcactgagcagaaatcaagttgtttgatacttgcgcagaaccaaagctgagatccgatttcttgtctgttgccctggagtgaaaagggttgtagtcacggctatctgctgctttccagcatgccaggatatttaagtcaagtgttaaactaggctctatccagatagcaaaaagtggaatgtcaggccgggcgcggtggctcacgcctgtaatcccagcactttaggaagcccagacaggcggatcacaagatcaggagttcgagaccagcctgaccaacatggtgaaacccggtctctactaaaactataaaaattagccgggtgtggtagcgcatgcctgtaatcccagctactcaagaggctgaggcaggagaatcgcttgaacccgggaggcagaggttgcaatgagccaagatcgtgccactgtagtccagcctgggcgacagagcgagtctgtctcaaaaaaataaataataaataaatggaacatcatctccccctctcaggggcatcttagccaagcaggggacctgtctttcttgttctttgcatgagtcacccaagcacgatgccttctcacagtaggcagtcaatatttgttaaataaagcacttttgaattaaaaggttctaaaacgtcagagttccagaatcaccaggagtagactacctgtccagtctcaataaaagaggcctagggtgaggccaatacatcactttttaaaagcaacatatgcgattttttactttttttaaagatcaactccaaatataggaaacacacgtgattttaatgcaggcagtctttaatttctatttttaagaaaagctaatgtaaccacttgagtgttttgaaatcagagaccatattgtgttctgttcatgagcgcctattgagctgtgtaccacacactcttcctcgttcttgggaaagagcagaacaaaatcccctgtgtgcaacatgttatgtggatactgagatggggcaggtgcatgctcttcaagagcccatggagcaatgggaggggagagatatagaaaaagtttttataacactgtgattctcaactggaggtgcttttgcctccctaagggacatttggcaatgcctggaagcatttttgtttgtcacaacggggtagcgctactgacatctagtgagcagaggccaaggatgctgacgaacatcctgcagtgcccaggacagcccccacaacaaagagttatctgggccaaaatgccaatagctactagattgaggaactcttcaacagagaatggggccgggcgtggtggctcacacctgtaatcccagcactttgggacgccaaggcgggaagattgcttgaggtcaggtgttcgagaccaccctggccaatgtgatgaagccctgtctccactaaaaatacaaaaattagccaggggtgatggcactcgtctgtaaccccagctacttgggaggctgaagtgggagaatctcttgaacctgggaagtggaggttgcagtgagctgagatcgcaacactacactccggcctgggtgacagaggctccatatccccccccccaaaaaaaaaaaaagagagagaatggaatgagtgaaatgacccagggacaagcaagatgcatatagaagtacaaaggaaataaaccattcctggtcctgcaatacaatacccagcgtcctacatccttccttccttcttcgctctccattgcttccaacccactgtctcatacctggcaacagtgcatcaagcctgtggttgtatgaagcggggtctaaagcctagtttctctgtatccactgtttaaccttaagcaaaaacaatgggtaagacctgtttgatagcacagtggggtgactatagtcaacagtaatttaattgtatattttaaaataactaaaagagtataattggattgtttgcaacacaaagagataatgcctgaggggatggatactgcattctccatgatgtgattactatctattgcatgcctgtatcaaaacatctcatgtaccccataaatatacatacttaccatgtacccacaaagattaaaaattttaaaaatttttaattaaaaagaaaaaataaccttggacaagccactaaccttcctgaacctcattctcatctcgactctcctccttgaacaacagagactcaggaagaaaagggggcctatttttatgtacccctgattgacagcctgacaaactcccacttacctcattgggttgatgcaatgaaatgaggtcatgcacatgaggtgctttgctcggtgacagcacctggtaagcacttgtcatatgtcagctgccgcaatgatcatgagcaacggcctccaccaccccatagatttaccacctctgccttgtcctttacatttacccaatttggggttcatctctttccttgagacttatcttctcccattacaacctatgggcatctggtgactctcatattattacattcttaggttcagagcctatagtttgctcctcctatccttcctcgtgggaggatccaatatataccccgctttagacaaagtgggggagaaccggcttttgataagaacactttggttggcaatgctttcgcaaatagaatcgctcttttatttccactctatactttagtctgttccccagactctttatcccaggcttgggctctgtctctgttggctgactaattttgcagcctaggaaccctagcatttgtgtagacaacagttatatatggattatagagtcaacgtatctcagtttccttaggtactaaaaataccacctattcctgcaaaccagccctttttctccaagcctaagaaatgatcacctctgacttctattaaagtaattgtggattttgccattgaaaataagggaaaaaatcacaattcctttgtaccaacttaataaatggtactttcccaaatgctattaggtctggctgtcatccctttcaaagatagctccccacttgagaactttcaaggttttgaagggtctttggaattcttaaatttttagcccttttccatgaattctcatgtttgacaattccgggtgaaaaccttcagacattatggaatgacatagctaccaatctatgagtaaataaaaccagtgttacctggaagcaaggcaattacatcattagtaaataactagagtcctccatgcagaaatataatatctttctccctgagttgagggttttgttgaaagattcaaagccaaaaaaaagtttaaaatctattttttagcaaggtgcagtggctcacgcctataatcccagcactttgggcagccaaggcgggtagatcacaaggtcaagagatcgagaccatccaggccaacatggtgaaaccccgtctctactaaaaatacaaaacttagctgggtgtggtggcacgtgcctgtaatcccagctactcgggaggctgaggcaggagaatcacttgaacccgggaggcggaggttgcagtgagctgagatcgggccactgcagtccagcctggcgacagaacgagactctgtctcaaaaaaataaaataaataaaacaattatatataattataattatattaatataaaatttataataataataattataaaataattatagttctaccattctcgtgtggaattgcaggagtggtgggagctcaggttgttactttaacccctcattctcttactagagcaatatttccttgggttattaatgcatttatttttgagacaggggcttgctctgtcacccagcctggagtacaatggtgtgctctcagctcactgcaatctctgcccaccagattcaagtgattctccttcttctgccttccaagtagctgggactacaggcatgtgctaccagtcctggttaatttttttattttttgtagagatgagcatttgccatgtgggccaggctggcctcaaactcctgggcagaagtcatcaacctgcccagcctccctaagtgctgggattacaggcatgaaccaccatgcctggccttcttgggttatttatatgtccctccgtttggctgagtgaccaacttctactcaagttacttcctctcaacagcttcctctggttttcatccttctcccatatcaaataaattgcttcctcttctgtgcccatcacacctcaagcatctctcttacacactgcgcaacagatattttcccgcaggtctttccaagggactgagcatctccataagctaaagtacctcacatgtcttttatcctcttccccaggtctcactcccatgtaggaatcagcatcccctgagtgtccacttcagttctattcaaccacccaaatccagcactgtggagcgttgttaactaacacaaacactggagggaattcaccagatttttttttccctctgctttagttcaaaacacaataagacaagaatatataatttggtttcattatgagttcgatttctgtagaacattctggctcttggttcaatgtttaattcatatgaaccccttacgaccatgatgtatatttgatcaggagaacaactaccatccaaggacgcaggacaaaaggaacagttgctccatccagattacactgccttgctttttgctttctcttcttctccttcgaagaacattctgtctcttgtaagccagtgttcctactaatagcccctttaaaaatcctcttgaagaatcccactagttatcctgttgccaagtaggtacttcctttataatagctggttgaatgtttctcccattcctttaaaaatagtaaccattcttgcaggaccaagactatgattagtcaagacagacagctagggtataaaatgtaaggcagcgctcactttcaggtgctgatcctgcacttgtgtgactcagagaatggccacctccttaaattttgcacgccagtcacctcctctgccccaccctcatctattccccacattattgcaaagacccaacatgcagctgctctaaaaaggagctgagtgtttgaatcctttctctacccttccagtcgattaattcatggttcctgacattctacttttccagtcactcttccatctgggtcagaatcttggggctcacgcactttagactccagaagaagctacttggcaaaagccagaaattccagatctcaagcctacttgcaatgaacatgttacatttaaatacccactttatgttttagataatcatcaatccctcccaaagatggatattgttaatatgaggaatatctcacagatgactttggtagatgtgtttcttaattaaagtattactcatttcttctttttcaaagcttttaatttatcatctaacaggcgtagtgatccatggaattacccccctcttgatttttccccctttttacacggatatgcttattatcattcatagcataagccaagtgctatggttattaagtgctgtcatttgtaccctaatgactttgtgcctttcacaccattaaaaaggaagttggctactatgaagcactaaatgaagccccaaacaaagactgaggattattaaccctcgtggcccaagtgtgaaggaactaaccactcacgtaggtgaggggagataggaggttctagatttgcaaccacattcatggaaactctttggaatgtagtaaccaaagtccccaactactttccagaattttgtcccaccttgacttttgctcttttgtccccaaggccattggcttttttcagtctctcctgtcacattccacttcctctgcttggaatggtcttctctctctcctcttgccatagctaaatcccatccatcctctaaatcctagctcaattatcacttcttcagagaagcactccctgatcttcccaaccaggtcaaatccccatccacaacctcataacaccatcttaccaagtggtaatgttacatttgtttgagtcattcttggataaagcccatggctccatgagactgtaaaagcctcaccagcttagggggtcttgtagggggttggcttgcttgccactgtcttcccagggcttaacagttagtacacactcagtgtatttgttgaatgaaaaagcttggagccaaatatatcagtcagtaccctggcaggaagcaagcagcacacttagctggggttctaaaggtatcagagttaaggaaaccaactcaacagggatgttgagatgcccagaaactagccacagtaggaagatattacccaccctgggcctgaaggggcacgaggaagcaaaggcattaacagattgcacagagaaagctaggaccttgcaggagctgtagttgtgaagaggcatagctacttccagagacccatcacaaggcaggaatgaaaggggaaatatcttcattctcctttctcctgttttctgatctagcaggatctcattggccaaagccaactggaagccatgggacaaggagcccagtagatatagtccatgggggaatgaatagaggccagagaatggaagagtggaggaaccccctattgataaccaagaccccaaggttgcagcccaggacccctcctcagccctgattgaggcttccagccaccccacctctcctaatttcattgcagacagtaatgactataactactgccgagaaatgaccgtgactactgctcctctgcttgcatggggtgagccaattaaattttccccatgggtcacgcgctgagtcttgaacaccagccaacttcattgagagcatgaactgatggcatgagttcagctccaatgggttgcaatccactggggttaaataaacaaatcaggaactctgcattaatgagtctagctacacagagtgaaatatttttgaataaatttttctgagagcatctatcaggacgctgcagctcctgtgctgctgtctgtctttaaccttgagggaaacagctggggcagttttcaaaaaggatgggcttgaggaacaagagtctttgttggctgcacgtctattcacagagaagcaaaaaatttggagacaggagttccaggctgtcaccaagggggcttctccttggtgcacggtgatctagctcctgcccactccgctttgctaagtcaaccctctctaaatcaccatgaaccgggttcaagggcttccttccagtctttctccttcctccctcggatctgttcaccttcttgttcccttaccttgccctactcctggctctcagatccctgggcctgttccaatctctgatctacattttagagatggaggtgggagaagaaaccattgttctccaaggtttccatggccctcttcttatcgaggactggatcagtctgtgactcacaacagccaggtagcaccacggttcttcatttgacttaggatgatcccagattggcctcctcaacctcattctttctcttaagccccatacccaggaatttcctgccattttcccctggctgcccagccaggatctcaaacacaacactagacatgaatgcagcctcttctccttggagaggaaaccaggtctaatggaaaagcctgggcttggccccctgccttctgaccttactcccagctcctccactatcagctgtgtgatcttaggtgaaacacttagcatctcggaacctaaggtttgttgttccaaaatgaagctcagcaaagatgatgggaatgctatacagatgtgaatattgttgtcatcatttttgtcattatcatcattgcattgtgacaaatccctcactgggaaccccattctgactagtgtgtctagagtatcatagtcctcctggtcagctgtgagtcatctctaattctttctctcctcagtctctatgtcatacccacatcctaatttccagaacctgccagtcatgccacgtaatcactgtgtcctgtagccagacccacccctcacatctgcagggccctgggcaagagtgcaaatggaggatcccagcccgtggtcagtccccttctgtctccaccccagagtcccacccacaccaccaggaggggtcctgcccatgtagtgggaaaaagtcctcatgtggtcttggggccatttgggaatagaattctggaaggccaggaacccaaagcatggtctagaagtgtatgtgttgggggagactttgctttgcatggctgtccctttggcttcaaccaaagggagccataggtaggggtgctgacataggtagggatgcaagcagaggaaggccagggtaggcccctctaagtggggcccaggtctcagagtagaatctctcctctggacttgggagtcaaacagaacccagttggagtcccccttttattaggtggcctcgagtatatcataggcgggaccatcctataatcctataaggaaagaaataggccgggagcagtggctcatgcctgtaatcccagcacatcaggaggccaaggcaggaggacggcttcaatccaggagttcaagaccagcctgcacaacatagcaagaccttttctctacaaaagaaggaaagaaggaaagaaggaaggaaggaaggaaggaaggaaggaaggaaggaaagaaagagaaaagaaaaaatagctaggcatggtggctcatgcctgcagtctcagctacttgggaggctgagacaggaggattgcttaagcctgggaggtagaggctgcagtgggttgtgatcatgccactgcactccagccgggacaatagatagtgatcctgcctcaaaaacaaaacaagaaaagaaacaatcttagggttctgggtgaggaggacatagacagctttcagaaatcgagtagagggcgctggatcctcaagttttctcctaaagaggcttctagtggatccagtaactgtgtcagatgcttaacagacatctgccctcaaccttcacggcagttctattaggtgggtgagaacctgggccgagcagaataataccacgcaaacgtgcccacatcctcatccccagaacctgtgaatctggtacctcacatggaaaaacggactttgccgatgagattaagttagggacttggggatggggagatcctcctgggtttttcaaagagggaggcaggaggagggtgagagtcagagagatttgaagctctaccctgctggctttgaagacggtgggagggacctgcaagcaaagaaatgcaagggcttcttctaaagacgggaaagtcaaggaaacaaattcctccctggaaacaaatgcaggaaggaatgcagccctgccggagccttgatgttaaccctgtaaaacccatttcaaacttttgacctccagaacggtaagataataaatttgtgcttcaagtcactgttggtggtcatctgttacagtaataataggaaactgatacaaaaccttaccttcacttcgtagaaaataaaggggggaaaaacccacagtgtcaccgagaggctgggggaactgcctgaagtcacacagtcagagaatgcaggagcctggatccctcctgagactcccgtggctccacagtacaggctgggtcctcacaggaaaggcatatgcatttggtaaacaggggaatattggggaagccatgggaaagtgattttcacttctctgtgatacttcccagcacagaaatgatttgaagcaatcagagacgagctgtctcactagcaaagaggacgtcttcgcaatacgtgaagaccttcagaacaaaaccgaaagtcttacaaaagggccttccgtggtgcaaatagtggctggttagggacttcaagatctgccacactctccacttccagaccccaggatctggccgctgccttcccctccacctgcccttgtatttttctccaccactctggcctcctcttagagaatcccacgtgggattcagatccacctggagccaaagcatatgttccccctctccctgaatccctattgctcagctctttctgtggctcactccttcctgctcttcaggtctcacccatcacctccttaaacccacctacattagtgtcctgtaagctgctgttcaaatgaccacaaatgtagtggcttaaataacataaaagtattatcttacagttctgaaagcccaaaaatcaaggtgtcagcagggctgcgttcctcgtggaagccctaagggagaatttatttccttcccttctttagcttccagaggccacgtgcgtttttcttgcttcacggtccccccagcaagggcatcactccaaactctgcttcccttgtcccatcacctgctctctgagccaaaccttcctgccttcctcttgcaagaatcgttgtggttccatggggcccccagataatgcaggataatcccccatctcagatttttagcttaatcacttctacaaagtccctttgccatgtcaggtaacaaacatatcctcaggttctggagattagggaatggatgggttgggagtgtgaggtcattctgtctgctttccccagggatcttgtttaactgggtcactctcccccaacccctcaccatctattctccatcgtggaacactgctcacgccctttgtagcacttttttttttttttttttttttttttttttttagatggagtttcgcccttgttgcccaggctggagtgcaatgacgtaatctcagctcaccgcaacttccgcctccccggttcaagcaattctgcctcagcctcccgagtagctgggattacaggcatgcaccaccatgcccggctaattttgtatttttagtagagacagggtttctccatgttggtcaggctagccttgaactcccgacctcaggtgattcgcccgcctgggcctcccaaagtgctgggattacaggcatgagccaccccggctgcctgtagcacatttttttttatgattatgataagcctatttaataagggaaactgtgattcccccaggacagagagagaacatctgtttcagccagctcccggcccagggctttggttctgttgaatgactgaacaaataaataaatgaatgaatgaatgagtgaacgaatgagtagtatagatattatcactcacataagatgagatgcagagagaggaagccagttgttagaatgatattaccaactcaaagcagaaccaggtttcagccctggaatgttcccactgcctcctgccaccatgcacttgggatgctgtcaaattggcctcccagacaccagaagtgtcagagaaagtccagatgtcctttgagcttagaatgttggcatcttgaggtgcttgaatgacatgactcagatttcctccctccactgtctggatgggaaaccagctctgttggagatggcctgagtaaatccagaatcccagccctggaaaatccagctgccaagaccagatatggccagccacgcagctggccgtggcatcccagactgggtgtgggaccatggtcctgattatgaacagactccgctgggccacccaggctgcacttagcaggccaccaagagatagctgcccaggccaggggctctaggatgtggggtaggcaggacaaagacctctaggtgaggctcagccacatgacatctcactgtctccacatatccactttttcattcattcattcatcccagaagctattgtgtgacagatgtccttttgcactatggactctgaggtagacaccattgtcctgcccatatagagctgcaatccccaatatggtagctatgagctatgggaggccaatgaggacttcaagtgtggctcatctgaattgagatttactctcagtgtaaaatacaccctagattccaaacagtcccccccaaaaaagcgtaaattattacttcattatattgagtatatattgaaataacatgttggatatatttggttaaagaaaatatctcaaaattaatttcaccagtttctttttacatttcttgacgtggttaatttgaaaatttttagccacatttgtggttcgctttatatttattttagatggcactgttctattgatttgcaatggagaggagaggctgatgtgtaacttacaaggctggggtaaggttgacatcactagccaactgaggtgtgaaggggtaagtgcttgggcgagactgtgaggttgagggtggagggcaaatacttagaagagctcacatccaagtcaacaacagcaagacaaatccaaggtagctcaggaccagggcactccaggaggggacccaggacgtacagagacacagtgcagagagcccagtgaacttcagatacatcgtaagtggtggacgtgagtgtgtgatgaaaggtgaagaaaagcaataaagccagaaaaggcaacagttaccagctccagaaacatgcagtccagtgctgttcagcagaattatgtgagccacatgcaaagttttaaattttctagtttctagccatattttcaaaactacaaaaaactaattttaataattgttatttcaacatgtaataaatgtcaacaactcttactgaaatagtttggattcttttttatggtgattaagtctgtgaagtctggtgtgaattttacactgacagcacgtggcaatttttactagccaaatttcaaaggcgcacttgccacattgactagtggctataggattaggcaatgcaggtctactagacagttctcttgaatacagtggggaagggttttaagcagtagagtactttaaaaaaaaaaaaaaaaaaaaaaaaaaagcacctctggtggtcccaacggagaagacaagtctcccacgtgctactgagctttctggagcccatcgagcccatcaccactatcttctgggcactgtcacccccgccggggtgctttcacttataaacggtaatttgggagcaatgtctcttttgtgcagactttgctttgccaaggtgttatatgagagcagtttggggtgttgacaacagaggaaggggaagctgccctctcagatcccccatggttctcaccacctttcagatgggcaccagaggcaagaaccttggatgttttatctgtgaaactgtggtgcttaactcagctaatcattgtgatgcttaactctgcttatcatcaggtttctcctctgtgaaactgatgcagacacttctaagaggcttggtgtgtgtggataaaaggaagcaacttatgcaaagggcctcatatggtggcctaagaaagaattaatcaagaacaatatcatttctttccttcaacattgtcatcagaaaggctccaagagcagcctaacaagaggatagaaatgcacacagcgtgaataggaggtcaggctacttaaatggcctcttggaaatactgctaatcctttatccatcctttccgtaagggacttcaaggagtcagttcatttcagaaagaaatatccaaaaagcatgcagattagaggcagccctgcagggagctttttctcctagcatcacaataagctttaactggtgagaaaacagcttttcagtttctctgggctctgtcttactggagaggcagcttaaaagttgttcctagtctccaaggagttttcagatgctaataacttgccagggtgataaataactgaatgctggagatctatgacgtgagacactacctacctcattcctctgcctttgagagtcaaacaaagcagtacggactaggcagaactgggaaagagctttagttttgaagtctggcagccctgagtgccaaccacaattgtgtcacaattaactacgtaatctttgggtaaattgcttctatttttgagcatcagggtacattatctgtaaaatggggatatattttgcaaggtaataattatgtatgtgagataagaatatattatctattattgcatttaactcccccacccccaacaaacttagaggcacttatgatctcccagtttctgtgagtggggaatctgggcacagcttagttggtcctttgattctcacaaggctgcaattggggtgttacaggaaaggggtcctgatccagaccccaagacagggctcttgggtctcacacaagagagaattcagggccagtccacagtgcaaagcaaaaacaagttcaagaaagtcaagtggtgaaacaatagctatgccgtagacagagtagtgagttcctgaaagaggaggaacacgttcaccctgggtacaatgcttgtttaaatgaagaataaaaaaagagcatgggctgggcgcggtggctcacgcctgtaatcccagcactttgggaggccaaggcaggcggatcacaaagtcaggagatcaagaccatcctagctaacaaggtgaaaccccatctctgctaaaaatacaaaaaattagccgggcgtggtggcaggcgcctgtagtcccagctactcaggaagttgaggctggagaatggcatgaacttgggaggcggagcttgcagtgagccaagatcacgccactgcactccagcgtgggcaacagagactccatctcaaacaaacaaacaaacaaacaaaaagagcatggggacaggctctgctacgagggtttgtgataaaggattaatttttttaattactgtattttgcaagaatcaattcttttttttttaaagacagtctcgctctgttgcccaggcgggagcacagtggcgcgatttcagctcagtgcaacctccacctcccgggttcaagcaattctcctgcctcagcctcccaagcagctgggattacaggcacccaccaccacacccaactaatttttgtttttttagtagagatggggtttccccatgttggccaggctggtcttgaactcctaacctcaagtgatcttcccgccctggcctcccaaagtgctgggattacaagcgtgagccactatgcctggcctgatattattatctttaaagcaaaattaggaatgcttctgttctcaagatatcgagatattgttatcagcacactcccaagtctgggtctgtttagtaaacattatcaatctgttcccttaaccgtgagtatctagaggctaggaatacctaactctctggggatgcagcccagcaagtcccagcctcattttcctagccctcactcaggacagagttgctctggttcaaatgcctctgacaaaggtgtcagctggggctgtggtctcaaatggggaagggtctgcttccaaggtctctgtggtcgttggcaggattcagttcctcactggcatttggaccgagggtatctgctcctcattgactgtcggctggggtctgccttcagtttcttgccatgtggacctctccatagggcagctcacaacatggcagtttgagtcatcagaacaaggaagcatcaagagttagagaaagagggactgcaagatggaagtcacggtcctttattacctaattttggaagtgatgtatcatcacttttgctctattctgttgcttagaagcaagtcactaggtgtagcccatgttcacggggaggggatgagtaccaggcaatggggatgactgacaaccattttagaaggtgtctgctacaatatatgaagattcccggtgggcagtagctataatgaacaaatgtgaaaacctttgaaaagcagagctcactacaaaaataaaaggaatctactgaattatgtattagggtcaagaaattttaacaatcatatgacactattaatcagagatcagggccgggcacagtggctcatgcctgtcatctcagcacttaggggaggccaacgggggaggatcacttgaggccaacagttcatgagcagcctgggcaacatggcaaaaccacatctctactaaaaaaaaaaaaaaaaaaaaaaaaggcaaaaaattagctgagcacgtggtgacgcttgccagtaatcctagctacttggtaggctgacgtgggagcattgcttgagaccaggaggtcaaacctgcagtgatctgtgattgtactgctttactccagccaaggcaacagagcaagaccctgtccccccaaaaatgtgttgattccgatcactgccaggttgtccaaagactgcatttaaaagtgcatttatattaaatactgatttgataatatgttaccagactgacgctaaagttaaaaggcatccatttcttctacatgatgttttatcatatatccatagccctttctagttattttagtatatgtgtgtttttatggagctagagattaaaacattttaaatatgcatgtcagttctcatttagcaatattacaacatttaattctgctatgtagtctttgtaattagctgtatatatctttatcttctttaacaaccacatatcatttcctttcagtagacacatgtgagagtcattatttacttaatcatccccttatctctgggacatataagttgcttcaatgttctgccataaaaagcaatactgtaattgagtatcttttgtgtaataagtttttttccccataatttaaattatgtctttaggataaagttccagaaaagcaattagaatacaaacattttaatagctgtgtcaagttgttatccaaatgtgtagaagtcttcggttttcatacaagcaaatactgctctatcaatcagccacagggtgagttcctcaaaggcaggcactgtatcttactttttaattttgtttaaccatagcatctaggctagacgcaacatttaatgaatatttttggactgaattaacacaaattttaaacatttgagacttcaggaaaaatatttaggctagatctattaaaacttttttttttttcttaatcaagagatgttgcatttccacgcagatttcattgagatgtggagcatgggcctgtaccaagcaccaagctccatgttgccctttctggatttcatttaactctcatgcctccctccccatccccacctcaacagttggaattccacatggcaacagaatgaaatgctcaaaaggcaaattggattctgccacaaacttaccgtttcagaggatcccaggagacacctgttggcctggcaagcccccaacatttgaaaagaaacaggaggccctctttcctggggagaatattatagtgttgaggggaaactgcacttagatagagacaacatttcctcccaataaccagaatcgtgagaattttcctgagttcagttcagccttgagtaatgggtcaatttagcccaactacgagtcacagttaaataacattgaagtaagcagggcacaaatgaccttcagaaaatatctctattggtcaaaatctaatctgactaatgcaccctgccaccctgcagcacataattctgagaactccagagaaccttcccccacccttttaaggaatgttcatctacttatttcaagagctgtcaccctcacttttccgacccagaagatgtttgcacaagatcagtgtgtgtgaatggcccaaccagaatgtagttgcaccccagcgtccaacagcaacctcttagccactaaacttgagccgcagcgccctctggtggtcacttgacagtttgagttctccaggccccctttttaactggggaacatctcgcctaaccagcacctctgtttctcaccttttcgcgcaggtgaaggaggccatgcagcggattcacgaccgagggaacattggcaagttaattctggatgtagaaaagaccccaactccactggtgagtgaaaagcagaggagtctgttcagttccacgcgagagagcaccacgggtcaatcagatgcagacacgggtggggtagaaggaagtacaggtagcctgtgggctagtggaggagaccaggggtaatcaaatgatgtcatacatgagggattcatgacaaactgagatgaatgctgaaaaggaaaggccagtgcttcagtgagagcatatcaaaagcaatctgaaggcataggcaggaaagcatagcaacaacagacctgtctattacagctgctagctcttgggagaaattcctggaaaatttcaataatttcacattcatgttcctaacagaatgatgccagctgcttccgagatgctccctgatggttccacagattttttttttctttctttcagagagagagtcttaaactctgtcacccaggctggagtgcagtagcactatctcaactcactgcagcccccgcctcctgactgaagtgatcctcccacctcagcctcttgagcagctgagactacaggagaccaccaccacacccagctaattataattattattggccaggggaggtggctaacgcctgtaatcccagcacttggggaggctgaggcgggtggatcatctgaggtcaggagtttgagaccagcctggccaagatggtgaaaccccgtctctactaaaaatacaaaaattagccgggtgtggtgtcaggtgcctgtaatcccagctactggggaggctgaggcaggagaatcgcttgaacctgggaggcagagattgcagtaagccgtgattgcgtcattgcactccagcctgggggactagaatgagactgtctcaaaaatgataataataataatataaaataataaaaataatgtaaaatataaataaaaatataatttaaaatattatttatattatttttagagacagaatctcaccatgttgcctaggctggtcttgagctcctgagctcaagcaatctgcctacctcggcctcccagagtgctgggattataggcgtgagctaccacacccagctgtgattttttttttctttcaccagaataaaacccttatatcccagggataccaccaggagtatagcatgtcaaactcacatcccacctattctccctggggcctctcgaggaggaactatgtagtggtgtggtcagtgcacagaccatccgactgcatggattcaaaaccttgagcccctgtttatgacctgggcaagttacatgactactcagctttgatcccctatcggtaaagtggagattgataagttcccagttagaatagtattcataaagcattgtctgatatgtactaagttccaggtcatctttttttgagatggagtctcactttatcacccaggctggagtgcaatggcacgatctaggctcactgcaacctccgcctcccgggttcaagcgattctcctgcctcagcctcctgagtagctggcattacaggggcccaccaccacacctggttaatttttgtatttttagtagagatggggttttaccatgtgggtcaggctggtcttgaactcctgacctcatgatacgcccgcctcagcctcccaaagtgttgggattacaggcgtgagccaccatgcctggcccccaggttatctttaacagaaaaaatattcgggaagtgtttcttgtttcttcatttacatacacattgattcttgaagctgcatcagttctttaaaaaaaaaaaaaagaactaaaatttcttgcatattgtcatgtaaagtgtttttttgtttgtttgtttgagatggggtctcgctctgtcgcccaggctggagtgcagtggtgcgatcttggctcactgcaagctccacctcccaggttaatgccactctaccgcctcagcctcccaggtggctgggactacaggcacctgccaccatgcctggctaatttttttgtatttttagtacagactgggtttcaccatgttagccaggatctcctgaccttgtgatccgcccacctcggcctcccaaaatgctgggattacaggcatgagccaccgcacccggccaggagtgtgtatttttaaaagtatttccttgacttgtaaccataatgtaatttgggtatgacagtcatttcattcaatgaaggacaccttcaacattgtaaaacaccctcttgttaagtgactgatacaacatggatataacttattaaatacttactaagttccagggctgttcaaagcagatgagagggcaacgagagggaggggagggagtgacttggatcctgagtctcctgtacacctctttgtagtctttaaacatatgaccaagtctctttcagtcccatttggagaaggcagacaggctctaggcccatcctggaagcttatggctttcaagaaaatagttggcaccaatttcccaccctgggatgctcctgtgtccatcacacatgagttgctcccaagtcctcgggctgataggaaggcctgtcttaccaagggaggattcttactggagcagatgctgaaaaatccacctttcagggtaaaggcacaggatctgcctgtgccacacacaatgtcattgtccttgtttctgaacctcctgaagccttcttttttgaaatgcagtctcactctgtcacccaggcttgagggcaatggcacaatctcggctcattgcaacctctgcctcctgggttcaagcgatcctcccacctcagtctcctgagtagctggaattacaggcacatgccaccacacccagctaattttttttttattatttttagtagagacagggtttcaccatgttggccaggctggttttgaactcctgaccccaagtgacccacctgccttggcctcccaaagagctgggattatagacatgagacactgtaccgggcccccttgaaggcttttatccctgggacctaaagaaacaaaaagacagtagagaatgggtaatcagagcaaccacgtggtggaaaagaggctacggcctatctagatggaaaagcagacttgaaggaaagggagcatgtcttgaggttaaacagaagacatggagatgcaggagggatccagtgaggtcattttagggttagcacctgacagaagaggaaacaactcaagctccaggctccacaggatgtgtcgctgtccgctcagcaggtgctggaggaggggacagaggcgcctgcagaggtgctttctcctactggaatgaccacttttttttttttttttttttttttttttttttttaaagacagtctcattctgtcacccaggctggagtgcagtggtgtgatctcagctcactgcaaccttcgccttccgggttcaagtaattctcatgccacagcctctagaatagctgggattagaggtgctcaccacaccacacctggctaatttttgtatttttagtagagatggggtttcaccatgttggccaggttgttcttgaaatcctgacctcaggtgatctgcccgccttggcctcccaatgtgctgggattacaggcgtgagccaccgcgcccggccatgaccagtctcagccctcactcagccccgaatctgcccagccagcatgctgcaggacacacactgctcctctagaatagtctgggctctaaggcgtgtgggcagcacccaggcaggggaagtcgactgctactggcagctccagaagtaaatttcctgggaaacactaagagtggagtctctcctgctgaaagcctcctcttaatgaggctggaccaaagcaaagtcgaaactcatcctatgatgtgtcatgaggtcagagcagaggcagaactgctgcctccagaccccacagtaccagcgggcagccctgccccagtcctggccatctgaccagtgccccagagaatagaggtggcctttcctgaaggctactgacctctgctgcccttatggattctgtgttcacatcacctcagggtctccctttccactgctgtagaacagaactaacaacaataattactactattgctgctacttcaaagagccatagagaagattaaaagaaccaatgtctgcgagccaattggcatattggtgactatgtattataatatacactactaaggaacagcttagctggttagttcttcattatcctaaaacacttgttgcatatgtacctagtggtagggaagaaaactgcagagacatggtcctctcccgtggtgtctaccgtttggcaggggcagatggacattggccaatgagccattcatataaatgggacattgcagctcttgatcagtgctacaaagaagaggtatttgggccatgaaagctcataatagggagattgttccagttagggaattctgcaaaggcttccttgaggaagcaggatgagccctaaaggaaacataggtatggactggatgaactgggcagagggggtagaggaatgacattccagggagaaggcactgcacatggtgtggccaagggggagaacccagcttcaggtgagacaacatggggagagctgagattcaggggccaaattcctgtttgtcagaataagccatgaagcagccaaggactcaagtgtgggagatctggggcccaatctagatcaggggataagaacagaaaagaaatctgaggcacagatcatgtaggggatgttaatggacagaactagtttgttctgagtctctgtcatatgctcagccctttgctagactctttagatacattactccattttctttcacctggttcttaaaacaaatttataaggtaggtggatttatcgccactgtaatgatggcggaaatgaagacccagaggggtaatcataactatgccaggtaccagtgattaacaaaagaaaaggagtcaggcaaaatccctgtcttcccagaaactatattccagttgggggaagagagaccaaaaagcagatcaatacacctttgttctggttgttgtgtctgctcttcttaagtgacagcatcaagacttcaaccctggggactctgtgcagctgatgctctcaatacccctcacacctccccttggcattcgggtcccctgcgctccaggggcacctcttgtgggcacctgcccctctctgcctgagagctaactcttgtcaccagagcatgcttgagttttgcacagaaactgcgtggggtgcagggagataactcacctcccctgagagcagcccttagccataacatggcttcctcctccctcagaagagacagctctaagatgtgtcccccagggtctctcagaggtccccagcaggactgagtcccactgcccacacaggaaccaacttactaacataccctgcattggattcttcccctttttggtctcatttcttcactcccctgctactgcttcctgggatcatctcctaaattccagatactggtattcaaatccttatctcagcaccgtctctcagggtgcccaacatatgacagctaatcctgcattgccttccagggaaacaagcaaccctagttcctagcccccaagaagtcctcccataggactctgtcagatgctcagagatgacgaggctgggttgcacaaccctcaataacatcctcttttgaattacagatggccaatgacagcacagagaccagtgaagcaggggaagaggaggaggaccacgagggagacagcgagaacaaggagcggatgccctttatccagtaactgaggacccaggtgggagaatgtgaaggatggtttggaagatgaggacccggctgagaaaactcttctgtgccccagtgaacaaatgctgtagtccagtgcgtgtcgtgtttgtctgcagtcagctgagctaaaaagctgttgatcactgttgttttttgaagtgccaatcccatgccatgcagtattatgtccctctcctatctgtgtattacacattcccctctcccctgtatcaaaaccatccatctgtgggttcttcttgacagttctagaacagccttgcaaattaatacaagtcccaggcccaatgcctaagagaccagacgtgggcaaagacaagtttggatggaaaggtgttatcacagagccctgtccagctcctagaattcctcaggccagtgacacttttttgctgctggccacccatgcctctgatgagaacacttgccaatttggccagcagaaagagagtaggccggatgttttcatgagcccacaaatttagaaactctcctagtagtactttttctctctccatttaagagacaactacggtcaaaagtttgagccattctcttctaccccttcagtgtctgaccctttcactggctcttatctgtaaacacagggaggcaggtatggatttttcacagtagacaatgggtcaacagcatgagtttgaggacctgctgtgaagatttctcctccaaaatacatctcatgggcaggattcttcctgctccatatctgtttcaattttaagaaagcaccacatacaagacacattcagaagtcattcctgagcattgctggtgtttgcacacttgccacctgcattaccaattctgtaaatttcaattcctggtggaaagtgaccactttgaccatggatttcccaaagaagagttcctttgcagaccataggtggaaaagtcaatgagcatctccttccttgccaaagcatgtcccaacatgtaacaaactctagggatacaaaaggtttatattcagcatctgatgtcagatgtacagttcctcccctcccatatataaaccccggtgtagaatctgcagcgccctgctcttcggaaaccaaggaacaagccacctgctcacacaccttgttcaacttttcagctcctaaggaaccccacccccatgcaatttgactgtgcttgagaggtgaatacagttaccttcgagaaacagagggagctcctcaccccgtccttccagtccttttggctaaaatgcttaactatcactcacaaacaaatgtggagataccaggagctcatttgattcataccccaactttgtgttctgaaaaacatcagagggattttacattgcccagtttctccaccaacaagccttagggtggacccaaccctttccgcaagtggtaggaacgaatgcatcttagcaattacctgatttccaaagtccttttgtagcaaatgtcacctcattcgtggtctttttacctatcctaagcttatgatgatgagttatgtatgccaaatacttatctgaagagtttctcctcattgtgaatgtgtatgtaaaatatgaagacaagaaagggtgctttcatctgaggaaccaaggggtgagagtatcccaaaggaggacaccagcatcatcttttcttcgtactccaggacccaccaatattccagttctgggtcatttagagagataatggggcgtttattcccctattacctttgctaagtgctatattattggctgtttctcccgtaaccatgctgaaaagggggtcttagggagaactgtcatccaagtggcattcctagtaagttgggtagaaatgacattttccagagctgaaggagtgaagagcccttggccatactagggctctccttcccccggggagtgggaactcagccacattcagaattcacatcgcctttgttatgtccagaggagaggcataaaaaggcactctcccccaccacccctaccaaatctgggtttggtttggttttatttaactagcaaagttaatccagtaatcgcaaattactccagatggttaaagaaaaccctttcagaatacagaacgagaaaactagagtttgaccaataagaccaatttctgccatgaagaaccgggggacgcaagttaattgtttaacgtactctcattttaagcaccttctttcctgtctcttgattgttttttctgaaggaagtgtaaagaatgtctcagtctgccttaaaggaactgtgaaggcttctctgtaatttaagcttgatagaagtgaactgaaacattgtctaatgtctttgtggctttagagcttttgttatattgtgcctataaagcaaattatgtttacataaaaatataaataaagtattcagcatagcaaaacctcacctggcatctgctattccacataattcattgctggataagcagtcgcactattaaatatgcaatgaatggggaactgaaacaagaaaagttaaaaacctaatgggagcatctccagataagaaactaaagaccacatggagaaaataggggttaagaggagaaaagcctttaaaatcactttcaggttccctcaaaccagaaagtaaaaccattaggttaaaaaaatatatatatattgaaaacatcctatgggccgggcgcggtggctcacacctgtagtctcagcactttgggaagccgaccctgtggatcacttgaggtcaggagtttgagaaaacctggccaacatggtgaaacctcatctctactaaaaatacaaaaagtagctgggtatggtggtatatgcctgtaatcccagctattcaggaggctgaggcagaagaatcacttgaacccgaaaggcagaggttgcagtgagtcgtgatcacaccactgcactccagcctgggtgacagaacgagactcggtctcagaaacaaaacaaaaccaaaaaaaaactatcatatgttcatgatgacagtgatgatacagataacgataatagaataacaataggccaagcgcagtggttcatgcctgtaatcccagcactttgggaggccgaggtgggtggatcacgaggtcaggagattgagaccatcctggctaacatggtgaaaccccgtctgtattaaaaatacaaaaaattagctgggtgtggtggcgggcgcctgtagtcccagctattcgggaggctgaggcaggagaatggcgtgaacccgggaggcagagcttgcagtgatccgagatcgtgccactgcattccagcctgggtgacagagcgagattctgtctctcaaaaaaaaaaaaaaaaagaaaaaaaaagaataaaataacaataataatgccaaacatttataaggcaacctactatatgttgctaaaaactgtccacatattaactcacatgccttccccacagccctaagaggtaaggtctatcattatgtccacatacaggtgacaagattgaaacacaagggagcctgcgccctttcctaagatcacacgctactaagtgaaagctacaactcaccaatttccagccatacttttgccgccagaattcatgctcttaaccacctgatcatgctaccttgaaccttaaataagggtaaaatataacgcatttcaaattagtgatcccttgttcactcgaaacccgttagggatttggttttctctgatttcaaggatatgcttgtaaatttgtcttgcttggtagcaaataatatgcgtgtccagaagcatatttatttttcttaccttccatacaagtgtttggtgacatactgattttgaaactcacatgtctcatcaacagccttcgttttcatgatcttaaatcctcaaggttatcaaagagatactaagaagtaaatatccaccagctagggtttcacaaaagaggaattcatggctggggagggtgtattgtgctttaccatctttctcagcaggaagccaacggaacaggcctatgtcagtaaaatatcacatatataaaccagaattgacaaagcagaaagtcatgctgttggtgaatttcttaggaagtcacacactactaagtttcctggttttatttgtgggtttttgtttgttttgtttgtctgtttgtttttgagactgggtcttgctccattgtccaagctggagtgcagtggcacaatcgcacctcactgcagcctcagcctcctgggttcaggcaatcctcacacctcagccttccaagtagctgagaccacaggtacatgccaccacgcccagctagcttttttattttttgtaaagacaagggtctccctatattgcccaggctggtctcatactgctgggctcaagcgatcctcccgccttggtttcccaaagtgctgagattacaggcatgagccactgcatttgacctttgttgtatacttttttttttttttttttttgagactgaatctcactgtcacccaggctggaatgcagtggcgtgatctcagctcactgcaaccttcgcctcctaggtgcaagtgatgctcctgactcagcctcccgagtagctgggattacaagcacgcaccaccatgcccagctaatttttatatttttagtagagatggggtttcaccatgttggccaggctggtctcgaacccctgacctcagttgatccacctgcctcagcctcccaaagtgctgtatgttcttatttaatgctcacattctctgtatgaatctcatggctacatccagccagtgttggtgcactgtcacatttaaaaatggctcacctacaaaaactaaaacgaaatccacatgttcacttataactggaaatgggaaagaggtctactaggagttggaaataatttttttttttttattttgagataaggtctcgctctgtcacccagggagagtatagtggcatgatctccactcactgcagcctccacctcccaggctcgagcaatcctcccacctcagcttccccagtagctaggattacaggtgtgtgccaccacacccagctaactttaattttttgtagagacagggtctcactatattgtccaggctgctctggaactcctgggctcaagcaatcctcccaccttagcctcccaaagtgctgagattacagatgtgagccaccctgcccagcccaaattaatttttaaaggtttgaaggaggttagggtattaacatttcaaaagccatttggggtataggaaacatttgtgtatgagcaaggaggaaagaaatttgaggagcagagaatagaacagtgtagctgaaatacaagatggtggggagggagtagagtggaagacaggcactatgggaagtcagcaccaggtctgggggccgctgaatgccaagctgggaatcttaaatgttaaggaacaaggtcatacaatgaatggtgtgatgtaaacgcttgggaggcgatttctgagggtaggtgctgggtttaatggaaggagaaataagaagagcccataggtggccaggagccagatggtcaaatgccttgactcctcttgccttagtttgggtcttccagaatcagacactgaaacaagcatttgaatgtaagtcgtgttggggaggtgaccccaagaagcacagagggcaggaggtaggggaagtaggacagaagaggaaagaagcccattcaggctatgttggtgagcaggcaccactacaagagtctgtaggcatgatcagaatggtcccattgaagggtaaggaggcagtcatgattacccataaattcccatgcactgttggttggggactactcttaacaagggtgttaattccattcccatcttgctgcctgtatgaaccaagcacattgctgtcgccggacactggtcgcggaaagccacaagaagcgcttggtctgtatgggaactgctaggagatatggaagcagtgcccacagctcctattgtaacttgtctcaagagcttactttatattctgaagttaatgggggaagcttttgaggctttccacaaactgtatttcagtcttagtaaccactctagctatatcccattacctcacaccaccccttctttttttacatttgttctgtcaactgttctcttcacttggagaatagagtttctgctcagaggagatagccaaattgccttgccatctcatcaggatgtgttacttcattaggatcttcctttcaaattgtaggtctcttcttcattgggaccagaaaaatctgggctctctgttacacaattccatgtgtttcctcaacacattttaaatgagcatttactaaatgcaagaccttattccaggtcacagaaatagaaagcaaacaagacagattctgcctcaagaaattcagtctagagctgtgctatccaatagaaatataatgtgagtcacaaagttaaattttctagtcgtcacattagatgagtaaggagaaacacgtgattttaatataatttagcccaatgtttacagaatgttatttcaacatgtaatcaacagaaagattgagatagtttatgttcatttttcatactaacactccaaaatctggtgtgtatttcatttattttaaagacaggttctcgctctgttgcccaggctggaatgcagtggcatgatcctaactcattggagcctcaaactcctgggctcaagtgatgccttagcctcccaaagtgctgagattacaggggtaagccaccacacctggccctggtatatattttatacttacagcacatctcaactttgactagacacactttaaacgttcagtagcacctgtgaccaatggctaccattttggacaggcaggtgtagaagaagggcaggaatggactgtaagatataaatgtagctttaaagatgcaatgggagagggcataatgaagatgcaaagtagggagggaatggcaaggaaaccagacacagagggggcaatgcttgagtgaagtaatgaaagatgagcacatgtcaaccgtgagaataaggtacttaaagcacacaggatagggcctggcacacagcaagcactcagtaaacgttagttctctttcctacctccacttgtcaatgctgggaagaacgggatgcttgggaaaaactcagtagcctttttttttttctttttcttttcttatttttgttgtttttttttttgagatagcgtctcactatgtcactcaggctggagcgcagtggcgtgatctccgctcactgcaacctccacctcctggtttcaagcgattctcctgcctcagccttccgagtagctgggattacaggtgtgtgccaccacggccagctagtttttttgtatttttagtagagacgggatttcaccatgttggccaggctggtctcgaactgctgacctcaagtgatccgcccgcctcagcctcccaaagtgcagggattacaggcatgagacactgtgcccggcctagcttcttttttctacttttttttttttttaaaacaacagagactatatagatctcaatattttgcttccagatttgtttgtgggagaaaataaaataaatgttttggtattctctgccatgagcacagcttctattgccagccaagcaaaaatgctgggaagtatgttattcaaattggcacccaaacacccatacaaagaagaaactcagacaggagtaactgaaacatcaacacagcacaggagtgcacactcacaaacaactgtgcaagagcataagccttagaatctttcaaaccaggggtcaaacttggggaatttgcttggggtctgacctttctcctattaaaatggagaagatcatattgtatatattctagatcaaatgtaacagtgtaggtgtaacccggctgaaatcatgacccacaattccagtccaaaagccaggtaacaaatgcctccaaaaccaggtttctccactcattaaaacactgatcaaatgcctagtatgttcccgacatattatttttagtgtcttagctgcaaaaataagtgcatagcccctgccattcaggaactcagtttaattatgtggtaataaataaggtacttattgtgcaaatggcaatttgtttgtagagcctgccttggtactgggcatttatgtgggccgagtggcaaagaggctgtaattgatgagaaatatctatcaggaacaggcaaagagagacatctaggagaagtaactatcattaggtccatcagtgaggaagcccagggtaggttcatggaatggtccacttaaccactgcatgcatcaagaggaaagatagaaaatcaataggactggattatggaaatccatggatttcacttcaaaggttctggattttgtactaaaagcagaataattcactgagggatgaatcaagagattgctagagagtgtctcaagtaagagaagaccatgggaagtcttcccagaatgagctttactatttcacttggttcagttgtgggaggtggaacagatgaaagtgccatattggaataacagttctttggccagtctcccagcatccacccattgtctatttagtcatgagataaggtgcccatggaattggcatggatgggaacaaaagaactcctctccatttcaggagttgtgagacaaggaggggctgtggttctgtctttctggagatatggggcatcgtctccatggaagtagaagctcccagaaagtaaatcaccattcatgggagttaaaactagtgcaaatgacccatgcagcatattcacaaacactgacactcaaaagattggaatcgttttcaaaaacgtgcccgagctcagagttgacagatgcccatagaatggaattgaatcaagaccaaccatggaaatgaaactagcatttgccgaggacttgctacttgccaggcatttgacacataccctcactgaatcgcggcagtgcctagaaaatcaggcattatcctcacttacagataaggatcctggatttcagagaggttaggtggcctgcctatgtacactcagtcggaaagcagaagagtccggtctagaacccagggctccatgtgacagaaagactcctctcaatggctgggacaagatggaggccaggcattccaacgaccacctggcaaagaaaaagaactttctcttcactagctttagtgtgaaccaaggtgctctcaggaaggctccgattagcccatctttggtcacatgctagtctgtaaaacagtcactgaagcagagggatggctattgattggccagcccgggtcacatacccacacctgtaggttccagcaacctgattgataagccaatcaggaccatgtcaagctgcagaaggatccttataggaagtgatgctggatggttaaacctatgtccactacagctacagtatatggaatactcattgtgtaccagacactgtttgaagcccctgtagaaatcaccactgacacccaccacatattgtcttggtgcaccagagttcacctgcagctatagacagttcctggcatggggacagctttccacatcaagcacctgcactggtctttctactgtgcctgcaggcttcctccaacatcacaggagacgaatgcatgggggtaacccagagttactgtggtggggggcaggtcgtagcttcaaccagtggaagatggcagccagtggataaatgccaagatttcccaccttctagtcgcatgatttgaaggtgtgttccacacagtagctcaaagggccccttggcaggatgaaatgcaaatttcccacaatggcaactcagtcaacagcatgccccttactggcttttcttccttccttgtctcattctcccactcctgctcctgctttctgagatcacattcccaataaaccatttccacccaagtccttgtcttgagggatactattgtggaacccaagtaaaagcattttacatgtcttaacttgccaactacacccagaaaaaaccctataaagtaagtgatgctatttccatttaactgatgacaaaatgaagcacagaaaagtaaaataaagtgcccaaaactacacagctagcaactgagtttccagaattagggcttagaaaccaagccaagttctctctaatgtccaagtcactgaaaacatgcattactgcttaagctggaaaaaattattcaacagctaagctagtgtcataattaaattgacttctgggaccagcccttcacagtatttcaaaagcctgagggagtgagaagggattattgctgttttcctgatcctggagaactctatccaaggccaacaggagaggacccagcagcagtgatgaattaatgggctatgctgggaaaaagggaatcagaccagccccaagaatcacaatacatttgttctcttcatcctttgctaaaacaaacaaaatatcaatttactgagcccaggctgctgctcaggctgaccgcggatgttaagagctgttctgcttgtctttgtttggaggcagaagtttaattatcccaatggtcctttgagattaatcaactagcaatgaaggaagtcagtctatcattaaattgcacttagataatttaattattaactagataaattcagagtgtatttttaaaactcccattcttactcaggacctctcgttctctctctcactctccctcctaatgttaatattatgaaagagacttgattcagttctacaaatattactaagccttggctatgtgtatggccctgttttgcatgttgtgaagaagttaaacacagcctggccactgctggcaaaaagcccatggttgggccgggtgcagtggctcactcctgtaatcccagcactttgggaggccgaggcgggtggatcacgaggtcaggagatcgagaccatcctggctaacgcggtgaaaccccatctctactaaaaatacaaaaaattagccaggcgtggtggtcggcgcctgtagtcccagttactcaggaggctgaggcaggagaatggagtgaacccaggaggtggaggttgcagtgagctaagattgtgccactgtactccagcctgggcaacagagcaagactctgtctccccacctccaaaaaaagtccatggttgagaagatggtgtgagacagggacatcaatcaccaggaaaaagctagaagcataaagagaagagatgcatggggcttgggggcgcaacagtggaagaggtggtgtttggatagaggataaagaagctctatggaatggaggtgggatggacactcttggttttgcctgccaaatttggctcatagttctgtggtcaaaactagagactctgaagacagatggcctgggtttgaatcctgaccagctgtatagttactagctggatgaccttgaccaagttatttgatctctggacctttgctggctcctctgtagcagggtatgatgatgctgaagtgttatcaggttatggtgtatattaaatgagtcagtaggtgtaagatgcttatgtgagtgcctggtacataagcaactgtaattgtgatgtgttttgtccattgcccctgattttcctctggggaaagacccaccctttatatattgtgttggggtttctgtaaatcaacgtgcctagcccttgcttactcaagtgaggctcatgacccagggaaggtcaaatgaatgttctagtaatttgaagtttaagaagagagatgcaaacacagacaaatagggtagagctcattcattctaaagacaacgtccttggccgggcacagtggctcacatctataatcccagcacttgggaggctgaggcaggcagattacctgagatcaggagttcggaaccagaatggccaacatggtaaaaccccatctctactaaaaatacaaaaattagccaggtgtggtggcaggcgcctgtaatcccagctactcaggaggctgaggcaggagaatcgcttgaacccgggaggtggacgttgcagtgagccgagatcctaacattgcactccagcctggtggacaagagcaagactttgtctcaaaaaaaaaaaaaaaaaaaaaaaaaaaaagacagtgccctaaagatactctccatgaattcctgatacccagatccccaaagctgcttaagtttctatttttctctgagaccagaagttttaaaattggattctgtgagcttaagttagccagacctgatttctgttacatgcaaccgaagaaccctatctgataaaaagagagcctttgaactgggtcttgaatcatgtgccagggttataactcagatggttccacttcccggttacatccatataaaaagcacatttattttaaaaagatcaggacacatagctggcaaaggatttttatcgcacatcagtgacaagagcagcctaagagagtatgaatgccaaactatagtcattcctgaaacagtccagatttttcattaagacgtaatggtcaaatatttgaagtacaaaaaaatacagccaacatattcatggatcaagagcagtatttgccaaatttcaattttttgtgtaccactttgtgatttttgccatacctaggtcccgggtatcactaatattttttaatattatatatgtagatatatatacacacatgcacgtatacacacctccccctcaacacataccccattacatcattaatgcttctctttaaatccacctacttttaaagtcatataaatgtatttttaaattatattactaccataaatggaaaataaatattgtccatgaatagaaggcaattataagcattaataccatggagcaaggttagggagtcccactggtcaaatatggagcaatttcagcacaaaataaatacatagtagatcataacccacgaataaaataaaaacccatgagcccagcaataactaatatgcaactgtagtcaaatgccaacaaataaatacaaacaaaatggagttagaaaatcaagtcgttggtgaaagtttaatgagtagcaggttttccttgcctcaaatgtttccccacaaattaccaattaattacaaagtgaaaattgataactttattgttgagaagcccagcaggctacatcttaaccaagggatcaaaggtgacaccaccaatgtgaaccagccgacactacttgcttcctaatagtatgcactgagagggacacaacatcacttccttaatatccacgccaaaatatgcacaactaaatttattcaggaaaaaacatcaggcaaacccaatctgaggaacattctaagaaaataatcccagaaaatggcctgtactcctcaaacatggcaaaatcaaaagggccaaaaaaaaggctaaagaactgttacaaatttaaagagtccaaatagtagacaagacagctaaatacaatgtgtgatcctggactgaattctggagtgaggcagtagcagttggggggaacttatacagaacattatcaggacaattgatgaaatttgcatatgcactagattagagcgcagcgttgcatcaatatcatgtttcctgattttgattattgcattgtgtgtatatgagagaacgtcttaggaattacacacttgagtacttaggtgtaaaggagactgatgttgaatgttgaagacaacattcattttctcagggttccaaaataaatacgcatcaagagacagaatgaagattataaaacaaacggggcaaaatgtagtcaggtgaatctggatataggataaaaaaattccttatataatttttgcaacttttcaataagctagaaatcataataaaaagttaccaaaaatcactaacaaaattaatatcataaaacatgttattagagttgtcgacgaaaaaaatctaacttttgtcagatacagtgagttctgcttcaaagctttagtttttgacctctttgttcttcattctcaagatcagcttttccttgtcccttctcctaagctacctgctctttaaatatctcttgccagtcccaatctgtaattcacatctccgttgtttggaaagagtcctctttgctcctggctacccattctgtaagctgcccctcctgcctaaacagctcttcctgcctttgccgtgccctgacatgcccaaacatgccttgtaccataatggacagcctctcccttcccatctaattagccatattcaattttaaactgtagccaatcggttcagtttagattgtccagtccaactccaaccaacggggacaggacacagaaggagggactaaccacattagggataaaaaccccttccctattttgtggggtatgccctcccagcaaccagaagtgtaagcagcacccttctgcagaagtaaatctggcttgctgagaaatcctttgactgctggtttccttccaactccaagctcttgtttctaacgctttgtaaaatatttgaagagatttattctgacccaaatatgagtgaccatggcccaagacacagccgtcaggaggtcctgagaacttatgtacaaggtggttggggtgcagcttggttttatatattttagggaggcacgagacatcaatcgaatatatttgaggaatacatttgtttggtccaagaaaggctgtacaaagtgagggggcttccaggctgtatgtaaatttaaacgttttctggttgacaattggtcaagtttgtctaaagacctggaatcaatagaaaggaaaagttcaggttaagataaaagactgtggagaccaaggttcttttgaagtctcatagtggctgcccttagagacaatagatgtaaatgtttcctactcaagacctttaaaaggtgctagactctcagttaatctctttgggattgggagggcttgaaagaaaaagatgtagctatgttaagagattctttacagatgtaaattttcccacacaaaggacagctttgcagggcgatttcaagagatgggaaagaaacatgttttggggtaaaatattttgattttcttctttgtcacataatgttatgccagagtcagattggaatgtgagtcatgatatatagggttaaataaaacccatctgatgagaatttatggtttgcagggcaggacttcccagaccccttagatatttgggcaagataagaaaaaaaaaaaaaaatcagaccttaatccccagtggcaagttaaaaactattgcccatcaaattctctaatactggagaccagtttcttaataaaaaagaaagaggcacattttagaaagattttaaaaggcataccaccatcaagataaaaaactacctcgatactataatcaaggtttggagagcattggaaaagaaaaagcatttcccccagtgtgatccaaagctctttaatgtatgtgcgccagtggtaagagcattcaacctggggaaaccttctctcaagcaaatgaggcttgcagaaactttgacccattgagtagctaaaaccagggaaggcggtaggacagagcagcctgacatttttgcacagctcttggctgagaagatgtgccagtatgttaaatttaatacactggttttgcctgttagaaatccactttgctcacaacagttttgaaacagacctcacttttgggtggtgacaatattgtctgcagccaggcgtttctatttaaatgctggctaaacccagcttcaacaatgagtcatcaggagagaagttctgttccccacatcaggagacccagatggaaagagaaaccatctgcccaccaatcctgtagtctatatccagctgccaagcatctgcagtcccacaaatgagatagaactccctgaaatggcccccccaaaatggtcccagtactttaaaagggctaagcttcagtgccaccaactaccaaagcaacctccatagaatttttaatgtggtactgagagagtactgggaatccccagtcatatttatttatctgttaacaccaggaagaatccctgctaagcaatcttgatggattatttcatttaatcctctcactgtcagaggagtttgaaacagagcaactccgtcctgagtgagggctaggaaaatgaggccgagacttgctgggctgcattcccagaaagtgaggtattcctagcttctagatgtttatggttaagggagcagattcatagtgtttactaaacagacccagacttgggagggtcccgatatccccatatcttgagaagagaagcattcctaattttgcttgaaagataatattgattcttgcaaaatatagtaattaagaaaattaatcctttatcacaaaccattgtagcagagctcatctccccatgatcttttcttttttcttttttttttcttgagacagagtcttgctctgttacccaggctggagtgcagtggcacaatctcggctcactgcaagttctgcatcctgggttcatgccattctcctacctcagccttccgagtagctgggactacaggcacccgccaccacgcccggctaattttttgtatttttagtagagacggggtttcaccatattagccaggatggtctcaatctactgacctcgtgatccgcccacctcggcctccaaaagggctgggattacaggcatgagccactgcgcccagcctcccatgatcttttcttatctcatatatatatacacatacgcacacacacataagtattgtacctaggtggatgcgttcccccttagtttagggaatgccctactctgtctatggaatggctgtactttcaccactttacttttttaataaacttgcttttgctttgtactatggactcaccctgaattctttcttgcatggggtccaagaaccctctcttggggtctggatcaggacccctttctggtaacatcaccacatgagactgtgcttttgtttcatagatgaagaaactgaggctaagaaaagttaaccaactcaccctggttctacagccagctacatgataccaggattcagatccaagctgtatgcctccagaaactatgttcttggccactatcaaccactaagctgggttgccccaaggaaagtaaaagaggcaacccacttggtgggttgccaagtgaaaaacagaatatgcagttatattggaatttcacacaaacaatgggggaacaattttttagtataattatgttccaaatataacatgatacatacttataccacaaaagttattgtttatctgaaatttcaatgtaactgggcatccatccaacccgtatttttaaatctggaaaccttatagcaggtaggaccaaacctatgcaacccctagctcagaagacatgtggcttgactattaggccacaagaagcaactacagcttcagaatccaggtcttctgtaaaccttcccaaatgtctacgtgcctaataaccatcaggtcattttttaattttggggcattggtgggatggtggtacgtgagttctagcaagatgccagagaatcccacaaggaattattataaagaacaaacagggatatctgtgagaaaaacctactgaagcagcattgttgtctggggtaaaaaccgggtttgtcatctcactccaagaaaattaaggacacagacacatgtggataggttaaggagtggaaagtttaacacgcaaaagaaaggagagatgagagcagttccttgtgagagagatgctaaggaaaaaaaaagtgggggaaaggtgtggaccacagcagattttataggcaggcttgaggaggcagtggctgatttacatagggctcacagattggtttgaccatatgtgatgtttacatagtatcgggaaaaggctggtcaccccaacctaatcttattatgcaaatgggctttccacttggccagggccatcttgtctgctgcttacttctacacgtggctggcaaaaaaagaagatggagctgccattttgaacatgcctattcccaagtagtatattcctatgggcacaactgtgggcattcacccatgcaagcttccagcttgcttatgtctgcagcttgattttacaggatgttctttgctagaaaggaatatgatttaggggctgctttacattaaaagggaaaccttaccaaggactttgccagagatgatgaattcctcttcaaagggttaattgtgtaatgtccttgtccttggtttggaggcctcatctccttgtactttgtttctagtctgagagcagccctcctgctcttgttgtgccctgacttgcccggacacgtctgaacatgctttgtgctgtagtagagggaccactactgccccctccctcccttgcgaatcacacatttaccctacttggaaaagtttaagtcttagtcaatcggggtcagcttagattatgcagtctaaccctagccaataggggaaggacacagggatagggactgcgttagggataaaaactccttctctcctttgtttggtgtgctcttgcagctgccagaagtatgagcagcacccttctgcagaagtaaatttgccttgctgagaaatcctttgagtgctcattttcctttcaattctgagctcgtttctaacggacttccataccttcactatctaagtaatttcttcttagctcctaaatcacaacagtactgggtccaaagagtgagatagaagcctgagcctcacatctcaaacccaagacaagccctggatggagtgttgcagctgtgtgacctccatgacaccacttttcctctttgagcctcaacctcctcctgtgaaaaaggagagcattgaactaggctggaggatctcaaagttggtctctggtctgcctgcaacagagtcacccagagaaattgtcaaagaggtagattctgtatttttttttttttttttttttttttttttgagatggagttcctcttggttgcccaggctggagtgcagtggcaccatcttggctcactgcaacctctgcctcccaggttcaagcaattctcctacctcagcctcccaagtagctgggactataggtgtatgcctctacacccagctaatttttgtatttttagtagagacagggtttcgccatcttggccaggctggtctcgaactcctgacttcaaatgatcctcccactttggcctcccaaaccgctaggagtacaggtgtgagccatagcacccagcccaaagaggtagattcttgattcccaccccagacaaaccaaaccaacaattttacaggagccagaaaaactgaactttagtaagatccccaagaggttctgatgcatcctgaagtttaaaaccaactggaccaatcttgaaaagtagatgctaaatgaaagaagccaaagacaaaacttcacatattctctaattccattaatatgaaatatccagattagattagtctatacaaacaataggtagatcggggatacagggaggaggaatgaggagtgactgatagatatggatttccttttaaggaaatgaaaatgtcctggaatttgatagtagtgatggttgcacaactcataaatatagtaaaaaaaaaaaaaaaaaccacgggcttgtacactttgaaatggttaattttatgatagttcaattacatcttaatttttatttgttttattattattttttgagatggagtctcactctgtcacctaggctggagtgcagtggcacaatcttggctcactgcaacctctgcctcctgggttcaagcaactctcgcgcctcagcctcctgagtagctgggattataggtgtgggccaccatgcctagttaatttttgtatttttagtagagatgaggtttcaccatgttgtccaggcttggtctcaaactccagacctcaagtgatccacctgccttaccctcccttaatttttaagtataataatgagtttaaaatggtaatgggaaaacaaaatcactcaactggatgatcctagattagggttccccagaatgtgctccccagaattctctgccaaaatcctccgtaagaactgagtattagagttcatcccatggccaggcatggtggctcatgcctgtaatcccagcactttggaaggccgaggtgagcggatcacctcaggttatgagtttgacactagcctgaccaacatggtgaaacccaatctctactaaaagcacaaaaattagctgggtctggtggcgcgcacctgtaaacccagctacacgggagtgtgaggcaagagaatcacttgaatcagggaggtggagtttgcagtgagccgaggttgcaccattaccctccagcctgggtgacaagagcgagactccatctacccccccaaaataataataataataatagagttcatcccagaaggtcatagggcagctactagagaggaagagctctgggaaggtgtgttgataaaagagagaaaatctttggcccagatattcctacacttactttcaccctaaagaacacctgactaagtatctatgaaacagccatttagaggtggaaatccatgtgaaatgccatttcctcaaattcacggtcaatctctgcaattggcatatagataagagggccccttgcatcacaaccttcggctggggaagtggtctgcacagacactgacctacctaaatatatccgcctcctgtaatcatgaccacttcatggtcatttaactcctcttttttcaaacaaaacttcatggcaagtccatcccaagtcaggcagagaatttagctacacttagtaaatatttgcagatgtattgatgaactgaagattaagttcaaaggtaaggtatgcttgcttcatagacacacagctccagcgcagagcatgacccaggatgttagagtagaagaggaaaatatgatgtgatgcaaggagacagacctgggttcaaaccctgccttcatttgttcaacacgttttgattgtgcaccagcgatgtgacaggcattagactaatgaaacggaggagttttcccttattcctccctcagggcatgcaacaggggtgtggctcacttctttggtgccctgctgctcaaacccctagggggagcatacagacgggcaggttataaggagtgcttttgggctctcaccccacagccgtgtctggggttgaatgtttccagctcccaaagccccagcggatgtgtattacagtgaactctgtcagttttgccgtctgcaggcagcttgtattaattgctcaattagaccttctatcttaccataaggaacaaactaatacagaggcctttctgtattccaggtgcttgccctaagtgtaccagaaaaattggatgatacacgggcttagaggatgggtgcaagattttactgagtggtggaggtagctctcagtgaagtggatgggcagccagaagggggatggagtcggaaggtgatcttccccgggagtcaggccgcccaggagctggactctcctttgactgtcccgactaaattatacattgtcctgcctcgatggtctgccggtgtctgctagtgtatgtcagtgtgttcttctgctctctcttcatatttagctgcttgtatctgtgcccactagcgtctcaggtttttatgggcacaggttggggtatggcaggccacagtggttttggaaaatgcaacatttgggtggaaaaacaggagtgcctgttctcactcaggtccatggacacaagcccaagagtggagccctcaccagggacccagcccttctctacctagcatttccctgcccccctcccgtatcactaagtatgggcatggttgggtatatgcctcaatttctctggagctatgagtagagtttctgctgcttagctgtgtgaaatgaccttgggtcatttacagaaggtctctggattcgttttttattactgcataataagttaccacaaactttggggcttaaggcaatgtacatttactatctcatagtttccatgggtcagcaatcggaacatcccttggctgtgctgtttgcctggggtctcacaatcctgcaatgcttttgttagcaggctgtattccctgctgaagctcagagtcctcttccatgctcacagggcatctcacagcatggcagcgtacttctcccttcatggaaggccaggacccttttataaagggctcccagtattaggctaggtccatacagggtcatctgtgaactcaaagccaacaaatttgggacctttattgtatacgcagaatcaatcccttcaccttgtcatattttactggtttgaagcaaatcacaggttccatgcaaactcaagggaaggagattctataagggtgttgatatggtttgcctgtgtccccacccaaatcccatcttgaattgtaactcccacaattgccatgtgttgtaggacgaacctggtgagaggtgattgaattataggggcgggtctttcctgcactgttctcctaatagggaatgagtatcacaagatatgatggttttaaaaagaggagttccactgcacaagttctcttattttgcttgctgctaagaggtgaagccagctggacttcctgggttgagtgcagacttggagaacttttctgtcttacaagaggattataacatgcaccaatcaagcactctgtagctaggattgtaaaacacaccaatcagcgctctgtagctagctagagatttgtaaaatgcaacaatcagtgctctgtaaaaacgcaccaatcagcactctgtagctagctagaggtttgtaaaatggaccaatcagcactctgtaaaatggaccaatcagcaggacatgggtgaggacaaataagggaataaaagctggccatctcctagccagcagcggcaacccgctcgaggtccccttccacgccatggaagttttgttctttcactcttcaggataaatcttgctgctgctcactctttggttccacaccacttttaagagctgtaacactcaccgcaaaagtccacagcttcattcttgaagtcagtgagaccacgaacccaccagaaggaaccaactctggacacaatgccatccacgtaagacatgacttgctcctcattgttttccaccatgatggtgaggcttcccagccacgtgaaactgcaagtccaattaatcctctttcttaagacttgggtatgtctttatcagcagtgtgaaaaataatacaggtgtagatactagggggtgggagggcagggtaatcaacttcaagttctgcctatcatactctgtaagtatcagttcctttcatcgtactttgatattgttcatggtaatagtactgctaatggtaccaaatattttcttttaatgacagaccttcttagagcctttcctcactagtagctgccctgtgaccttccgagatgagttctaatactcagttcccatggaggcttttatcagaattctggggaacacactctggggaaccctgacctaggatcatctagtccagtggaggtttttctcatgttctttgcattttgtagaacagcaaaatgggaggagcttaaaccaccttgcaatattgtcaagagaataaaacaagaaatcgtatagaatgagcaaagctgccaattctcccttaggaagaatagcaaatatttaccatgattcttcatggccaagtcacagaaaaagttgaatggccactatattatagcgattaaggacatggctctatagtcaaactacaaggattttataaatcctggccttactgctgatttacgatctgtaggtcctcgggcaggcttgtcataacctcacgtaaccacaccactttccttataaatagagtgaggataacagccatcagtctgttgggctatcaagagaattaagatcatatacataaagcatttagcttagtgtttggctcatagagctcacataccatcaactcattagcatagctggacaattttaacctcagtaagaaaaggaagtctcaaaagattacagtgacaagtacatatttcaaaaactttaaacttcactataaagtaaaaacaaaagttgtaagaaatccttgaacttggactctggactgtttcccaataacacatgctaatgtgatagctaagtcactgagcctgcagtgcaaatcctgttgcacctccttaaaaaatcctgaaacaagtacaggagccctgcccttcaccttcaggagtagagaatttgatgtcatagtgctacaggtccacattgacatttgatttctccaggaggggaaaaaaaaacgtatttggtcataaagaagccatgagttatttgttagatgagggtgggcaccctattttgcttttatgaagctttcctgggagaaaaaactctgctacatttttagtacctaaataggggatgcatcaggattggaggcagttaaaatagcaattaccaacagcagctctctccggtctacaatatcatagaggatttctatttcctacattatttgcttttataatctatggatttgtagaatgtacatgcatcattgtgcacgtaatccagaaaacaaaaaacatatgtgtatgtacatatgcacgtgtatgcacgtgtgtgtgtgtgtgtgtgtgtgtgtgtgtgtgtgtgtgtgtgtgaagctggaggtagctggagcatctctggacctccaagagggctgatgagagccccagaaaggctccccagaaagcctaagggagtgtttctcaaacttcagttgtacctcagaatcctaggagacttgtgaaaagccaacacaattgcagactaaagccctcccagagattctgatctacggagactgccattgcctaggaatctgcatttttatgtacagcagccccaggcgattctgctgcattttgaaaagtgctggttaggacccgggcctctcctgtgatggaaatgatctgagactgcacagcccagtgtcatctcaccatgacaggggaggccctgttctatacctgggtctgtaggtcaggagtgtgggatggctcatgggaaggggagaaagagcttgcaactaagatgttccaatatatttttaaaaattagatgctaaatttataaaaatatacagatctacagttgcatgaaaagctttttctcaatcctatctgtgaatttctatggcaatggaaataaattcatttgaggataaaggggaaagtctaagtgtcagaccttttgtgaaagagacctcaccttctgcctccctcccttccccctcttccgccgccatgacaagccccagcctaaaaggacattcaaggctcctcccagaaggctcccagccagccagcaaccgggtaccaagcttggacttggcgtcagcctcctgccacctagtggtcagtccgggacacacagctaatttatcttaatttccactccactctcattggttgatccagcggacatttgtctagctcctgtaatgttgccaggcaatttgctgggctatggaggtaacaacgacttcgtcttatagcgctgaaaggaatgtgctggcattagttaaatcattcccaatggtgaaactgaggcctggaggcagggagtatggcttacacagggttctgcatcaactctgataactcgcttaaaatatccttttctcagccaggcgcagtgggtcactcctgtaatcccagccctttgggagcccaaagcaggggaggactgcttgaggccaggagttcaaggccagcctggccaacatggtgtaaccccctctctactacaaatgcaaaaattagccaggcgtggtggtgcatgcctgtaatctcagctactcgggaggctgaggcacgagactcacttgaccctgggatgcagaggttccagtgagctgagatcactccactgcactccagcctggacgactgagcgaaactgagcaggggataagctaagcccagactcttgacctgtagaaactcatcatgaatatgatcatatcataaacaagcctcagagtttgtggtcatttgttacacaaataggaaactaaaaaaaattcaataaatactgaaaacgagagagatgagagcgggaaagtagaaagtgagggaaatggcagaggaaaaacagtaagtaggtgggtccattctgtaaggtatttatttgattttagcaccaatgaactcaggaggtcgaaagatgtaacactgtttcaccctctctgtgggggtgagatgggatgtgaaccttcagcaccagtgactgtctcttcagcaagctcagcagggaggaaataaagtcctattgatagttctgatgcttaagccccagagaagcctccagcccagagataagtaagcttctctgggtgttcatatgtggttcacttgtctgcctgtagaacactggaacaggagctgttcatctccacccaaaccactaagaatgcatttctcacaactcaggttttgtatctacgtggaaaaaaaaaatgctgggcagaaaaaaagctgtatgatcttccttgggtgaaaataaattttatctcagatactagtggacattaattaaaaattcatggaatagctctcaagagagaagatgtcagtaaacattagaatataagctctatgagggcagggatatttgtcagtcaggtttactcttgtatctttgcacctaggacactttctggcacatagtggggccaaccgatatttaacagataaatctgaaagagggtggatagaggggctgctgcagtctagtcaaaactaatcagggtcctctctactcatcgcccagcaaaccaggtctgatcgaatatcttcctgtcacctctacctacctactctcaacttgacaagccttgagggaaatggcgttattccagaggaagcaggaagcagtatgagtcctaaattgtgactgtgagccacagttatatcaccatactcaggccccatctccaggagtgtctgattaatatttaaccaagcattgtcaggtctataaagtaaaggagaaacccaattctcatctttggacttccattcagagtggaacatttcatttgctaaaaagccaataccttgctttattagacagttgtgctcaacaagtccattcaacatctgtaggatgcatttataaatacaccgagctcagcggctcacacctgtaacctcagcacttttggacgccaagacagaagggtcatttgaagccaggagtgtgagataagcctgggcaaaaaagtgagacctcacgtctgtaaaaaaaatatttttttttagattagccaggcatggtgtcacatccctgtagtcccagctactcaagaggctgaggtgggaggattgcttgaggccagaggttgaggctacagggagttatgattacgccactgcactccaacctggattagagcaagaccgtttcaaaaaaaaattagtggaaaaccagaatttgactttgtcacgatggttcctaatgactagaagtaacaaaaaacagcaagagggagagtagaggaggagaatgaacttggagtcatgtgtgccagatgccatatcctcagccatgaatcagacccactctgatatcagatcccatttctgaaaggtgtggtctagtaaaaaatacaggcactgttaaattacaaattacacaaagtacagtgcttagtgtttcaaagagaaagtatccagtactccatgtccccctaaagtttataagaaagttctgacggtcagcagagtccttcctgaaaaggttgaaatctaatggattttgtctggtaaagactctacagcaaaccttactgactacctatctaaaagctgcccctgctgattctcttgttaacagaaaacttggtatttttgtttgtttgtttgtttgtttgtttgagatggagtttcactcttgtagcccaggctggagtatagcagtgtgatcctggctcactgccacctccacttccggggttcaagcagttctcttgcctcagcctccccagtagctgggattacaggcgcccgcccccatgcctggctaattttttgtgtgttttcagtagagacggtgttttctcatgttggccaggctggtcttgaactcctgacctcaggtgatctgcctgcctcggcttcccaaagtgctgggattacaggcatgagccatgggtgccgggcccagaacatctgttttgttcaagtatctggtacttttttgcgctcagaaaatgttctcctggccccagtctaggaatgaccctgtggcccaattttgaccaatgaaacattaaggggaaatccgctagggggcatctgagagcaagttccctctctaataagagggaggtatgtgagcaccatctttccttcccattaataccccctgctccctcctttcaaagtgatgctgtgaagacgtgacacttggaggtgctgcagccatcttgtgactgagggggaagcaatagaaattgcaaagatactaattcagtacccaaatgtaaagccactgggcccacactagaatgaactaccctctctctctaaatatcttcttatatgagaaaaatatacccccatttgttcaacatggtgttaactggatttcttttctttttttctttttcttttttttttttttttgagatggagtctctctctgttgcccaggctggagtgcagtggtgcaatcttgactcactgcaacgtccacctcctgggtttaagcaattcttgtgcctcagcctcctgagtggcttggattacaggtacccgccatcatgctcggccaatttttgtgtttttagtagagacagggttttaccatgttggttaggctggtctcaaactcctgacctcaagcgatccacccacctcagcttgtcaaagtgctgggattacaggcatgagccaccgccccggcctgattttctttacagcagtacatacaactaaccgattcagatttgtagcatgactgtcaggattttagaaatgagttttgtatctattgttagataacaaacaagcctaaaactcagagccaaaaatacaatcatttgttcacaattttgggatctaatgctgtgtaacaattacccctaggccaagtgcagcgtctcatacctgtaatcccagtgctttaggaggctgagggggaaggattgcttgaggccaggagatcgagagcagcccgggtaacatagggagaccacgtttctaacaaaaaacttaaaaaaaaaaaattagccaggcgtgatggtggacacttgtagtcctagctactctggaggctgcaggaggaggatcgtgtgagcccagcagctaaaggttgcagtgagctatgatcgcaccactacacttcagcctggaaaacagaatgagaccgtgtctctaaaaaaaaaaaaattattccaaactttggcaactcaaaataatgatcaacatctagtgtcttctaagggtcaggagtttgggagtggtttagctgggtggttctggctgaatgtccgctggcttcccccagggcaagcaatccaagagagacaagtggaagttgcaatactttttatgacgttatcttggaggtcacatactcccatttgcacaatatcctatccattacacaggtcatccctgttcagtgtaagaggagactatgtaagtatgaatgaatatcaagaagtaaggagcagtcattgggaaccatctggaagtgggtcaccaccacctaccctctaatgctgtgtcacacaggactcagggaaacaaagcgcatcaggagatacacatgtgtgtatacacacacacacacacacacacactttattttttaaactccattttgttttttgagacagagtcccactctgttgcccagactggagtacagtggcatgatctcggtcagctccctgcaacctccacctccccagttcaagtgattctcatgcctcagcctccagagtagctgggattacaggtgcacaccaccacacctactttttttatgtttttagtagagacagggtttcgccatgtttcccaggctggtctccaactccttggctcaggcaatccgcccgccttgacctccgaaagtgctggaattgcaggtgtgtgccgagcacacacacacacacacacacacactttaaagggtttattacagggatttgaccctgtgtaattgtgcataccggttaaacagtctataaactgctacctatgaagctctaatgctggcacttggggtccacagggccagccatggagatgggcacctctcactgcatcctgctttggtatcttgcaaggaaagctggtggctcaccttaactggacacacacagggaagtctgggacacagctgagcatcgccaagtgacactttccaaagccactgaagatgtttacccttcgtagagtcgtggctgggacaggcacaaagacaagtcgggagagctgccagtctccagcttgctttatagccaggtctagaggcgcattcctatttatgttatgaaaaatcagaaagtgatatgcttccaatttggaaacgtttctgtttatatttcaataaaacgtctatttaaaacattgatatgttttatgcagaagacttagaaaaacaaagagaaggccaggcgcagtggctcacgcctgtaatcccagcactttgggaggccgaggcgggtggatcacgaggtcaggagattgagaccatcctggctaacacggtgaaacgccgtctctactaaaaaattacaaaaaaaaaaattagccgggcgtggtggcgggcgcctgtagtcccagctaatcaggaggctgaggcaggagaatggcctgaacccgggaggcggagcttgcagtgagcccagatcgcgccactgtactccagcctgggcgacagagcgagactccgtctcaaaaaaaaaaaaaaaaaaaaaaaaaactaccatctcatcctctcaaaggaaccactattattttgacctatccctaccatacagatactcatctgcacacatccctcacccatggctctctaccgcctgcattttttttcttgagacggagtcttgctctgtggcccaggctggagtgcaatcacgctatctcagctcactgcaacctctgccctcccaggttcaagcaattcgcctgtctcagtctccagagtagctgggactaacaggtacacgccaccatacccacctaattattttgtgttttttactagagacggagtttcaccatattggtcaggctggtctcgaagaattcctgccctcagctgatccacccaccttggcctcccaaagggctgtgattacaggcgtgagccaccacgccgagcccctgcattcttttgtatgaactgcttttcccctttggaaatattccatgggtattttctgtgttaatcaacgttcttttatagcagaattttaatgatggcttaaaagtccaatatattaatccccttttagtaatatccttttaatttttgattagaaataattctttttctgagctgggcacggtggctcacgcctgtaatcccagcactttgggagaccgaggcaggtggatcacgaggtcaggagttcaacaccagcctgaccaagatggtgaaaccccgtctctactaaaaaaacatgaaaattagctgggcgtggtggctggcacctgtaatcccagctacttgggaggctgagaaagagaatcgcttgaacccaggagggagagtttgcagtgagctgagatcatgccactgcactctagcctgggcaacaagagcgagactccatctcaaaaaaaagaaataattctttttctggttcctgctaaactaccatgaataaagccaggccagaggctgtctttgcttctttattttcagtaagggacactcaaggcaagtactaggtttttcaacaataatccgagctatctggtatatattttggagggtggcccaagtctcgctgggcagaaataaattatagaaagaagccaggcatggtgaatgtgggtctttcagggacatcagcctgtctcctggacttgctgtctccacacctaactggcccggctctgcgagcgtttcctgtctggtttccatttgaagaaaccctttagcgaaaaacagcatccagtgcaaattggacagtccctctgctgatcagggaaaagcgaacgctgaaaaaaactcctgagatgaaaacgagacactaataaaacactgactcctaagctgtttaccagacattcaaaatggatgtgctggtggtttcctgaaaggaaagaatagttgtctcatattctgaaccccggcaggctctcgcctctgagaaaaagcaatgtgttccagataccagtaactctccattaagcctgccatcttcctcctagcctgcaagggcctctcaacacatctgagaggaaatataaaattgaaatctacctcttacatttttttttcctggtgggaaaattggcatttccctttttaaaatacagttacgtatgatggtgacatttggggcattattcgattatatcagggagcacaggccaggcactgtggctcacgcctataattccagcattttgggaagccgagatggacagatcacttgaggtcaggagtttgagaccagcctggccaacaaggcgaaaccccatctctactaaaaataaaaaaaaaaaaaaaaaaaaaaaagattagctgggtgtggtggtacatgcctgtaatcccagctactcaggaggctgaggcaggagaattgctagaatcttggaggcagaggttgcagtgagccaagatcacgccactgcactccagcctgggcgacagagtgagactacatctcgaaaataaataaataaataaataataataataataataataataataataataataaaatgtatcagggaacacaaaactccctaaatcctgccttggcccatctaaccctcttcctccacgcacagggacaatggtgaatggacacacagaccagctatgctggtacagagcttgtgccccaaaccccactgcagagaactgtgcagtgtgtgctgggctggaacagagtatctccccaaatttaggagcctctgcatctttctaagtctaaacttgtatttcaggaccttatcaccatccattcagttgcagaaacagagagatcagaaggaatgcccaaagaggaagagctggctgttcccagcaaagcccttttaagagccagtgactccccctgcttatccatgtggcccaatcactatcctaaaaattgacctaatccaatcagtgtcccttcctcttgggaaggagacaggctaagacctcctctttcccatcaaccataaaattggcaatattcacttccgttggcccagtaattattacttactcatgcttaatacaggctagacattgttctgagtaggtaccttataagcatcattatgtttaagcccccaatagccctatactttaaatcctactattgcccctatttggtagatgggaaaacttgatgcaaaagccaatggggagcctagatttgatcccagatgatccagctccagtctgagttaattagtagactatgctgcctttcaatcaatccacttcaagtatcatgtgtcctaaggaaattacctatagaaaaaatattgacacacaacgatgttcatctcatcatttacaatagaagcaaaattaggaattaaacaatggagaagattaagtaaagtaaggtacatgaaatatacatacattaaaatgatgtgcaattacctgcattgtcagcagactaacagttgtaaacatgtagctactgctcatcaacggaaagcttatgtataatacagagagtagggttcctgtcagccttcagccagcttcctaccaccccaataacattaggagagaatcaggaggcagggtttccagcacagcctctaggagaactcactaaatagacagttatccccaaccttgacaaaaacttccaaccaggatgaaaaccattcaacactcccaactatttaatgaatattgttagcactttttatggggcaagcgttgttccaagaaatttcgtgtgtattcagggatttaatctctacctggcaggtagttcagttattatcctctcttcctatgagataggaggcatggcaacagcacacagctgagaagcgggaaagccaggattcaaaccaaagtcatctggttcccgggtctgcaacttaaccaccaccccacacagccattccagcacagcctgcggtgagagccaccttctgcctgcctgcctgtgggcatggatgtgtgtggccctgtggccagcacatttctggcttgcagagtgaggtacatgcaagattgtgagtccggagatgggattacgtagggaatgggttagtggtgggaactggggctggagattgcaaaagcaccaattccacctaccacacacccttcccacctgctcccaaaatacaagcagacctccctgaacagagacatccatagaaagaaccaagtatttgtgtgtgccttaaatggatgatactagacactattttgttctctgatgttatttttactctatagtgtgtcttacggtctgtgcatgctggaacatctatttatttttatattttgagagatgggctctcattctgtcattcaggccgaagtacagtggcactattacagctcactgtagcctccaactattagactcaggtgatcctccaaccttagcctcctgggtctgtagttagggctacagacactcaccacattgctcaggtaatcacaacttttttttgagagatggggtcttgctatgttgcccaggctggtcttgaatttctggcttcaagtgaccctccttcctcagcctcctaagttgccaggataataggtgctcgccactccacctaggtcatgttggaacatctagatcttcccacttctttgtaatggcttcagagttttccacagtaggaaaataccaacggatattgagccattccctactgatggatatgtaagttgtttccagcttcttcatattttaatccatgttgcaataaccacccttatacatgcctttttgtatgtgtgcatgtgaaaatgtttctctgccagaaacacctagatagacatagtagaggataagcatacacattttttggttttattgttagacttcaaagtagccacactaatttacatttgccccaacatggatgaaaatggttgtcctatgtcctcagtactcaatataatcaaactcaccacaatcaccaccaccaaaagattgagacaaaattatggagctactgttttaacacagatttcctacttgttatcaagatcttaccatagttttttttaaacccattttgatactgtcttttgtgtattgcctatttatattcttgcccattaaaaaaaaaaaaatcctttcccagccgggcatggcggctcacgcctgtaatcccagcactttgggaggccgaggcgggcagatcatgaggtcaggagattgagaccatcctggctaacacggtgaaacctgtctctactaaaaattcaaaaaattagccaggcgtggtgacgggcacctgtagtaccagctactcaagaggttgaggcagtagaatggcgtgaacccaggaggcagaggttgcagtgagccaagatcgtgccactgcactacagcctgggtgacagagtcagactgtgtctccaaaaaaaaaaaaaaaaaaaaaaaaaaaaaaagagttccttgtatactctgaataataattccttttatgttacattgctaatattttctcctatgggttttcttttttggttttaactttataaaaacttctgtcatgtcaagtattttaattttgatatggggaaatttctcagtttttcttttatgggttttcctcttcataggttgtttcacaaagtcttctctactcctatgtcataaagatgttttcctgtatcataggtttatcattttaaagtcaactctttaagatctacttgctattttcctcagtgcaatctggctttcacatctaatgcactagagaagttattggaagtcactttctaagtcccaaaaccaaggtttattttttttttctattttatttctttgatatatttgccagttccgtctcctccatccacccgaaaaactttcatcttatgttcaaaaaaactgtttcttgaatcagtagagggaaatgcagtttttttctagctttcttgaccgctaaatcttttctggctgcctttactcacctctcaaatacctgaatccccagagatttgtctctgagcctactttatctctccacatgtgtcctggcttcatatccatcatcaaggtttccactattagtatattaatcctctattaacaaatacttgattccccaatgcaactctttctacctcattcacatacccaacatttccagtcatcaactaaacaaatacagctgcatgtccagtgaaatccttaagaccaacttgtgcaataccaaattttttctacccttccatccttcttcccatctgttgccttcccttttcttttggaaacagtcttgctgtgtcacccaggctggagtacagtggcacaaccttggctcactgcaacctccacctcccgggtgcaagcaattctcgtgtctcagcctcctgaggagctgggattacaggtgcataccaccatggctggctaatttttgtatttttaatagagatggggttttgccatgttggccatggctggtctcgaactcctagcctcaagggggcctcccatagtgctgggattacaggcatgagccactgtgcctggcctttttctcttctttgtctttattaacctcagaaccaaaagaagtgtacataatgccttgaacgaacaatccatctaattacctggttccttttcttattttttgtgagaaacagggatcttggacacaatttccttggtttaccctttaagaacaatttcttcaatttctccatgcaggttttcaggttcaggaagcacttcctggaaaggtgactaaaaatcaattcctttttatgtcatttaaatagaaaggaatagctttactgtttattaagcagctcaaggagagcaccagatgaccttagttccatcactcaatttccgccagcatcagggttggaaaatcagttcatccccaaaaaggcaaactttcccaatggttcactctgcaacctgcagtcatcttgcttcaagcacagttagagtcagcaagcctctgaattctgaggaagaacaagaacactgttgttgtcacctgaaggccaaaaactgtttctaccaagtctaaacttgggaaggccacagagaggaattaggaagatttttccactctgggctgcccttgcttttggtgaaagggagaggaatactggctttttttgtattcttggagtatctggcagcaggatcaggcaaaaatcacaataaattttatatgtcagtacacctaggaaaaacagatcaaccaaatgcttgccttcctttaaaaatggactgttcactgcagtgagtgctggaggacaaggtagaggggacaaccagatggggacaggctggatgcatggagaggaatggacttcagggtcaagttggtaagaactaagatattattttaaccatgataatcattagtagtaattccacatattaaatatctctaatggatatcagccattatcctaactgttctcagggcatctgtttaatctccccatcgttgctggtaaacagtctttatgatccccaagatagaggaatatgaggctcagagaggttggtgagcttgcccaaatcacagagctggcaaacgagagcaccacagttcaactccaggtctgtgagatgtcatttgtgcatttttccacgactgcaagttgctttgggaagtatagaagtgaggtgtctggttgtgtggggccaagagtacagtggcctcagcatcatgtctgatgggaaggagccaggagaacactgggtcctagaagagggaagggagctggtataagatgaaatcacacattagacaccagcttagagaggtgacaaccatgtgcacagagtagaaccagagggaaccagtcagaggcagctgtaacctaagcagcgagaacccaaagagcttacagtaatggtggaagtggtggaaacagagcaagtcaagtacagcaatgtcaggggaacttcgtgaattaaattgggggctgtatctttccttacaggttttcaagagagagggctggtcataataagacagtaaaggaggcagaagagaaggaggaatgccttctgggtaagacacaatgttctagcagtaaaactagcagccttgcttctaggtagtcaattttccatcatggacaatgttcagagacttgccagctgttgttgcatcagggatgcaagtatcaacgcgaatttgatgactgcaagtctttccttaacttgagattctgttgttctaatcttgctgccctgactttaccagaaatttcacaatgacctcctaggtaagcccaaaaagccccatatcccttcaccaccaggtgggccgcacccccagccaagccccaatatgggagactcaagtctgaccaactcttagaagttgagaagtctaagaaaattcactaagcctgggtctcatcttctataagacaaggatatttatatcttccttactagatttacatttaaaatctagcacagtgcctaggataagacgaattgaatctaagtcacctatctattgactgtaaaacctcttggttgaacaattttatataatacccatttacaaaatgcccccctaaacattagtccatttgctagacactagaactatgctatcaagtatggcagccgctggccacatgtggtcatccagtaattctattgtacagcactagtctagaagatcagaagagaataagacaatgtgcatctctaaggccaaatatttggctaagggtggggggtaatataaaataactgcatgttttagaagttctctagtagaagcgtgtttaccatgggtgcacatggaaccaaatctgcgagactggggccagggcagtggcaagtctgagaaccttatgcaagtatgatgggttgtgtacctgtatgatggtagtgcaggaaacccagacaccctttgattgttcacctactgtaatgagatgcgtctgtcttgtagacacatgctctggcttcctcaacggtctgcaaaaatcgatcggaacatcaaggttcagagacatgaggaagtccaacccctgaggcaaaagcaataaacaacagatctgagactttaatcccaaactatcaagagttcttgttcttggcctatatgcggcactgctccaatttagcagtctcttaatcctcttccctaaaacctgtcaccatccctttctgtaaattctttaacaagtaatagccagctacaagtaatagccacagtagccagagtagaaacggaagtagaaagccaaaggcagctttgcacgtatacagaaaccgacctttcctataaacatttcaggttgcctgtgctatatccaagtgcagtcctatcgcttcctttaaatgctaccctggaacctttgaacacagcctttaaacatgtttggccttgagtattcatggagaaataaccatcaggccggatagatttgtttattagaattcaagactctggaaaacagcttagagcaattttaaaatagcatccagtggaataaacacaccaatggcacagggtggtcagtgaatgtgttgcaaacagccatttattaaagaaaatgaaaccctggtgacagttttaaaatcatcatcaaaacgctttttgtctaaaagcaatatttttatagcgtctatccctggctataaatgtggtgtttcttcttaaacagtcctttcagaaccccaggtccagcccaggagacaagctggtgacatcatcctgctctacaaaaaaggaattgttcagcctccaatgaaacagtgagatctgccttccccaaagacaaggtggggcaggggtcaccccaccctgttatctttgatgtgtgtgatttctttttttttttttttttgatgtgattttttttttcaggtctctgccatcccacgtgcatttcctgataagatatgagggggagagcctcacctaaatgggaaggccatgtctgatgtccgtcagcatttgtgacagggagaaaaaccttcacgtgagaatgttctgaggtccatcactatccacagaccctcatcccacttcctcttctcctagccaatcctgtcagccatttagtttatttcattttctctgctttttccctgaagagggataagctggagttggaattcctacaggaggaagacaagttaaaggacagcttctgtccctgtctggcctcagggccaagaatccacaagacaagcagagcttctccagtgccgagtgtgatgatttcttagtgtgactccaagtgctggtacaacagatgagtctcagtctctttactcttccatgggttgcgttgctgttttccttggttggccaaatgccttgttgccttagagaggcggtgggaagagaaggaagcaaaagcaaagctgttcagccacacattcaaaaataattattgagcaaatactatgtgccatgtgtcatatcacatgcatggttgaactaacctgacatagcccctgccctgcaggagtttacagaccagcatccagcaagtaaatcaattaagtaggtaagtctttaaatgagaagcaaattgtgatgaagcctatcaaggaagcagggtactttgatggagaaccacagggcaggacctttctagattatgcacattgagaaggcttctctgtggaggtagcatgtgagttcagacctgaaggacaaggtggagttggccttatacaaaacagcacacaccgagatatcaagtttgggaaggcatggagtggactgacagaaaacccatgagagaaagcacagtgggggtgtgggaagagacttagataggatttagaaatggcaaacggtctttgcaactggaacaagtcaccaggaagaaccaggtaaaagggcctcagcaatcatgataagcaatgtgggtttcattttaaatgcaatggaaaattctggagggtttcaagtaggtgagtgacaatttcattagtgatgcgtggtgcatccatttgaattggaaaggggctgagttgggatgggttaggacaagagctcttgacttggaatgggatgatgatggcaggagtgaagaacaaaggtcacgaatcaacacgtatgtgggggcacttgctgctgacaaggtcgtggggaagggtgttgagggcaaggacaggggcctcataaatgcctcccatgtttctgaattggcccattgagtgggtggagacattaactatgacaagggagactctggaggaatgagacttaagttcataggtcattagtgagagaagcagctagaattcaatatttgactatcatgggttagaaatgtctgagacattgaattctaagtgtcacatggacaactggaaatatgagactgaagggaggagctccaggttggggaggctgatgcgggagccacagacagcactctgaagccatgagaagaattaaggtcttctagggagagagtataggggaattagagcagccaaaggagagctctgaggagcaccaggcaccggaagtgaggaagaggtgaattctcaaatatttaattagaacaaaaagcaggggttaaatatcccagtgaatagttaatagctaatagtttcagtgaaactattcagtacaacactatacctttgtccaaacccacaggacgaatactaccaaaatgaaccctaatgtaacctgtggacttcagttaatactaacatcagtattcattcagcagttgtgacaaatacacaacattaattcaagatattttgtgttttgagacaaagtcttgatttgttgcccatgctggagtgtagttgtgcaaacatgggccaccacggttgaggctatggtagcctcaacttcctgggctcaagtcatcctcctacttcagcctcctaagcaagctgggaccacgagcacgtgccaccgcacccggctaattttttctgttttttgtagagataggatctcatcatattgcccagggtggtctcaaagtcctgggctcaagcagtcctcctgcctcggcctcccaaagtgctaagattataggcacgagccaccacacctggcccataacttgaaatttttttaaaaggatttaggaagatggcaaagaaaatttttgatcaattgtaagatcaggtgtaaatcattgatcttttcccctgttcaaaccaaagcacattttcacagcccaggtcttctggagttaatcaaaactggattgtaatttctactcagttccttgagatcttagtgatgttagacaaaaaccacttaacttttgaggctcaatcacctttaaaatggagataatattattacttatcccacaggcttgctgtgaagactaaaaagatggcattccataaattgtatgtaccattgtaattaatggtaaggatcttattattaaatactggacattgcgctaagtgcttcatagccattatctcatttaatctttccaacagccctgtaaaataagcattcctagcccccactgttaagatgagagaagccttatagaggtttattgacttgcctgagatcacacagctaagcggtaggttgtgaactgagctcagcctgtcttcacaatgttctcaaatgcccatgcattaactgcccatgttggtacaaagagtcaacaccggaggtcagatctttaattgtacagttactttgctgaatcatgtcagactttcctacatcagtggtcttactatggtcttactatattggtaggttacaaaatggctttaacttggaggaaatgaagatgaaatagactgtggtttttctcattaagattcagaaggaagcactcattccttgattctttctgtattgtctcaaagaaaaaacaaaggcaaaatgaacttggtccttcagaccttccaaatctgcaaccactgccctccatttgcacctggtcagccaaataagcatgtggaatgcaggaaggcctttccctgggtctaaattcctccctctcggctattcctgtaatgcaagtccattgcttttgatgcaaaagcctatcaggtcccgaaaacttgcccttaaagcctatggttaaaggtaggaataattgagtttctcattacattaattttatttttattttttatttgagaaggagtctggctccgtcgcccaggctggagtgctgtgacaaaatcccggctcactgcaacttctgccttgtgagttcaagcgattctcctgcctcagcctccagagtagctgggactacagactcctgccaccacgcccaactaatctttttgcgttttttagtagagacagggtttcctcatgttggccaggctggtctcgaactcctgacctcaagtgatccacacacctcagcgtcccaaagtgccgggattacaggcgtgagccaccacgcccggcgagtctctcactaggtttctgtgctattacatcatgcacttgaaagtgttgtttaatgtgttcaaggaaaaatgattggtgaggacctgaaaaaatagctattgatctattacattaattcttattctaatggaaataattcactttttaaaattttcttttcactgtaaggtacattttcccaagaaagtaatttgcccgggctggagggcagtgatctcgaactcctggggctcaggtgattctcacacctcaacctcccaggtagctggcattacaaatgtgtgccaccatgcctgatgaatttttttatttttttgtagagatggtgtttcgccatgttgcccgtgctcttctcgaactcctgacctcaagggatccacccacttcggcctcccactgggactacaggtgtgagccaccacatgcagccccaaggaagtaattcttgatgagtctacaaaatcctaatggaggaaagccctatattttatcatcgagtatctatttccgcaatctccataaatcccactgagaaaactacttccaagctacacttgagctgcgcagacacatgagtatgagtagacacactggcttgaatggtgctgtggcaccacacacacacacacacgcagtaactttcctttttctccaattttttttttgccctgaaaactaaattgaatccattttccagaacatttagtgaatttcagagttccaaatcaaagaatttttcacaaagaccccaatcttctcagagtttaaatttaaaaaaagaaagcaggctaaacctgtagttaagtttgacacactccaaaaaggcaaatcactaggaaatgcagcagaaattaaataaatagaaagcctaacatgaggcacaagaacaagaggccaccttatgctgtggccagcagaggcattcaaacattccgtcagcaggattccagccaacctccgaagctcacttttataagccagccccaggcatcccagagcaagatgtagctgtgtagtctccttccatagctgctctaagggggctggcaacatggctcagcaggcttgccccagagccatggcaaagaatggacttgtaatttgcatcctggtgatcaccttactcctggaccagaccaccagccacacatccagattaaaagccaggaagcacagcaaacgtcgagtgagaggtaatggggcttctcaatcaagcaaaattctaggcttagacagtgtggggaggtgctggacaatgttaattttcaaactcctccaggagactatcttcggtgatggcaccatgccatcatccctatatggcatttcaggggattaagtgaacttgtaatgctctgggatagtttattttaaagaaaccaggctgctgggttttaaaaaaaaacaacagggaaaaaatttgatagtaaaagaattctgtgttgtatattttttgttaggtgggcttaaatagaatgtgcttcagaggaagctcaagtggatttctgaaaatctggtgttattaatatggggcaagaagaatgtattaactgagcacactgtttcactagtagatattgagtaactcaattcagttatattttaagataactataatcttattcaatgtgtagcagaggatagagattttggtaatggtgacttcctgttttgtcattagttatcattagctgtatttccatatccttggcagcataaggacaacctataccatatatttaaactttttcatgtcagagacattgaatctctccaacttaaaaaagtcaatatgcaaagtcatctagtatttgaaggcattgtgatgcaaaactgaatctcccaggaacctcaaattttgagtgacttgaattgggttaacaggttaaagaaattgaaaagaacaatgatgatagcgaggtgtttgcaatacgttgaaacctaagcaaaagaaaaaaacaagacagagggtcatgttttatcacatcctctgcatcattttcatttcaggatatttcagattatgactatttccttattttcactccattagtaacaacacacacatacacaaatttcagcaaggttacagtctatttcacatgacagatggctggtgggtaaaaaggggtcttgtgctttaaggattataaagtaccattttttcagggacatttatttacaaaatttaggtctggtgcaaggtttcttttttttttttttttctgagacagagtctcgctctgtcgcccaggctggagggcagtgacacaatcttggctcactacaagctccacctcctgggttcacgccattctcctgcctcagcctcccaagtagctaggactacaggcgcctgccaccacgctcgactaattttttgtatttttagtagagacgaggtttcgccgtgttagccaggatggtctcgatctcctgacctcgtgattcgtcagcctcggcctcccaaagtgctggaattacaggcgtgagccaccgcgcccggctagtgcaaggtttcttaagtggaatcttttttccttaagaaatactgtacttctttcggtgaaagattaaaatatttctcatgagtagatgaaacatattgctgaagatggtatcgaaaggagaggggagagagaagatactgggtgacatggtacatttctgtagccagcgtttcttcactgctggatggagtggcactcctcgtgagagtggcgatcacccagtaggaatgtgtgaagagggtctgaacatgactgagtgtgcatgtgggtgctgtgtgggtgtttctgaagtaatcgcagcttaggtcacatccaggttttccaggggcctccctccccttcctcctcccactctcttctctctccctaccttctttcccacttctttacccccttcttccccactgcctctgtcataaccacatgtgcatgcacatgcttttatttaaaaacaaaacaaaacaaaactgactaggtacacacctcttaaatgtcattcccccagtatagtttttgctactttttgccattaggtcctagaaagtagattctacagtaggtgaagcaataaacctaaaccgatcaagcaattatatccccacccatccatatacttttaaaatagtttaagtaccttgaaatataataataccagtgttaaagagatcaaaagtgaaagccatcttctctctcccaatcctcaccacaaaattatccactattaactatcaggtaatactattcccagaagttttgtgttttgttttttgtaggattgtttgttttgagacagagtctcactctgccacccaggctggagtgcagtggtgtgatctcggctcactgcaacctctacccaccaggttcaaacaattctagtacctcagcctctcaagtagctgggactacaggtgctcgccaccatgcccagctgatatttgtacatacatcttttttagtatagatggggtttcaccatgttggccaggctagtctcaaactcctgacctcaggtgatgggattgcaggcatgagccatcatacccagcctattcccagagtttttaaaatgcacaattaaaatacatatttttaacaaaataagaattggctatgcagaatgtttggctaggcaaataaatttatttcatctattaaaccttggatagttaccagtgtaagcaatactttattcattttaacagctgcataatattccattgtttggatgggtcatcacttaatctgatctctcccaatacatctctttttgattcaatagccccaagtaactgctttgcacacatactgctccccatgttaggatgttatgagacatttccagaagtaaaattgcaggttaattatactttctaattgtccctccaaatgataacaccaatccatcttcccatcttctgtgtatgggagtgcccattcctatgtattttgacagtccaacatcatataatggttttactggccatgtcttctgggaatgacttttgtgtttctacactgtgtctacctctggagagcaacagtaaaatgaaagggagccttctgggggactcaaaatagcaaccgaagaatttagcttcaaacacaagatctctctggtacttgcttcataggtctcaatttatgtgttgcattcatgaataaaatatgacttttccagctcagtagttgttccacatattccctttgtttgttgtacataaaagacatctatatcagctacaaaggatggaagctacagccaagtccctggacaatgaatttcataaccatctcccaggagcctaatatcaattcatgtgtcttcatgttaattacaatgtttacaatctcccagtagaggccacttatttaaggagaatggagcaggaagctgagagggatgggggatgacatttttagaggtgacagcttataccttggaagaaagtgttcagcagtctttgcaagcccggcccccaccagctgatgaatttgcattctgaatgcacccttacattttttctggattaaatggtcacacaggtaaaaatctttaggttatagtatttctgagctgagccatgggatgctttgagaactgatgtgtagcattaagtaaaacagaggcaggggccacccctggatattccagaagacagcttcctaacccaaatgaggaaacatctggcttatgaagcacatgtttaaggggacagtgaattagcacatgtgaattttagactgtcctgaaaaatccagtacagaacatagacttcctccatggaatccccacaaagaagcagctgggaacagttcataccaagctttaagtatcttctctgtctggggccatgtgctcgggaccaagaaggtagaggcaatcactgtgcagaagcaggtaagagggatgaaatgagaacaggcctggagctgggcaaatttaaatcccaattcttcactttactagctgggtgaccttcagcaggtgaattcagctttccgggactctttcttctgcagaatggagacaatgattgtgtctctctcaaagcactactgaaagaattgatctctgacaaacagtatgtggaagcttttaataatttttgttatgatttataattcctgcttttgaagacctcacaagctgccaatctctaagagaatccttattacacctgaaatttcaatttatccaaggcttcttgttttctgccacttacttatagccaagattggtcaaggacagctataaagatcctttagcctcatccaggaacatacaagacttaagttgctaatacctaatatagacgtatttctatatgaacctttagcacttaaccctgctagtagccaccatacctgaggcatgtgttgagtcggaacactggggacaggggacctggggacccaaatcagtcagagtatgaattctgccatgtatcttttgagacactctcattggacttgtcctcattcttcagtgggaatccaatttttctcccttcatagctatgtttgaagagcaagtgaaaacaattttgtataccataaagtgtgtattcactagacaatattatgaacacctattatgtaccaagtatcatgttaagcatcagaagaaccaagaataataagacagatgaaataaagtaaaatagagaaaagaaaatatacagaatactctataaaatatggaataaaataaaatgtgaactgagactagagaatgaagaaaaataagtttcaaagacagattagcagaagggatactaaattatagtataaccaggaaagccttctcagaagaggagatatttaagcttgctaagaatacaggaaagcgctggagcaagagtgatcctagcagaaggaacacacagggaagatgagattgagctcattctcagatgaccctgaaagtcaacaagcctagagtcacaggatgtgactggagagacagaaggagcctcatctcacagaaggaccttctagtattatgattgccatgaagctcttaagaatcttcctgtccaagttattttctttttctttttttccttccttctttccttcattcattgtttttttgtttgtttggttttttttcagacagagtttcactccctcaccaaggctggagtgcagtggaatgatctttgctcactgcaacctctgcctcccaagttgaagcagttctcatgcctcagcttcccaaatagctggaattacaggcattcaacaccatgcccagctaatttttatacttttagtagagacagggttttgctatgttggccaggctggtctcgaactcctggcctcaagtggtccacccgccttggcctccccaagtgctgggattacaggcgtgagccacttcgccagccccaagttattttcacgcattattttttgtatacactgggctcaggttcaccaaaaccactattgccttgggtcctacattccaaagcttgattttattttaatcatacgcttttcatccacctaccccatcccaccctaaaattttccccagacaaggatggagatctgaagactcaaattgaaaagctctggacagaagtcaatgccttgaaggaaattcaagccctgcagacaggtaaggtgcagaccttctcagtgccttgtcccaaaggagacaggaaaatttctgggtcaatttctgggggacgtctttttaaaagaaacattgacaaatcaataatgtggccaataagagggccccaatgccgggagatgattgttttaggaaatcagcttcatttacaatcccattctcctatatatgggtggtatagaaataaaaataagtagttcaggaataaatttgaaaagtcagtccatacttattctctaaagagtagtgaaacagaatgaagccagtatgaaatgactaaaatgattagcatttattggatgatagctaagtgcctatcaggccaccaggactctctcgggccacacccagcctaagatgctggaaggacatgggttagaaccgcagcttgccaacagggcagcgccagcgttcctccccacagttatgcagccacatgcgctactgcccaggagctattctccaaggggtgaggaagtgagccatgtgggcaggtttgggaacagccctggtttacaaggctcatcccccaaggagctaatatcctttgtagcaatttcaaaagcaaggtgttgaggttcctcacaagagacctgcctcattacaagttactgccttcagggaagactgaagttacggctttccatcaagtatttataactcccagaccagatgcatgttaccaacctggggtcatttttaccacaagcaatgttgcctagtaacaagggtgacatactccctttatcaggcttccgggggaacagaattagaaagttaaaagacagtcaaatgcttatgcagaaggtgagtttggttcatcctttacccacagtcaggtactagaaattctttataaacacaaatccattaatcctccagcaacttaagctattatgatcctaattttacagatgaggaaaatgaggcacaaagaaggtaagtaatttgttcaagagatacacagctagttaaatgtcagagatgagacctaaacccaggcactatgggctctgaggcctgactctccagtgctacggcctaaaactatctttatgctcagtttatcctgaataatctaaacaatattaccaaggctcagttatctgcttaagaaaatccctgtctctccacatgcaaaactagaatttaattgattgattgattgattgatttttgagacagagtcttgcactgttgcccgggctggagtacaatggcgcaatctcggctcactgcaacctctgcctcccaggttcgcacgattctcctgcttcagcctcctgagtagctgggattataggcacacaccaccacatccagctaattttttgtatttttagtacagacggggtttcactatgttggccagactggtcttgaactcttgaccttgtgatccacccgcttctgcctccctaagtgctgggattataagtgtgagccaccacgccaagcattttttttttaaacaaatatttttaaaaataaatattaaataccatctagttccaaaactcccaaagaaatccaacacagagtagcaagcatgtatatatcagaacagcatgaagtttaaggccatgtcttgggatagggcagacctgcatttgggtagctgtgatctcacatgctgcaaaaattacttcatttaaaaaaatgtggctaggcgcagtggctcacgcctgtaatccaagcactttgggaggccgaggcaggcggatcatgaggtcaggagatcgagaccatcctggctaacacggtgaaatcccgtctctactaaaaatacaaaaaattagccgagtgtggtggcaggcacctgtagtcccagctactcgggagcctgagacgggagaatggcgtgaatccgggaggcggagcttgcagtgagccgagatggcgccactgcactccagcctgggcgacagagcgagactccaactcaaaaaaaaaaaaaaaaaaatgctaaggtgttacaagtaacaacttctctaagcctaaatatcctgatatgtaaaaataggggtaataaaatacaacttcatggggttgtcaggattatgtaacttaatttatgtaaaatgcttagcatgttgtccggcacatagaaaattttaactgttgtctcatcattatcatacttcattccacaaatacttattgctatttgccaggtccagccctagtcataatacactcaaaatgcatcttaatatgttacacttcacatcttcacagtctgtctccgaggcactaaagttcacaagaaatgctaccttgcttcagaaggtttgaagcatttccatgaggccaatgaagactgcatttccaaaggaggaatcctggttatccccaggaactccgacgaaatcaacgccctccaagactatggtaaaaggagcctgccaggtgtcaatgacttttggctgggcatcaatgacatggtcacggaaggcaagtttgttgacgtcaacggaatcgctatctccttcctcaactgggaccgtgcacagcctaacggtggcaagcgagaaaactgtgtcctgttctcccaatcagctcagggcaagtggagtgatgaggcctgtcgcagcagcaagagatacatatgcgagttcaccatccctcaataggtctttctccaatgtgtcctccaagcaagattcatcataacttataggttcatgatctctaagatcaagtaaaaatcataatttttacttattaaaaaattgcaacacaagatcaatgtccatagcaatatgatagcatcagccaattttgctaacacatttctttgggattttgcccttcctggggtataggggatcagaaatattgatccatgtgcacgcagataaaatggcttctgctaaacagactaaaatctttctctctagtctttctcacttgtacaaacccagtttgttttcaaaaaatcacagtagcaatgcaactcatcactctagaaaagcaagcttaggctacctgaaagattttcccttggaagtttagcgtatgtttgactaacaaaaattccctacatcagagactctaggtgctatataatccaaaaacttttcagcctgttgctcattctgtcccatgctggcaataataccttgtcagcccattacccttattttgaattgctccatctcctggtgggacttgtatcttgtctgccatatcagaacacaaacccctgaagaggttctgatttgattttttttttttcttcatgcctaccctttttttggaagtttccagccgcaatttgaaatgaaatgacaaggtgtatatttgatcaattttcattcccaccattgcattacaacctctaacttaaatgggtaaccctaaggcatatcaaagaagcagattgcatgataaacggaaacagaaaaaaagaacctacatttattttgctttagcatccttactctcaccttttatgagattgagagtggacttacatttccttttttacattttcgtatacttattttttttagccatcattatatgtttaagtctattatgggcaaccaatctttggaagctgaaaactgaatttaaagaatgctatcttggaaaattgcatacgtctgtgcaattttttattctgcctagtgctattctgcttgtttaactagattgtacaaaataacttcattgcttaatatcaaattacaaagtttagacttggagggaaatgggctttttagaagcaaacaattttaaatatattttgttcttcaaataaatagtgtttaaacattgaatgtgttttgtgaacaatatcccactttgcaaactttaactacacatgcttggaattaagttttagctgttttcattgctcaataataaagcctgaattctgatcaatagaaaatgtgttcgagtgttaattacagttattcaaaatatgttggtttatattaaacttggcagagtttgaggggaattaccctgaatttaatcaaactggtgattcggatatactcagagaacaattttacctggcaatgaagaggtatggtctggctagaggagggaaacttttaaaaaattttagctgcagaggctgggcgcagtggctcacacctataatcccagctttttgggaagctgaggtgggcgtatcacttgagctcaagtgttcaagaccaacctgggcaacagggcgaaaccctgtctctacacaaagtaccaaaattagccaggtgtggtaaggcatacctgtgatcccagctactcgggagactgagctgggaggatttcttgaactcaggaagctgaggctacaatgagctcagattgtgccacgacactgcagcgtggatgacagagcaagaccttgtctcaaaacagcaaaaaatgtagctgcaattatatctggttgatcttggccaactccctacttccaacgtaaccacagtcttcgtaaaggtaatgaccataatgaaacgggtggacactggtgagtaagtgcattctcttcacatttcaggtactatgctagatcttatataattatcatttatcttgaggaacaaccctgggaatttaacctggagaattaggctctagaatcatttcatattacagaagaagaaaaaaaagagagttaagttgtcctaagtcacaggccaggaaatagtggaactgtcactggaacttaacaagctgactcagatcctgtatacttactacccatggggagcaataaaaggtaaagcccattcagaaaggcaatgggagtggattctaatccagtatctcaatttccttaggtgaagtaacaatctggactaacagctgaccttgagaagcattcagtctgaggctacttcacagaaggtgtttttccttccccctttgcaagggcccaaataaagacaaagacaaccaatgttactgagcatggtggttcaagcccctaatcccaacgacatcagagactgaggcaggaggattacttgaggtcaggagttcaagaccagcctgggcaacacagcaagacatggtctctacaaaaaaaatttaaaaactagccaagtgtgatggcacatgactgtagtcccagctacttgggaggctgaggcagggggattgcttgagcccaggagtttgaggctgcaaggagccatgattgtaccacttgactccagccagggcaacagacagagtgagaccctattgaaaaaaaaaaaaaagacaacatttgaagatgatccattaaataaggcaatccttcccaaagtgcctcaagaagaccaagagagtaagttaatgcaaaggaatagatgaaggttagtgacatcaagatgagggttagcgaatatcaagatcagttagcaagacaaagcacagatgatgggaaacagcaaaactggaaggaatggattaaaagattacctggtttgttcctgggtctaactcatgacctcgactttgttacttagccaacaaagcagatgaaagccacacccacaagattccctaacctagacttctctttggtctgttttgcctgttgggtactctctagcaaacaaatggtcttcaggcaggaatgataaattgttcttaactctcacgccaacttttttttttttttttttttttttgacgcagggtcttgctttgtcacccaggctgcagtgcaatggcacaaacatggctcattgcagcctcaaccacctgggctcaaagtagcagggacgacaggtgtgtgccatcatgcccagctaatttttacttttgtagagacaggggtcttgccatgttgcccaggctggtctagaactcctggtctcaggcgatcttcctgcctcagccttccaaagctctgggattacaggcataagcccatgctcccagcctcaggccaactcttatgcttccataaaagctgtctggactagaggatagagaagcatcctgaagcctggtggaaacaatgacataaagaattagcaatgtctcccctacaaggtcatggtcagaggatgtgaacattgtatcatgtaagtgtcaggtgataaaacttcgaatataactgacatcttcaggaaggtaggcgtttcccgtcttcccaaagatgtcagttacattcgaagcccaaacagtctaggctccccaaaccttaccaggaagctgattctaatcttcagagcagtgcttctccccaaaccttaccaggaagctgattctaatcttcagagcagtgcttctccccaaaccttaccaggaagctgattctaatcttcagagcagtgcttctccccagaccttaccaggaagctgattctaatcttcagagcagtgcttctccccaaaccttaccaggaagctgattctaatcttcagagcagtgcttctcccaattttaaatgcttgcagatcacctgaggcccttgctaaaccacagatcccatggggctgggccgattccaacaagctcccagtgcacaccaaaagtctagaccacagaccacagcatgagtagcaaggttctaaagtttcagctacttgcccagacaccatctctgattaattgtagttctgctgcttgctagcacaaaagggtaagatttacagttcttctgagtaaggaacaatacagacagcaattttctacttaccaaaatgcttccatgcccgtcattaagtgagataacaagaaaaatcagtaagctaaaggaaacacctataacagactcaggctcaattagtattgtgaagaactggcttattgcaaggctcaatggcttctttctctttcccacttatctggttgattttggccaactctgtactccaacataaccatagtcttcctaaagataacgaccctaatgcaataggtagacactggtaagtaagtgcattctcctcacatttcaggtactgtgctagatcttatataactctcatttatttctgggcagcatttcttatctaaaaataaagttctattactggaggccaagaatttgaggctgcagtgcactatgcttacacccataaatagccactgcagtctagcccgggcaacatagtgaggccccatctcaaaagacagtaacaaaataaataaattaaacaaatagaaatataaaatattttcttctctcagattagcaagaacttccataacatcaccaaaaaaggcacatctaacaaatgaaacccccaaaatttagtatttggaggatgcaataaataacatcaaattttagtaagctcagtatcttatttaatctggtgcaagaaattcaaaggctatctactaacggtaataggtaatatggagagacagaaaaagtcagtcatatcacgcaagagagcaagactacctgcgggggtctgtgaagacaatattaggatctataattacacatggcattaagcagatggattactatctaatttttttctaaactgacacccacaaaatggaaaatagtttaaataaaattctgctaaggaactataaagtgaatatacaatagtcaaaaacatgtgcacacatgccagcaagcaaagctgacacttctcctctcagtgtgggtggttcagggaggtatccgcagcccacacagagccaatcagattattttccagtggttgtcacctggaaactgggagcaatggaacactttcccctggacatgttcaataaggacaaagtaaatttagggcttctggcagaattctttctttctagatgagtgcaatgtgcagaatgaagcaaaacaaagataagcagtgatgagaaataaggggacaaaaacggaaggagagggaagggaaagaaaacaacagggagaaaatgtgtgtgttctgatagttcttagtccatcatttcaatcccctaaggcccgggttctatttctgtacattctgtgagctgccccacaatgcctccaaactacagaatacaattcttccttttcatttgtgctagtttcagttggcatattagccaagataggctaggttatgatgcagtaacaatctcaaaacctgagtggcttcaaacagcaaaggttactactgtcccttcatgttcatattcttcgtgcattaaaaaggggctcttctcggcattgtgctcattctagaaaccagcggatggagaagcaactactgtcattctctacagcagaggaaaagagttttggagagactcacagcagccattaaatgatctgatacagaaatagtaaacatttccactctgagagatacctgcaagtgcagttcagccatgtgcccaggaggtagagagctcgaatacttggtggtgatcagcatgtctcccacagttgggtttctgtcacttgcaatcaaaagaattctgattaacataagccatgaagagaaatgagactagaaagacctgtattccaattgaaagagaaaatgggttcatggagataggtagatagcagtagaaacgcatctcatatttggtaaatggaagccgagttcaaagcttcaaaagctggaagtcagtttaactgtttaactgtataaattggaattattacatgcaactccaaaggcaggttcttagcatctgtgatagctttctagaagtgggacatgcatttttaaggggagatggtatgtgcaaattttatcttattaaaagccaattattccagttgtccaatatatttaatctacccaagtagagtgaccatggattacattccaatttgccctggagagtgctgatgaatgacaattgtttaaaaatttatagcaccctttttcactctgaaagtttcccagtttgggtaataaattatactgtcatcctaactataactcaggctttgtttcagaggattgatgatcttgcctattcctacattttaaaattcaccttccattcctttcatggaggagccctacacttgagacaaactatgctactcatgggaacttaaatgcaccattaatttacaccagcagcactctgatcatatttctctttcctctgtctagaactctttcttatcattgtgtttctggtgactttcttctctttatttaatattcaacacaatggtgaccttttctgccctcctgcaagacatatttcttcctctgtgcattcataataccttatataactcacagcccttattgcatttgtctaacaatggacaagtattatcatattatcctcccctaattcaaacctttcaatggctttccaagtttcttaaaaacaaaactttaatgtggcctggaaatgctgcaaggtcttgcccttcatccctctccattctctcttccctttacgtttgtactgccaccctttgtgggcaccaatctcccctgtcacaaatatttgcagagaaactcttccttcgtctgcttaaaccttgctcattcttcaaactttagctaatcaagacttcagggaaactttctctggactcccttcacagcacttaagaatgtgcttggctgcaagtaaataagacatgactaacagtggattaagcaaataggaattattactattacataacaagaagtctgaaagtgaggaattgcagcattctttgtttcagaaaatcagtaaggccaggaatgatgtttctgctattctgtgggccttttcttataatcctaagttgtcttctgcaactccagacatcacatccacattcaaggtataaagacacgtagaatagcaccaccagcctggtttgcccctcttttgaccaacatcctccaggagactgcagtttgttttgttggtcagaactctgctatatggatgccctaaccctatgaaagtctggaaaaggaaatattgttgtatattttgccaccccaaacaagattagccttaataagaatagaaagtttttaagtaacaggctcttccagaatcaaatccccttgtaaattcccatagcacaaacacctcctgtctgtttcaatttttcagatgtgatgttacatttatatttatttctcttattagactataaactccaagggctcagaactagaaaaattgttttttgattgtatttccagagaaatatgacttttggtagaggctcaatatttaactgttgatggaataaatgagttaatgcgctaacatatttcctcttttcaagggttaagtgcaagcactattctctatgccccaggttccaatcatgatgttaagtctcattaaattaatgaattaaataatttgatcaagttattttatcagagaacacaaagctttaaaagaaacttctgttttcactcaaaacaaattatttacctccatacctaaatactttgcattcttctgaagtttggtttctttattaaaaacaataacaagaaccaaaaactgcatcaaaactgtacccagaggagccaaaagctactgtattatcatgggatacgttattggtgatgaatggctaacaaatgcaggactcaacagccaatagctaaactgagatgggaagatcaaagcctctgtaaagtgagagctttctgggctctactccctgaactgaaggaaataaaccaaaacatcttcatgaaagcgattttacacattactgcctctaacttggtatcatctggctactctgttcggattaaaaaaagaaaaaaaaatcaatgaagtacttggatgagacttcaatagaacactcaacagaatatttttaaagctttgatttccaaaacggttataaacaaaagtagttggtctaatcacaataattggactctgaacaagctatggcagacattcagcaaccaattcaatgggttaaagaaccaaactagggatctcaaatacatggcacctgggcatctgtctttgtgtgtttgtgctgcagtaatagaatagcagacactgtgtaaattgtaaagagcagaaatttatcagctcacatttctggaggctggggagttcaagaccaagaagctggtatccggaaagggtcttattgttgcatcatcccatggggggaaggcaggagaataaggaagtgcatgagagagagagagagagagagcagggagctgaactcacccttttgtaatggcactaattccactcatgagggcagagctctcatggcctaatcacctcttaaagttctcaccttccatactgttacaatgaaaaccaaatttcaacaagtgttttaaagggaactaacaaactgtagcaaccccaatttcccactcctttgtccacagcagacatcctgaattcattatacagtccttgtcaggggtggaattccagcagccagcacttggtcatcaggattggcataggagaacacattcataaccccttggggttatacacaccctgaaagcctttcccaccaattcaaggtcaccagttccctaactctgacacaccatggatgctcaaaggatgagatgatttaggaattacaacaaaccttccccatctattcattgtcattcctctccatgcttctcacatgttcatcctcagtttggcagagtttggtacacctagaaaaaaggccagacaccctaaccctggcattcaaggctgtccacaatctggtcttagactatccctctagccttatttctcactgcagtctttcacttatactgtgtacagtgggtttaacagagatacccaaaattcattttctatccagaacctccaaatatcattttatttggaaatagagtctttttttagaggcaaggtcttactttgtcacccaggctggagggcagtggcacaatcacagctcactgcagcctcaacttttggggctcagctaatttttaaaatttttatataggcaagaactcactatgatgcctcaaacccctgaacccaagggatcctcccatctcaacctcccaaagtgctgggattacaggcatgaaccaccacacccaggcagaaatagggtctttgcagactgcattagtttgctaggactttcataataatgtaacacagactgggtgctttaaacagaaatatactttatcacagttctggaggctgtaagtccaagatcaaagcgtcagcagggttggttccttctaaggggctcccttctcagcttatagatggccatcttctggtgtcttcaaagtcttttctatgtgtgtctgtgttctaatctcttcttataagggcataagttatattgggttagggtctacccctgtgatctcatttcaccctaaatacctctttcaaggccctatctccaagtacagtcatggatcacttaactacagggttatattctgagaaatgtggcattaggcaatgtttttgttgtgcaaacatcatagagtgtccttacacaaacctaagtggtatagcctactacacacctaggccatgtggtgtagcctagtgctcctaagctacaaacctgtgcagtgtgttgctgtactaaatcctgcaggcaattgtaacacaatgctaagtatttgtgtatctaaacataactaaatgtaggaaaggtacaataaaaatatggtattataatcttatgcagccacagtcatatatgcggtccatcattgattgaaatgtcgttatgcagcccatgactgtacacattttgaggtacagggatcaggacttcaacataggaatttgaggggctatgacacaaatgcaatgtgttaaaatcaggtcatattggattaggatggactctaagtccaatgattgatgttcttataagaaaaggagaagagactcagatatggctctctcctggcttctggtggtcactggcgatccttgaggtgccttggcttggtgctacatcaccctagcctctgctccatcgtcatttgcctttcttctccatgtgagccaccacacccagctatagtctttttttttttttttttttttgagacggagtctcactctgtcacccaggctggagtgcagtggcgcgatcttggctcactgcaagctccgcctcccggattcacgccattctcctgcctcagcctcccaagtagctgggactacaggcgcccaccaccatgccaggctaattttttatgtttttagtagagacggggtttcaccgtgttaaccaggatgtattgtcggttatttttaagccaccctgtgtatggtgatttgttacaacagccccagggaactaatacattggcttcagttctagcaacatcacttataatagccaccatttatgtagcacctgaaacgtgcctgacactggtcctcttaggatagaggaaaaaaattatgtgctgcagcagagaatcaaaggaaagctgaaaagggaaggaacaaaagaacatccaataagtcttatgaaattttaagccctagtagactaaataataacaagtatctagtatctgacaaataatattcacttataagcctttctattcaaggttggttcatggatttcaggtagaattcatttgaaatgtcaagaaagattatggaagcaaggcagagagaaaatctaaaaagccttttgaaggatttctgttattgctcaggttaatgctcgttaaagaatcctcaatttgggagatattagttcctattataagtcattatcatgaagcttcccatttgtcaaggatgtgtgtcgtactgaagtaggatttgacacttcagctggaagccagaaggaggcttggtaccatcctcactgcagaaaattccactaataggtccagactctgtctaaagatatcactcggggtgttatccaaaggccaaactcaacccaacaaagttggtgagttgcaggagttcatcatcagtgtttggctccaggagaagtttgtttgtttgtttttgagatggaatctcgcctctgtcatccagactggatagtgcaatggcatgatcttggctcactgcaacctccaactcccaggttaaagcaattctcctgcctcagcctccggagtaactgggattacagaagtacaccaccacacccagcttattttttgtatttttagtaaagatggggtttcaccatgttggcaaactggtcttgaactcctgaccttgggatctgcccacctcagatttccaaagtgctcagattacaggcgtgagccaccgcgcccggcataaagctttaattcttgttaaataacactgggatgggttagagccagggactcaagctccaccatcatcccaaatacaagaggaataaaacacttgcttcacacacagttgggataatatgtgaaatatgaataaggttttaaattagataatgacattgggtcatcataattggtaattgtgctgtgtttatgtaaaaccttttaggaaatgcacactgagttatatagaagtaacaaaacatcatgtctgcaacttggccttaaatagttcagaaagaaaaaataattacatatatggagaaaatgataatgtaatatggtaagataccaattggagaatctgggagaaggtcattttttatattattcttgcaacttttctgtatccttgaaattatttcaaaacaat

SEQ ID NO: 726 - DNA, 14395 bp, Homo sapiens
gttttgttcaaatgagtggacttgagtctctagcccactgaggagcatccatgggccggagctctgccgggaggaaaggacaggtgtgatcgcagcgttccccagctggctccaccccgatggggagtgtggaaggtgtgttgaggggtatccagagaaggcctccccaagaaattgatctttaaactgagatctgaagagagagtcagagccggccaggtgacccgggggaggggaactcccagcagagggaactgtggatttgagggccgagaggtgagtgtggccaggccgcagtgtaagtacgaggaatgagtagtgagtagatggtccacggagagtgaacaacgcaggcagtgaaggcactctaggagaaccaggcagcatcactgatgtgaacgaatgtaaactaaatcaatacgacagcttttctcattaaatgattgatggttttaaataacaagaattttacatctggtttaatatctggtgggagtgtaaatttgtgtaattttttttgcaaaggaatttggcagaatgtattgagtgcgttaaaatgtttatatcttttgatcaaataattccatttctggagatttatcataaggaagcctgagaatagcccttcctgccacgtccctctcaccacctgtcccctttgctgtgaaaccctgccttcaaagaagggcgttactcctgcactagggctggggtagccaggtgacaggcggaggactggctggagggcaggtgggtagggaaggggctcaatgttctgggggacattttaaaagctggaaaaacacataaacgagttccatattgaaatatttatttatttttttctgttgtgttttcagatgaagacagtcagtgttgccttagttttgtgcctgaatgttggtgtggaccctcccgatgtggtgaagaccacgccctgtgcacgcttggaatgctggatcggtgagtatgcctccctcacgcgctgccacaaaggccgtctggccggctctggcctgggcggggctcgccaagcctgtggtctggtccaggggcccgtctccagctgtgcaaatctgaggggtttttctttctggagtcacatcacctttgagtaatttccgatgcgctcacctgtgattggtagtggagagagtgtttccagaaaaatcaatacagtgatgattattggcttatataattttctactttatttttttatttattattattatttttttgagacagagtcttcctctgtcaccaggctggagtgcagtggcatgatcttggctcacagtaacctctgcctcctgggttcaagccattctcatggctcagcctccttagtagctgggactacaggcacccgccaacacacccagctaattgttgtatttttagtagagatggggtttcaccatgttcgccaggatggtctcgatctcctgacctcgtgatccgcccacctcagcctcccaaagtactgggattacaggccaattttctactttattacacgcccggccaattttctactttatatttgttctgtctggcacacatagtatctatgtacacttaaaaaaaaaatggaatgactgatacctgcatggaaatgtagaagaggtaaatggaaccacttccagcaaagcatcacataatggatcatggcccataataataatggccatcatttgctgaatgcttgtagtgtgtcagacgccactggaagcactttacaatgctcacaacaaccttgtgtggtagggtttttgctaatctccatttgagagctgaggaacatgagacatagagattagtaatttgctcacggttgtcctgtagagctggaatttgaacctatgcagttcaagtccagagactgttttttttttttttttaattgtggtaaaacatagacaacacaaaataccattctaggaattattattattattattattattattattattatttttcattctaggaattattaagtgtacaattgaacgacatgaaataattcataatgttgtgcaagcatcctcactgtccatctctagaaccttttcaccatcccaaacagaaactctgtctccattacacaactcctcattcctgccttcccctagcccctagtaaccgccattccaccatctgtctctatgaatttgtcattctagggacctcatatcagtagactgatatttgtccctttgtttctgccttctttcacttagcataatgcccccaaagttcatccatgtcgtagcatgtgtcagaatttcattctcctgccgcagcctcgcaataactggacttataggcacctgccaccacgcccaggcaatttttgtatttttagtagagatggggtttcaccattttggccaggctggtctcaaactcctgaccttaggtgatccacccgccttggcctcccaaagtgctgggattacaggcgtgagacaccatgcccggccaagatacaatttatatacagtaaagttcacattttttagctgtacatttctttaagttttgacaaatatgtacagccatgtaacaaatgccataatcaatgtatagaatatttctgtcacaccaaggaagttcccttgggtccctttgtaatcgatcccctctcatttctctggcctctggaaaccattgatctgattttttccttttacagaatgtcatttaagtggcgacatatagtttgtagtttttgtatcttgcttctttcctttagcagaatttatttgtgattcatctgtgtagctacgtgcattagtagtttttttcctttattccatttttatggctccctcacaatttgtttatccatttactagttgacagacatttgggttgtttctagtttttggcaattatgaataaaattgctataagcacttgatctttgtgtggacatattttctctggttaatatttaggactgtgattattagctcatatgttaagcgtatgtttaaattttttttttttttttttgagatggagttttgctcttgttgcccaggctgggagtgcaatggcacgatcttggctcaccacaacctctgcctcccgggttcaagcgattctcctgcctcagcctcccgagtagctgggattacaagcatgcgcctccacgcctggctaattttgtatttttaatagagacaggatttctccatgttggtcaggctagtctcgaactcccgacctcaggtgatccacccacctcagcctcccaaagtgctgggattacaggcatgagccaccgtgcctggccaagtgtatgtttaattctttaaggaactgctgaactgtcggttttttaaagatctttaaaaataatgaatgtcttttatatttaccttcatatttattgttttgaggaccattcatttctttccgcagttccaagtttctatctggtatcataatcattctgcctgaagaacttactctaacatatcttgcagtgctggtctgtaggcattaaattttcctagatttctgtttggaaaattcttcattttgtctttgtggttgaaaggtattttttcggggtatgtaattttctgttgactcttttagcactgtcttttaaaacagtcacctgttgtgttctggctagcagtttctgagaagtctgctgtaattctttgtttctctgtatattttgcttcatttttctctggcaatcttcaagatgttccctttatattctcagtagctttatctataacctattagttttttgtttgtttgttttggaatttattctccccacccttttttttttcttttagagatgggtgtctctcaatgttgcccaggctgggctatacttgaacatctgggctctagtggtcctcttgcctcagcctcctgagtagctgggactatggatgcccagtactgcacctgtgaaatttattctttttgggtttctgtgagcttcttggatgtgtagtttgatgtcttcatttttgaaaagttcccattatcttttcaaatatttattgtttgttttctctctcttctgggactcagctctctatgtattgtgctgttagacattgtaccgcagctcttccatgtgtctctctcttctgggactcagctgtctatgtattctgctgttggacattgtaccgcagctcttctgtgtgtctctctcttctgggactcagctctctatgtattgtgctgttggacattgtaccgcagctcttttgtgtgtctctatcttctgggactcagctctctatgtattgtgctgttggacattgtaccgcagctcttccgtgtgtctctgtcttctgggactcagctgtctatgtattgcgctgtcggacatagtaccacagctcttccatgtgtctctgtcttctgggactcagctctctatgtattgtgctgttggacattgtaccgcggctcttccgtgtgtctctctctcctgggactcagctctctatgtattgtgtcgttggacattgtactgcagctcttccgtgtgtttctctcttctgggactcagctctctatgtattgcactgttggacattgtaccgcagctcttctgtgtgtctctctcttctgggactcagctctctatgtattgcgctgttggacattgtaccacaactcttctgtgtgtctctctcttctgggactcagctctctatgtattgtgttgttggacattgtactgcagctcttccatgtgtttctctcttctgggactcagctctctatgtattgcgttgttggacattgtaccgcagctcttccgtgtgtctctctctcctgggactcagctctctatgtattgtgttgttggacattgtaccgcagctcttccatgtgtctctctcttctgggactcagctgtctatgtattgtgttgttggacattgtaccgcagctcttccattgtgtctctctcttctgggactcagctctctatgttttgtgctgttggacattgtaccacagctcttccgtgtgtctgtctcttctgggactcagctctctatgtattgcgctgttggacattgtactgcagctcctccgtttgttctctcccatgtcacaatgagcttttgttagtctgctgataaaccagccaaggaaattctttttctctgatattgggttttttatttctagcatttccattgactattttagtttccatctctaggggaaatgcatattgcctgcctttccttctagagcctctgctgtgttcatcatagttaccttagagtccttgatctatagttcagaaaacagggtcagccctgagtctgagtctcctaattcctttatcatctcttgactgtaatttgcttttccttgctttttttgtgctttataaattttaattgcatgctggacattgtgtgtagaagaacaatagcgaatgaggtaagttgcatagtctatagtttagtaagtagttaactggggttagaatttgttgttgtaatggttatacccactgcaacagcactcttagttcttagagtgattagttggtgcttgtgtcagtcaaggttctccagagaaacaggggcagtagatgtgtgcctgcatgtgtgtataagtatgtatgtatgtatgcatgcatgtcttgtgatcttgaggcagaaatttcttctttctcaggaaaacctcagtttggctgttaaggccttcaactcattggatgaggcccccatattaccaaagaaaatctcctttactttaagttagctgattgtggatgtcaccacatgtatagagtactttcactgtggcacctgggtttgtgtttgattgaattgctgagtgctacggcctggcccagtggacacataaagctgaccagcacagtcctcgtgcattagggtgggtacaggcaggccagggggttttcccagggctcctgctccacccctagcctgagctgtgcctgcccacgtgcctcactgagtggtccctggctttgcctgtctcctggcacaggatttccattgctagttactcagcgccaggctgtggagtggtgggagttctctgtggtcctggtctctctttagtcttaggcaggccctgggcatctgggccttgggcgtagtgcggttgcagtgttttcacctgtcccccagtgatggcaaacgtctgcctcgattcagtgtagaattctgtgcccagggcgtgttctgctcctatcccaggagtaggctgttttgcaccttccctcaccccatcctccatgctcttcacctgtgtcttgggacagtgtgttctatgcccatggtgagcaaggtaggttttgtctgtacctcctcccactccccaggtacaggaatgtgtgcctgttcttgtggactgagggtctcctgctttgcttcctaggggaggaggtctctgggggcaggtggacttcaagcctctccacactctgtgctgcctccagcagatgcttctcatgaagtgggggtgcagtgggggtgcatgcaggagagtgtgagtgccccttgtgcctggaccccctgtgtttccacacggatatgcaagcgcacactggggcctcgaggacacattaccatcttagctggtttcttgtgcagacctgcgctcttcaaagatgggctgtgcatgtgcccgggctttctcggagaggacgggcctgtgggattcggtttgtctgccctgcggtctcagctcccttatgagctcaagaaaagtgatgatgtcagtgattattcagctttctcatgttgataggattggagccactctttccccccagctttctacatcctaagcaaaagcagaagttccctttattgctttaacaaaaactacaaattattctcagcctgggcagcatagtaagagaccatgtctctacaacaaatcagaaaattaggagggcagggtggctgattttgagatgacaggcatgcctgtagtcccagctactctggaggctgcagcaggaggattgcttgagcttgggaggtcgaggctgcaatgagctatgattgtgccagtgcattccagcctgggcaacagagtgagaccctgtctcaaaaaaccccaaattcttctcatctaaatctcatctaatctgaattggaaataaatgttgtttttcctgcattatttggctgtcacactatgtgagggtgttttaggatgacagttccctcaccccttccaggctgcttgtcccccacaccccatgatggagcagctgtgttttgtggctgatttcttcagatgctctcttggctcactgctggctcccggtgactgtgctggttgaaattgacttcttattagccaccatggactctttccacttcatccgtccctcgtcacagctgaatgtaatcagttattttctcttcctctacagcaatgcttatgttaggcttttcgaacaagccttcctcatgcggatccctgtgtgtgctccggggacgggacgcgcaggcccttcggggttgtgtaggtgtcatctgaggatccagttgctcttccctgcctgaggagcctgagcttttatcagagctcaccgccctctcccacacagtctctttgatcagtatttacacaatgttaatgagaatggaaaaactccatgcttctttcttggtgtgaaagatccagcaaatgagatttctaaaacttgagttttaaaagttttcctgcagtttaggaatatcgtctactttctaataatttcaagtgaattttgagtttaggagggcatgtgctttttctaagttggaaaaattttatttggcctttattaaaaaatgggtaggttcctggtcctggtgatggtggttttaacaatatggcataagagaataagaagcctagtgatttgaatcagcacatttgcaggagtgtgtagcagcccacttttattttttagtttatttacttgaaaatttttatttttgtgagataagaccttactctgttgcccaggctggagtgcagtggcgtgatcatagctcactgcagcctcaaactcctgggctcaagccatcctcctccctcagcttcctcagtagctgggactgtagatgtgcatcccccacgcttttaaaattttttatggagacagggtctcactttgttgctcaggctggtctcgaactcctgggctcaagtgatcctcccacctcggcctcttaaagtgttgaaatgaccggcatgagctaccacactaggcccatttttcattttgaaaaaaaagttccaaaagttgcaagtatagtactaagctgtttcctttctgattctctgagagaaggcggctgacatggtgcttcagcacctctgaattccttagtgtgtaattcctgccagccgggagtttctctttccagatgacaacgcagtcaccaaaatcaaggagcattcgcgtggacgtgtgactgccacgtaagcgtccgctgcatgcaggtttgccagtgtcccaggaatgtcctttgtagcgccaggatcctgctcagccatgcgccatcctaacttcctctcactcagtctgaagcagttccacaggcattccgtgaccctcctcaccctggcgcttgaaggtggcagtctctttgttttgtagaatgtctccggtgtctcctaatgattccgtttaggtcatgcttcgctggcaggagcatcacgcagagctgcctgcttcacgcgggctgcaccaggtgatgcggggctgtgatctatccattactggtcatgcagatcttctcacctgattcagctggcgcctgctggacctcatgtgaaattcccctttgtagttgataggtattttcgggaagaagtgctttgagattgtgcaaatattcctttcctcgtgactttcaatttcttcattttgaactcatggcctccattttcattcagtggatttagaatccagtgttatcctttggtgccgagcttgtctccctctggttgttgggaacccattgggccggcttctttggcttctgtcttgtttgcatcattcgtggagcatgtgcttactttgtctcatctagtctttttcccagcctcattcctcttagtggaatgtggtgttagaaactgagatctgggtgccaggtgttctctttgaactggcgtgctattgctcccaggacctctctcgctggacagagcaaggaaatgcatgtgtgtgcatactatgtatgtgtgcatactgtgtgtgtgcatattgtgtgcgtgtgtgcatactgtgtgtgtgtgtgcatactgtgtgcgtgtgcgtactgtgtgtgtgtgcatactgtgtgtgtgcgcatactgtgtgtgcatactgtgtgtgcatactgtgtgcgtgtgtgtactgtgtgtgcgtgcatactgtatgcgtgcataccgtgtgtgtgcgtactgtgtgtgtgcgtactgtgtgtgtgcgtactgtgcgtgtgcgtactatgtgcgtgtgcgtactgtgtgcatgtgcgtactgtgtgtgcatactgtgtgtgtgcatactgtgtgcgtgtgcataccgtgtgtgtgtgcataccgtgtgtgtgtgcatactgtgtgcatactttgtgtgtgcatagtgtgtgcgtgtgcatactgtgtgtgcatactgtgtgtgtgcatactgtgtgtgtgtgcgtactgtgtgcatgtgcgtactgtgtgtgtgcatactgtgtgtgtgcatactgtgtgtgtgtgcgtactgtgtgtgtgcgtactgtgtgtgtactgtgtgcgtgtgcgtactgtgtgtgtgcatactgtatgtgcgtactgtgtgtgtgcgtactgtgtgtgcgtactgtgtgcgtgtgcgtactgtgtgtgtgcgtactgtgtgtgtgcgtactgtgtgtgtgcatactgtgtgtgtgcgtactgtgcgtgtgtgtactgtgtgcatgtgcatactgtgtgtgcatactgtgtgtgtgcatactgtgtgtgtgtgcataccgtgtgtgtgcataccgtgtgtgtgtgcatactgtgtgcatactttgtgtgtgcatagtgtgtgcgtgtgcatactgtgtgtgcataccgcgtgtgcatactatgtgcgtgtgcttctctctgtacacatttgtctcagcgtttctgtacctctctacatgtacattcatgcctcctattccacctcatgggggttttccatatttgtagctccatcttctgacagtgacaaccttggtatcctttgtccttattgtattggctaatgtggtgcctcctcctgtgtgaaccctcttctcctctctgccattgctgctcctctcagacccggttatcctttgccatttcaccccaatatctgcctttctcactgccctggtccaacacccatatggtcacctttctgcagccacacctctccttcttcctctgcacgggctcagggcccagtcagacttgagagctcattccaggccagtgtggctcccatcatcctgagacagatgccagctttgcccagacccaccttgtggctttaggattgttgaagaagggattttagcattttcaacaagtgctttaggtttcaggcctggtcagccgagggaaggatgatacaccagtaaccaagactgggacgggagctgggctggctggcagatggtggggtaccatttcgcacatggtgaggtgcttgtaggaacctccaagcggagccaccatccagtggaaagtggatctggtgggagaagagggctcattgtagactagaggacccaggggaggtcagcgcctagtacgaactagaccagagggtatcgggcagaggcagggccctgagggtgcagagaggggtgccaaagaggaggaccagggtggttctggatgagtgcgtggaggagcttctggtcagcattgtcaaggctgaggtggtgtccaggctgattgtagcaacctgaagagtgaaggcagatgaggtggtgaagcttgtggggcagcttggccaggaaggtgaggagtggggtactagtgttggggctgggctcagtgatgggtttgctctgccttcctcaagatgagaatgacgggggccatggaggaagccaaaacagggattggtgcaatcaaattacttacaaacatgttaccgtttagaaggcagacctcaggattttatatttggtcttagcattttgaggtctattactagaaatcgagatttttgtgttaatcaagactccagctttattccttccagctgtgctacacatttaactgttttgggcctcagtttcctcatctgtaaagtggagctagtgatgccgtgtacctcatggcagggtgggggaattaactgggagcagagacctggtttggtgcagagactggtcctcacctccgccgccccaactctagtccctacttctaccccaacatcacaacacctcaaacaccccgacccctacgtcacagcgcctcaagcatcccgacccctgcaacactgtcttagtctgttgttgctgctgtaacagaatacccgagactgggtaatttacaaacaacagaaatgtatttcacgcagttctggaggctgaggagtctaagataaaggcactggcaggtctgttgtctcttgagggccctgtccatcttccaagatggggctgtaacactgtgtcctgtcacggtgaaagggacagaaaagcagaagtgtgcgtctagttccctccagcccttttatgaaacacgatcgcctcctgaaggccccatctcttcatactaccacattgggcttccgttccaacacgtacatttttggggacatattcagaacatagcactagccccagtatccccactccagatcacccacacccccgcaacacgccccagtaccgccactccagatcacccacacccctccccaacacgccccagtgctgcatggggagcaggggccaaggtgctgcatgagctgcttcctgaatccgtgcctcttccgctgctttctgtagggctgactacgaaagagggctgcagtgaacacacctcactgagccccactgccgggcatgtagccttgcaggacggccgctcactcagggttgaaggtctccagcagattctgggagtagatgcacggtgctgcttatttcgttttacaaattaaacatccaatatgcaggtagcaatgtgtgtgaatccccagtgctttatgtagaaccctgagtatggggttcatttttgggcagggtggggtggagcggaaggtggtctgtgctgatgtcagaggggtctgagaagcttgaaaaataagggtaactgtgtgtgcctgaaccatgcaggaagacagcactccttccagagatgagggagagcagacgtcatgtctgtgagcaaacaaggggcccatgcccagcgtggctctgggtgtcatggcctccctgctaggtcatccggatgaagcctggggctgtggagtcagctcgtgagaaatgggatccaggtcctgagcgtgctggaactggcgagacggggtcacagcacacacctgcgtttccagccctgcccctgctgacggccaagacctcttttcccacccctgctccgcccccctctggataataagttgctgttctagttcatagaagtgacacttgtcccttttcagagaagcaggggagaggctgttttgttttatggcccgacattaaatactacaacagtaatactaaaaacaatcctgctgaagagctgcgcgtgccccactcttggggaactctgctgtggcagcagagtgcggatgagctgcatgctgagcagggagtgtcatttagcggaaatggttttgtgtgccagctaatggtagctgtgtatcagaagaggtgagaatgcaaaggtttgtcagatgtgtggaaattctgtcatcccaagggaacgtttgggaggtcttagctttgtttttctcttcttaatgcaaacacgtgagcattaagagaccttgggtagatgagctgaaaatagtcgtgatcgcccttggcggcggctcgtgggtttacagagcacttgcacagacttcgtcattgattcttgcaaccatttgggattcatagaccagtcaagttggttaacagatattgattaggtggaaacgtatatgttaagcatagtgccatatacaaggaactgtaagctgtgctcttgctttcaaggcactgatagtacacctggggaggtaagactaggatccatgcagtagaacagagaccaatacgaggtcaagcttgaacggcctggaaggccagagaatgctgcggtagagacgtcagggcaggcagtgggaggcaagagcaaagagctgaaggaagagcatgagcccacactctgaggtccgaggggctgggttttcgcacaccagctgggctccctttgggcctggggggtcagtagcacccgttagccacggccagtcacagccgtatgctctgtgcacacagctctgtgcccacagctgaaaccttggctctttggggcttatggtttaaaatgctgttttcttttcttcctttcttttttttttttttttttgagacggagtcacataggctggagtgcagtggtgtgatcatggctcactgtagcctctacctcctggactcaagcgatcctcccacctcagcctcctgagtagctggaaccacaggcatgcaccaacacgctgattaattaaaaaaaaattattgtagagacggggtctcattttgttgcccaggtttaacatactgttttctctgccagttccattggtgtctcaaggtggtatctctgcttcccctctgaaggaatctgaaagaagggggttaactgcttggagcccacctctctcctgtatctactttccaaagtgaggacagttttttaaaacaggacatgttcatcccctcatatctgctgaaaatccgtctagctcttggtttttgtataatacagcaataggcaacacaggaacgtaattttgtagctatgtgaggagtgaggcctagtgttagaacggggccagactgtaaaagatctcgctcctgtacggctcccgtcctagtcccacagacgctgcaagggccgcgggtcccggccgaagctttcctgtcccagatgcctgcagctgtgtggctccaagctttgcgcctgagctgaggaagatcacacgcctctcactgtatacaggactaattattacaaaatagacagggatggcattatggttaggaaaatatagactcattaaaaatcatttctaatttcaaagtagcccctttgctattatgtattttctcagtcaaaaatgagttgtttaaggctacacaactaatgagtggcagagtcc

SEQ ID NO: 727 - DNA, 6090 bp, Homo sapiens
tggcccaccctaaaaaagggtctccttccggaggtaagaggacttggcctctgctgtgagatggcagagaagcaggaaacacgttggggaggagggcaccccccagagatagaattccagggccattgtctgtgcagccacagagcaaacactcggcctttgttcccgggaccctgcgggaggggggcctcgggatgcccattccgccagtgtggcccgcaaacccgccggacaggtttggttctcctggcctcccggccccccgccaccccgttcacccgaagcctgggacccagccttcatccccagtgtctcccccgcccgagccagcagggcggctgggcctccccgcacgtgcacgggttcgaatcccgccgacgcaccgggtgccaggaccgagggtcagccctctccgcgcgcagcgggagcgcccaccccaggggcggaggcgcggacgtcctgccggggtaacccgcggccgcccccacctcccgggcccgcgtgactcacctcccaggccaggcggggcgggatggaggcgcgcgcgcggcccctccgcacagacttcctgctgccggggcgggggatgctggccccggctccccgggcctctcgcgacccccatccccctgggcctgggacgcggggacccccgagcctgggagggcgcgcgcagtgcggggcgcggagggaggtctggtcctcacgcgaggtccccgcctccagggtcctcggagggacgagggcgcgcagcctccgcgttcccctgcaaacttgcgcgcagccgggggcgtgtccgtcccgggagggtccccccaacacccgggtccccaaggctcttaccgaccagtaagcacagcacgtcgagcagcacgaagacccacctccgctgcatggtccccgcgacccccgacgccggtcccagcgcgtcccgtcgcgtcccggcccggccgcggagtcacgtggcgcggagcccgccccgcgcggagaggaggggaggggcgggaaggggaggaggggaggggcggggagggcacgaggggagaggtgaggaggggaggggaggggaggagggagggttaggggcggggaggggaggagggagggggaggggaggaggggagggctaggggcggggaggggaggggggagggggagggaagggaagaagggggggaggggaggagggaggggggacggcagcggcgggcaggggagcagcggggggggcggggcgcggcggacccgggaccgcgcggactctgcccccgcctggccgcggcgcccaaaagagcgggtggggcgagcgtgcgggcgccacggggacctcgtccgcccggagtcccggccctgacccgggctgtgcgggtctccgagcggcgtgaggtcctcagaggctggaggttccccgcgggtcgggccggcggagccccgggcggggacgtggagaaggaggacgagcagcggcgggaccggccccgcgggacggttcccgactttcctcctcagggagtggcagccgcgccgtgtgcgcctggaaactccgacagcaggaggcaccttaaagtggaaggggcgacgtggcttcatttcaggagtttcttttctcctaatactcaaaatcctggcgcgtccttggacccctggcacgttagaagctcgagttcctcggcacccaccttgcgacggcgtagggtgtccaggcgcagccctgtgcccaggcaccgttcctatcagcgcacttgctgtcccatttcacagaagagcacgggggcgccaggagctgggaaccccatgaaatggcgccggggtctgtgcccccaccaggtcgtggggagccctgagctgagggtgcctggggattgagggcacctgagccagggaaacccaggcccaagggacccacactgggtcctttcggctgggaccatccgggaggcctcaggagtgtcagacccacgtttccggagtccagccttgacctctgccactcacggtcacttaaatgggaagtggcaggcctggggtcagaaacaaggctgctgggccccagatccgctgccaccctgaccctcctctaaaacccgttcagcaccaccatcagccccctgccccagcaacaccaaaacagggtgcgtctcagcaactggacttcaactgggagctcctcgaccctgcttcccggatggtcagacacctgcacgtggggcaggggggcatcatgagggaactccaagggcaaggggctcttgggagacagcaaaggcacccagagtggtgctgggtgggaagacggtgcaagctgacctgtggccctccaagggcagggttgaggtgctcccttgctgcactcacggtggggtgggggggctctagctcccgtcggaattaggattgtgagggttctggtgcctagcatcaatgctacataaatgtagggttcagcgtcactactgcgctttcccccacacttcaccctgtctgcaaatgagtgaccactgctgtcagtgtagtcttgacagccaacgcacattttctcctaagatggagagggtgcaacatctactggagtcaaggaaaggcggtgttcttcattgagcacctactgtgtgctggggagcaagggagaggtcacttggaggggcctgccaaagtgggagcggggggaagacagtgggggctgtgggatggggccaagccaagagggagagacccaggagaggggtggaggtagacctgggaggatagagggtggaggtgaggctgcaggctgttcccccttccatccttccccttgggtcaggatttgggttagcccttaaaatccctgggcaggataaggattaaaatctggtggggaaagcaagaattaggattagggtcaggattggggtcgtctcctacatatgctgactgcagcccaccacacttcaaggaacttcttgtcacggctttcatagctggatctgctgctgcccccagctgcctggtcctcccttccaggaagaacctgaggccagggcagctcccagcagggacagagcctggcctggaggccaggcctcagtggctttctccttcacctgcaaatagcagagctggaagcgggtggtggtacatgtacccaggctgggtcccctagagacaagcaacccctgagggccaggtcgccactcccaggcaagcaagctcacgggttcagcaactgcagctcccgcctcttgcccagcactggctctgccaccttggtgcctcatcgcaacctggatggctccgggcctgtttccaaatggactctatggagactaagacacctgtgaagtgggcagaagggggcctggcacacagtaggtgccacctaagtgcagccagccactatacctgccgttgctttctctgcttctctgggacttgagaggtgaagtaccttgcccagagtcaaaacgggagttgtctcccaggttcctggcacggggctcttggagtcgaacgagtgcccgtcagtgggtttgacgtgcaggcagtgggcagggaaggctgagggggtggatggtttggaaagacatctaaggtatccctcagtctctgtctgcataaaggcggcaagacagtagctaccacctgggattgtagagaagattaaatagtttgtgaaatgcttgacccagggccaaacattaggaaacatcatttgagggttaattgaacaaaatacagtgtgggtaggtatcacgtgtttgctgggtcaagatgtagaaggtacttcttcctggggtcaagatttaaaagggttggaaaccgctgccttcaaattcacaatccaggacccacgaattcaaaattcccctcggactttgcaatccttggagtgcctcttaatttagtgtaaccttacagtcagtcagggacagggtaaccctccgggtttcagcaccgcgagtctgctgtgctctgtctgtgaggaggtcttcactgggtcacagcaaagaaaaacacacagcagtagtgctggacgtggtcgccagagcccctcgcgcagacaagccgggacgcggcccccctgccagagcccctcgtgcagacaacccggaacgcacagcccctcccaccatctcagtctgtgcgttcgttcactgtccccgtctcctcccacgagctccaggaaagtgggagctggcacacagtgggtgcgcaagccgtgcttactgggatgcccagagcctgaggtcaccagggagctgacagctgcagggagctctccctgggtcacagcaaggcaagacacacaagcaacagcggagggcaacagtgcgttctcaaagggagagctggtttccgcctgcttctcgtacaaaacgaggggcagagatggcaggggccaccccgcgaaacactcgattaaatccccgttcacaaaccttcctgatgcctggcagccctatccctgcccccgaaaccagcatctggtgaaggcaaggagaggcacctggaagacctcaaatctttgcaggtctgcaaagccactgagcacccacagaccccaaggacctggttccgactcaaggaagaacaaggacggtggtggcggaggggctccagagaactcgtaatgcctctggtgaggccaccgccgtcctgcatctcttgatgtgactggtgacagcccaccagggcggggaaccggttcacctcccaagtgctcaccgggggccgcgctttcgactctccctgcacaggccgtgggtcgtggctccgggtgagtggaaacatttgccccgcagcgaccaccgcccctccctccccgacctcgagccacaggaccaggggacggggctgggctgcgctctgggccccgcgatgcctccgggaggcacggccgccctctgctggacacgccgaggaggcgctccacgccagggtctcaacatcctcctgagaacagcccagcaatggggcaaataaacatcaaggaccccctagctgagtcctgatacctgtgaaacaaacaggacaccccgttacatttgaatcccagaagagcaacaaaccggttttcagtatgtgtcccgaatactgcatgggacatacttacacattcgtttatctgtaatccgagcccaactgggcatcctgtattttatctggccatcctacccaggaactacaaaccgagaaaacaaggaccatcagggagagagaaacagctgggtcaggtcagtgggggcccagacagcgccagtccagggcccggacatcttcaacaaagcctgggcctgggaggctgaggctctggggaccgtggccggtccaggaccatcagttctgagcgactttctccctcccccacttccacccccacagaaattgtctcaggagggctgatctccaggcaggcccctggctaacgcctgcttcctggcacggccatggactctgtccagaacagatttccatatttggttagcaggtaggaaggaggtcatcaaagaccttcacttcactgtaaaaggaaagcattaaataaacgaacacaaatgacttttatttatggctgccgaaaagctgaggacagtaagtttgttctagagaggtatgagctcccctgaggttagtcaagaccaagtctggtggaggcctcattagtcctaggagcctggtgtcagacaaatccggaagagccccaaggcacagcgggccctccaggtcctcctgcctgggtctgggctgcaggaagggcaggattccaccaccccacagctaacccagaggcaaagctacgctacacaagcggtgagcaggccagcccagctcctcgagaccagcacatcaacccagctgctgacaggagaggggcaagcccttcctgaggcaaaacagtatcccctctgctccttaactgtcttacccacatctagtgcaccctcagaaacacaagacaccatggacaagaacagaatattagtcaacaatggcatcccagggtctctcccagctccaacctatcttagatattccagtcaaatccaatctccctaaagcgtgactctacttcagctaaaaaacacactaaggctccccactgccttccca

SEQ ID NO: 728 - DNA, 2819 bp, Homo sapiens
tggcccaccctaaaaaagggtctccttccggaggtaagaggacttggcctctgctgtgagatggcagagaagcaggaaacacgttggggaggagggcaccccccagagatagaattccagggccattgtctgtgcagccacagagcaaacactcggcctttgttcccgggaccctgcgggaggggggcctcgggatgcccattccgccagtgtggcccgcaaacccgccggacaggtttggttctcctggcctcccggccccccgccaccccgttcacccgaagcctgggacccagccttcatccccagtgtctcccccgcccgagccagcagggcggctgggcctccccgcacgtgcacgggttcgaatcccgccgacgcaccgggtgccaggaccgagggtcagccctctccgcgcgcagcgggagcgcccaccccaggggcggaggcgcggacgtcctgccggggtaacccgcggccgcccccacctcccgggcccgcgtgactcacctcccaggccaggcggggcgggatggaggcgcgcgcgcggcccctccgcacagacttcctgctgccggggcgggggatgctggccccggctccccgggcctctcgcgacccccatccccctgggcctgggacgcggggacccccgagcctgggagggcgcgcgcagtgcggggcgcggagggaggtctggtcctcacgcgaggtccccgcctccagggtcctcggagggacgagggcgcgcagcctccgcgttcccctgcaaacttgcgcgcagccgggggcgtgtccgtcccgggagggtccccccaacacccgggtccccaaggctcttaccgaccagtaagcacagcacgtcgagcagcacgaagacccacctccgctgcatggtccccgcgacccccgacgccggtcccagcgcgtcccgtcgcgtcccggcccggccgcggagtcacgtggcgcggagcccgccccgcgcggagaggaggggaggggcgggaaggggaggaggggaggggcggggagggcacgaggggagaggtgaggaggggaggggaggggaggagggagggttaggggcggggaggggaggagggagggggaggggaggaggggagggctaggggcggggaggggaggggggagggggagggaagggaagaagggggggaggggaggagggaggggggacggcagcggcgggcaggggagcagcggggggggcggggcgcggcggacccgggaccgcgcggactctgcccccgcctggccgcggcgcccaaaagagcgggtggggcgagcgtgcgggcgccacggggacctcgtccgcccggagtcccggccctgacccgggctgtgcgggtctccgagcggcgtgaggtcctcagaggctggaggttccccgcgggtcgggccggcggagccccgggcggggacgtggagaaggaggacgagcagcggcgggaccggccccgcgggacggttcccgactttcctcctcagggagtggcagccgcgccgtgtgcgcctggaaactccgacagcaggaggcaccttaaagtggaaggggcgacgtggcttcatttcaggagtttcttttctcctaatactcaaaatcctggcgcgtccttggacccctggcacgttagaagctcgagttcctcggcacccaccttgcgacggcgtagggtgtccaggcgcagccctgtgcccaggcaccgttcctatcagcgcacttgctgtcccatttcacagaagagcacgggggcgccaggagctgggaaccccatgaaatggcgccggggtctgtgcccccaccaggtcgtggggagccctgagctgagggtgcctggggattgagggcacctgagccagggaaacccaggcccaagggacccacactgggtcctttcggctgggaccatccgggaggcctcaggagtgtcagacccacgtttccggagtccagccttgacctctgccactcacggtcacttaaatgggaagtggcaggcctggggtcagaaacaaggctgctgggccccagatccgctgccaccctgaccctcctctaaaacccgttcagcaccaccatcagccccctgccccagcaacaccaaaacagggtgcgtctcagcaactggacttcaactgggagctcctcgaccctgcttcccggatggtcagacacctgcacgtggggcaggggggcatcatgagggaactccaagggcaaggggctcttgggagacagcaaaggcacccagagtggtgctgggtgggaagacggtgcaagctgacctgtggccctccaagggcagggttgaggtgctcccttgctgcactcacggtggggtgggggggctctagctcccgtcggaattaggattgtgagggttctggtgcctagcatcaatgctacataaatgtagggttcagcgtcactactgcgctttcccccacacttcaccctgtctgcaaatgagtgaccactgctgtcagtgtagtcttgacagccaacgcacattttctcctaagatggagagggtgcaacatctactggagtcaaggaaaggcggtgttcttcattgagcacctactgtgtgctggggagcaagggagaggtcacttggaggggcctgccaaagtgggagcggggggaagacagtgggggctgtgggatggggccaagccaagagggagagacccaggagaggggtggaggtagacctgggaggatagagggtggaggtgaggctgcaggctgttcccccttccatccttccccttgggtcaggatttgggttagccct

SEQ ID NO: 729 - DNA, 13104 bp, Homo sapiens
tataaccttgggtatttttttctttctttgtgtgtgtatgttttttatttgtttggctggtttttttttgtttttgttttttgttttttgttttttgtttttgtttttgttttgagacagagtctcactctgtcgccgaggctggagtgcagtgacaggatctcgggtcactgcaagctccgcctaccgggttcacgccattctcctgcctcagcctcctgagtagctgggaccacaggcacccaccaccacacctggctaatttttttttgtatttttagtagagacagggtttcgccatgttagccaggatgatctcgatctcctgacctcgtgatccacccgcctcggcctcccaaagtgctgggattacaggcgtcagccaccgcgcccggccagttggttatttttgagacaaggtctggctctatcacccaggctggagtgtagtggtgcgatcttggctcactgcaacctccacctcccacctaaacctgctgaattagtgtctacaggcatgcaccaccacacctggctcacttttgtgtttttcatacacatgggtttacaccatgttgctggggctggtctcaggaactcctgagctcaggtgatcctcccgtcttggccccctaatgtgctaggattagaggtgtgagccaacccaccccacccatacttacgtatttctgttcagattttattgagtttttatgaccaagcctatggtctatcctggagaatatttgtgtatgtgacaatgtatattcttcaacatcgtagactcgattttgggtgctcccatcgggactgtgtgtacctgtcctggaactcaagtgcacccttggctcataatccattgctcttctccagaaatcttaccaattctcctgcttaaatataagctacgtgtagtaggcattgttttttcttagcagatacgaaactcaggaagattgtcctatgataaacaaggctaacctgctgattgtttgaagcaaggaactggagatggtccttttaggggtttatgttttggattccagaaaacgtgtaaacagggccaatacgtgcatctttattttgtgtccagtttagcctggtcaacaaaaatgtcaacaaaaaacccagagtgctggagtaagaaggtctcgggctgtgactctccaaagggaagaattttctcttgtctaaaagaaaagaacgcacttccctttagagtgttaccgtgtgagaaaagcaatgctgaagttgatgctgatcttgcaaataactttgcagagcctgcttataatcagactttgacaatggtgggcgtctgtttttttttttctaagacaggatctctgttgcccaggctggagtatggtggcacttccaacctaggtctcttgggctcaaatggtcctcttttttgggacagagtcttgctctgtgacccaagctagaccacagtggcacgatcttggctcacggcaatctctgcctcccagtttcaagtgattcccctgcctcaacttcctgagtagctgggattataggtgtctgacaccatgactggctataattttcatttttcttatttatttatttttgagtctcgctgtctctcaggctggagtgcagtggcagcctttgcctcttgggttcaagcaattttcctgcctcagcctcccaagtagttggaattatatgtgtcaccatcatgccctttttgtttttttttagtagaaaatgggtttcaccacgttggccaggctagtctcaagcccctgacctcaagtgatcctcccgcctcagactcccaaagtgctgaaaatgcaggcgtgagccactgcaccgagccatcaacaccttctactccatggaaatgatactggcgctggtttatagaacctcacttggggtcgggcagatttaaaagggacctcaggctgggtgtggtggctgacgcctgtaatcccagcactttgggaggccgaggcgggtggatcacgaggtcaggagatcgagaccatcctggctaacatggtgaaaccctgtctctactaaaaatacaaaaaattagccaggcgtggtggcgggtgcctgtagtcccagctactcgggaggctgaggcaggagaatggtgtgaacccgggaggcggagcttgcagtgagccgagatggcaccactgcactccagcctgggcgacagagcaagactctgtctcaaaaaaataaataaataaataagggggtgggggacctcattgtcccttgcagatgggatgtgccctgcttagcaagagcacggaggtggagtgcatggctttgagttttcactggggcacggaggtggagtgcatggctttgagttttcactgggtaaatgcagctgaactcttggctgcacgaccaggtcatatgtgcaacgagacaggggtctcactatgctgcccaggctaaaatgggcttaggtccttttgcctccacctctccccagtccttagtagctgggactacatgtgaatattaaccatgcacaggcaagaggaaagaaaggaccgttctttggttcacacctagccgccagtcaaattagtattttagatgaagactgcatttgagacatacttgaacaacaaatgatttgctgtttaggtgtgggcatctttcttttttcctagttttaataatggcaccaggcagagtacagtggcccacgcctgtaattccagcactttgggaggctgagacaggaggatcacctgaggtcgggaatttgattccagcctggccaacatggtgcagccccatctctactaaaaatacaaaattagcccagcatggtggtggtatatgcttgtaatcccagctactctggaggctgaggcaggagagtcgcttgaagctggaaggctgatctttcaatgagctgagatcacgccactgcactcaagcctcggcaaaaagagtgagactccatctcaaaaacataaaaaataggccagacacggtggtccactcctgtaatcccagcactttgagaggccaggacaggcggatctcctcaggtcaggagtccaagactagctgggcaaacaaggcaaaacctcgtctatactaaaattaggaaaaatggctgggaacagtggtggacacctgtaatctcagctacttgggaggccacggcaagagaatctcttgaacctgggaaaaggagattgcagtgagacgaaatcacaccattgtactccatcctgggtgacagagtgagattctgtttcaaaaattaaataaataggccgagcacagtgactcatgcctgtaatcccagaactttgggaggccgaggtggcggatcacctgaggtcgggagttcaagaccagcctaaccaacacgtagaaaccccatctctactaaaaatacaaaattagccgggcatggtggcgcatgcctgtaatcccagctgctcgggaggttgaggcaagagaatcacttgaaccccagggggcggaggttgtggtgagccgagattgtgccattgtattccagcctgggcaacgagtgaaactctgtctctaaataaataaataaaactattaaataaacattaaacgttaaaaaataaaaatagataaatatgagatcatcatgaatttgagtgtcacctttgcgcagggcccatggtaatctttgtcattccaattttttcatgcgtgctgccaaagctagcacttgtgtgtaggaagtattcttcctgtgagcatacaatatatggaagtttcttttattattattattttttatgtttttgcgactgagttttgctcttgtcgcataggctgaagtgcaatggtgtgatctgggctccctgcgatgtccacctcttgggttaaagcgactctcctacctcagcctcctgagtagctgggattacaggcatacacttccagggctagctaatttgttgtattttagtagacgggatttctccatgttggtcaggctggtctcaaactcccgacttcaggtgatctgcccaccttggctttccaaagtactgggattgcagacagccaccgcggctggccttcatatattcttatatatataatatcatgtacacacaaaagactcttttacaccctgagaatactcttatatcactttgggcatttttttgttggtgtgtgcattttttgtttgttcgttcgtttgtttttgagacaagatctggccctgtcacctatgctggagtgcagtggtgtgatctcggctcccggcaacctcaacctcccacctcagcctcctgaattagtgtctacaggcatgcacctctatacctggctaacttttgtatttttacagatgaggttttaccatgtttcccaggctggtgtctaactcctgagaatataaggtatatgtagtaggcgttgctttttctctttgaagacaaaacccaggacagttgtccctcgatgaacaaggctaacctgctgaacgtttgaagcaaggaactggagatggtctttgtatcggtttatgttctagattccagaaaatatgcaaacaggaccaataaatgcatctttatttttgtgtccattttgaccaggtcaaggaaaatttcaacaagaaacccagagtgccggagcaagaagatctcaagctgtgagtctacaaagggaagccctttctgttgtctaaaagaaaagaaagtgcttctctttggtgggttacggtttgagaaaagcaacgttgaagttgatgctgatttcggtaatacatttgcagagcatgcttatcacacttggacgatggtggggttctgttttggttttgcttttttattctaaggctctgtgttgctcatgctggagtgcagtgacatgtccaatatatctcttggcttcaaatggtcagcctgggcaacacagggaaattctgtctcaaaaaataaacaaatgaataaaaatacaaaataaagccgggcatggtggctcatgcctgtaatcccagcactttgggaggccgatgcaggtagatcatctcaggtcaggagtttgagaccagtctgaccaacgtggtgaaaatccgtctctactaaaaatacaataacaacaaaaattagcccagtgtggtggtgggcacctgtaatcccagctacttaggaggctgaggcaggagaattgcttgaacccgggaggcagaggctgcagtgagccgagattgtgccacagcatccagccaggatgacagagtgagattccgtctgaaaaaaaaaaaaaaaaaaaaaagctgggcgctgtggctcacgcctgtaatcccaccactttgaaaggccgaggcgggtggatcacgaggtcaggagatcgagaccatcctggctaacacggtgaaaccccatctctatttaaaaatacaaaaaattagcgaggcgtggtggtgggtgcctgtagtcccagctacccgggaggctaaggcttgagaatggcttgaacccaggaggcggagcttgcagtgagccgagatcgtgccattgcactctagcctcggcaacagagcaagactccgtcaaaaagaaacaaaaacaaaaacaaaaaaaagaaccctacagtactggagcaagaagacctcatgctgtgaccctctagatggaagcactgtctgttgtctaagaaaagatcgtgcatccctttagagtgttactgtttgagaaaagcaacgttgaagatgctgctgatcttggtaatacatttgcagagcgtgcttatcatcagacttgcatgatgttggggttctctttggtttgtttttttccaagacaggttccctgttgcccaggcgggagtgggtggcacctccaaccgagatctcttgggctcaagtggtgatctttttatttttgattttttgagatgcgctctcattccgtttcccaggctggagtgcagcggcaggatccctgttgaccggaaactccgcctcccagcttccggcgattctcccacctcagcctgccgaatagttgggaatagagatgcccgccatcgtgtcctgctagttattatttttattgttgttgttgttgttgagatggagtttcactcttgatgtccaggctggagtgcagtgttgcaatttaggctcactgcaacctccacctcctgggttcaagcgattctcctgccgcagcctcctgggtagctgggattacaggtgcctactgccccacccagctaatttttgtgttttgaatagagactgggtttcaccatgttgggcaggctggtctcaaactcccgacctcaggtgatccaccagccttggcctcctaaagtgctgggattacaggcgtgagccaccgcccctaatctcacgtggtcctctagagtcagcctagactctggtctatcctggaggatgtttgtgtgtgagacaatgtatattcttcaacatcagcccaattctcttagctaaatgtaaggtatgagtagtaggtattcctttttctctttggggacaaaactcaggacgatcgccccttgatgaacaaggctaacctgctgagcctttgaagcaaggaattggagatggtcctttcaggggtttatgttctggattccataaaacatgtaaacagggccaataaatgcatttttatttttgtatccgttttaacctggtcaaggaaaattccaacaagaaacccagagtgctggagcaagaagatcccatgctgtgaccctctagaggaagcactttctgtttgttgtctgagaaaaaacaaagtgcttccctttagagtgttaccgtttgggaaaagcagtgttgaagttgatgctgatgttggtaatatatttgcatgcttattatcagacttggatgatgttggggttctgttttgtttttgttttctaagacagggtctctgtggcccaggctggagtacagaggcacttccaacctaggtctcttgggctcatatggtcctttttgggacagtcttcctctgtgacccaggctggagtgcagtggcacgatcttggctcactgcaatctccacctcgcgggttcaagctattctcctgcctcagcttcctgaatagctgggattgcaggggcccgacatcacacttggctaatatttgtatttttcttttttattcatttatttatttttgagatggagtctcgtttccccagctggagagcggtggcatgatcccgactgactccaacctctgcctctcaggttcaagcaattctcctgcctcagcctctgaagtagctgaaactacaggtggccgccaccacgcctggctacgttttgaatttttttttttttttttttcagtagagatggggcttaccatgttggccaggctggtctcaaacccctgacctcaagtgagccactcaccttggcctccgaaaatgctgagaatacaggcatgagccaccaccgcgcgcctcccaaaggcgtgagccatggtgcgtggccatcaacacctcttactttatggaaatttttctggcactggtatagaacctcacatggggtcaggtggagttgaggggacctcagtgtccctgcagatgggatgagcaagagcacggaggtggagtgcatggggcttcagtgtgtattggggaaatgaagctgaaatcttgggtgcatgaccaggagataaatgcatgagacgggggtctcactatgctgccctggctaaagtggtcttagatcctcctgcctctgcccctcccaggccttgttagatgggactacatgtaaatattaacccatgcacaggcaggaagaaagtaaggaccattttttggttcgtcccggccctcagttaaacttgtgttttagataaacaatgtatttgagatgtgcttaaacaataaatgatacgctatttaggtgtgggcatctttgtttccccctaattttaatgatgggactagtccaggtatggtggctcctgcctataattccagcactttgggaggccgagacaggaggatcacctgaggtcagttgttcgagaccggcctggccaacatggtgaaaccccgtccatactaaaaatacaaaaatcagccaggcctggttgcacacacctgtaatcccagctactcgggaggctgaggcaggagactcgcttgaagccaggaggctgagctttcagtgagctgagattgcgccactgcattccagcctgggcaactgagtgagtctcagtgtcaacaaagtaaataatagtctaggcacagcggcacacgcctgtaatcccagcactttaggaggctaagacgggaggatcacctgaggtcaggagttcaagaccaacggggccaacgtggcaaagccttgtctctactaaaactacaaaaattagctgggtgcggtggtgcacatctgtgattccagctactcgggaggccaagacaggagaaccacttgaacccaggaggaggcgatttcagtgagctgtaatgaagccatggcattccagcctgggccacagagcaagattccgtctcaaaaataaataaaacaaataaaaatacgtagataaatacgggaccgtcgtgaatttgagtgtcacctttgtggagcagccacggtaatctctgtcattccaattttttttatgtgcactaccaaagcaagaacttgtgtaggaattattcttcctgtgagtatgcgatgtatggaactttccttgagacagggtctcaaaaatatatcatgtatattttatatattcttatcatatataatataatcatgtacacacaaaatactcttctaaatacagagaatactctgatatcaccttgcgtattttttgtttgcatgtgtctgtgtttggttgttttttttttgtcatatttttgtatccctacttatatatttatttttaattttattattatactttaagttctagggtacatgtgcacaacgtgcaggttagttacatatgtatacatgtgccatgctggtgtgctgcacccattaactcatcatttagcattaggtatatctcctaatgctatccctccccgctacccccacccaacaacagtccccggtgtgtgatgttccccttcctgtgtccatgtgttctcattgttcagttcccacctatgagtgagaacatgcggtgtttggttttttgtccttgcgatagtttgctgagaatgatggtttccagtttcatccatgtccctacaaaggggttggttatttttgagacaaggtctgactctatcgcccaggctggagtgtagtggtgccatctcggctcactgcaacctccacctcccacctaatcctgctgaattagtgtctgcaggcatgcacaaccacatctggctcacttttgtattttttatacacatgggtttacaccatgttgcaggcgctggtctcaaactccctcccaagctcaggtgatcctctgtctcagcctcctaaagtgctgggattagaggtgtgagccaccacaccccactggtatttgtgtgttcctgttcaaattttattgaggagtttttataaccaagcctgtggtccatcctggaggatgtttgtgtgcatgacaatgtatattcttcaacatcgtagactcgatgttggatgctcccatcgggactgtgtgtccctgtactggaactcgagtgaacacttggctctaagttcattgctgttttctagaaatccagcccaattctcttggttaaatataaggtgcacgtagtaggcattgctttttctttctggagacaaaactcaggaggattgccccttgatgaacaaagctaacctgctgagactttgaagcaaggaactggagatggtccttttaagggtttatattctggattccagaaaatgtgcaaacagggccaataaatgcatctttatttttgtgtccattttaacctagtcaaagaaaattacaacaaaaaatccacagtgctggagcaagaagatctcatgatgtgaccatctggaggtaagaagcactttgtgttttgtgaaagaaagtgcttcctttcagagggttactctttgagaaaagcagcattgaagttgatgctgatcttggtaatacatttgaagagcatgcttatcatcagacttggatgatcttggggttttgtttttttctaagacagggtgtctgtagcccaggctcgagtgcggtggcacttccaacctagatctcttgggctcaacaagtagccctctttttcggacagagtctcgcgctgtgaccctagctggagtgcagtggcaggaacttggctcactgccacctctgcctcctgggttcaagcaattctcctgcctcagcctcccgagcagggttataggcatgtgccaccacacctggctaatttttgcattttattatcgattgattgattgattgttgagacagagtctcactctgttgcccaggctgtagtgcagtggtgtgatctcggctcactgcaacctccacctcccacctcagccttctgaatacctgtctacaggcatgcaccaccacacctcgccaacttttgtgttttttgtacagatgaggtttcaccatgttgcccaggctggtcttgaacccctgagctcaagtgatcctcccacctcggcctcctaaagtgtgagtcactatgtcccgccctacttgtgtgtttctgcttacattttattgaggcgattttttttttttttttgagacggagtcttggtctgttacctaggctggagcgcagtggcgcgatcttggctcactgcaagctccgcctcccaggttcatgccattctcctgcctcagcctcctgagtagctgggactacaggcgcccaccaccacgcccggctaatttttttgtatttttagtagagatggagtttcaccttgttagccaggatggtctagatctcctgaccttgtgatcctcccgcctcggcctcccaaagtgctgggattacaggcatgagcgaccgtattgaggcgcttttacaacatagcctgtggtctatcctggggaatgtttgtgtgtgtgacaatgtatattcttagacatcttagattccattttggatgctcccatcggtactatgtgttcctatataggaactcaagtgaacacttggcttaaaatccattgctcttgtctagaaatttagcccagttatcttggttaaagataaggtgtgtctggtaggcattgatttttctttccggagaaaaaacttaggaggatttcctcttgatgaacaaggctagcctgctgagcctttgaggcatgggacctggagatgatcctgtgaggggtttatgtttttggattcaggaaacacaccagcaggacaaataattgcatctttatttttgtgtctattttcaccaggctaaggaagattccaacaacatatccatggtgctgaagtaagaagatctcgtgctgtgaccctctagagggaagcactttctgttgaaagaaaagaacatgcatcctttcagagggttactctttgagaagagcaacgtttagtttgatgttgatcttggtagtacatttgcagagcatgcttttatcatcagacttggctgatggtggtgttctgttttttgttgttgttttctacaacaggatgtctgttgcccaggctagggtgtggtggcacttacaacctagatctctagggctcaaatggtcctcttatttggggcagagtcttgctctgtgatccaggctggagtgcagtggcaggaactctgctcactgcaacctccgcctcccgggttcaagtgattttcctgccttggttttctgagtaggtgggattacaggcgcacaccaccacacccagctagtatttgtagttttctttattattcttttttttattttaatttttgagacgaagtctcgctgttgcctacggtggagtgcagtggcgtgatctcggctctctacaacgtctgcctcccaggttcaagcaattctgctgcctcagcctcccgagtagctggaatcaacaggaacacaccaccatgcctggctactttttggatttttttttagtagagacggagtttcaccatgttggccaggctggtctcaaactcctgacctcatgtgagccacccacctcggccttccaaagtgctggaattacaggcatgaaccacgacgtctggcctaatttttgtatttttagaagagacagggtttcaccatgttggccaggctggtctcagctcctgacctcaagtgatcctccccctcggcctcccaaagtgctgggattacaggcgtgagccacctcgcccagcctcaagtggtcctcttgactcagcctcccatgtagttgggactacatggggcgtgccaccacacttggctaagtttttaatttttcatacagatatgatctctgttgctcaggaaggtctcaacacctgagctcaaggattccacaggcgtgagccacattctcctgctgacccttttcaaagatagttgacatggccaggcatcatggggcacacagtcccagccaccgcagatcccggggtgggagggtcctttgatttccagactattccatgcactgatcacaccttgtttttttgtttgtttgtttgtttgtttgtttgtttgacagagtctcagtttgttgcctggcgggagtgcaatgatgtgatctcgggtgactgcaacctctgcctccaaggttcaagtgattctcctgcctcaccctccaaagtagctgcggttacaggcatgcaccaccacacccagctcagtttttgcatttggtagagacaggttttcaccatgttggtcaggctggtctcgaactcctgatttcaggtgatccacctgcctcagcctcccaaagagctgggattataggcgttagcctatgcgcccggtctgtatttcctaattttaaatatgggacccatggtgaatttgggtgtcactgtgtacaggggacatgggaatctctgtcattccaatttttttaatgcatgctgttctgtgtaggaattattcttcctgtgagcaaacaacatagagagc

SEQ ID NO: 730 - DNA, 6855 bp, Homo sapiens
atctggaggtaagaagcactttgtgttttgtgaaagaaagtgcttcctttcagagggttactctttgagaaaagcagcattgaagttgatgctgatcttggtaatacatttgaagagcatgcttatcatcagacttggatgatcttggggttttgtttttttctaagacagggtgtctgtagcccaggctcgagtgcggtggcacttccaacctagatctcttgggctcaacaagtagccctctttttcggacagagtctcgcgctgtgaccctagctggagtgcagtggcaggaacttggctcactgccacctctgcctcctgggttcaagcaattctcctgcctcagcctcccgagcagggttataggcatgtgccaccacacctggctaatttttgcattttattatcgattgattgattgattgttgagacagagtctcactctgttgcccaggctgtagtgcagtggtgtgatctcggctcactgcaacctccacctcccacctcagccttctgaatacctgtctacaggcatgcaccaccacacctcgccaacttttgtgttttttgtacagatgaggtttcaccatgttgcccaggctggtcttgaacccctgagctcaagtgatcctcccacctcggcctcctaaagtgtgagtcactatgtcccgccctacttgtgtgtttctgcttacattttattgaggcgattttttttttttttttgagacggagtcttggtctgttacctaggctggagcgcagtggcgcgatcttggctcactgcaagctccgcctcccaggttcatgccattctcctgcctcagcctcctgagtagctgggactacaggcgcccaccaccacgcccggctaatttttttgtatttttagtagagatggagtttcaccttgttagccaggatggtctagatctcctgaccttgtgatcctcccgcctcggcctcccaaagtgctgggattacaggcatgagcgaccgtattgaggcgcttttacaacatagcctgtggtctatcctggggaatgtttgtgtgtgtgacaatgtatattcttagacatcttagattccattttggatgctcccatcggtactatgtgttcctatataggaactcaagtgaacacttggcttaaaatccattgctcttgtctagaaatttagcccagttatcttggttaaagataaggtgtgtctggtaggcattgatttttctttccggagaaaaaacttaggaggatttcctcttgatgaacaaggctagcctgctgagcctttgaggcatgggacctggagatgatcctgtgaggggtttatgtttttggattcaggaaacacaccagcaggacaaataattgcatctttatttttgtgtctattttcaccaggctaaggaagattccaacaacatatccatggtgctgaagtaagaagatctcgtgctgtgaccctctagagggaagcactttctgttgaaagaaaagaacatgcatcctttcagagggttactctttgagaagagcaacgtttagtttgatgttgatcttggtagtacatttgcagagcatgcttttatcatcagacttggctgatggtggtgttctgttttttgttgttgttttctacaacaggatgtctgttgcccaggctagggtgtggtggcacttacaacctagatctctagggctcaaatggtcctcttatttggggcagagtcttgctctgtgatccaggctggagtgcagtggcaggaactctgctcactgcaacctccgcctcccgggttcaagtgattttcctgccttggttttctgagtaggtgggattacaggcgcacaccaccacacccagctagtatttgtagttttctttattattcttttttttattttaatttttgagacgaagtctcgctgttgcctacggtggagtgcagtggcgtgatctcggctctctacaacgtctgcctcccaggttcaagcaattctgctgcctcagcctcccgagtagctggaatcaacaggaacacaccaccatgcctggctactttttggatttttttttagtagagacggagtttcaccatgttggccaggctggtctcaaactcctgacctcatgtgagccacccacctcggccttccaaagtgctggaattacaggcatgaaccacgacgtctggcctaatttttgtatttttagaagagacagggtttcaccatgttggccaggctggtctcagctcctgacctcaagtgatcctccccctcggcctcccaaagtgctgggattacaggcgtgagccacctcgcccagcctcaagtggtcctcttgactcagcctcccatgtagttgggactacatggggcgtgccaccacacttggctaagtttttaatttttcatacagatatgatctctgttgctcaggaaggtctcaacacctgagctcaaggattccacaggcgtgagccacattctcctgctgacccttttcaaagatagttgacatggccaggcatcatggggcacacagtcccagccaccgcagatcccggggtgggagggtcctttgatttccagactattccatgcactgatcacaccttgtttttttgtttgtttgtttgtttgtttgtttgtttgacagagtctcagtttgttgcctggcgggagtgcaatgatgtgatctcgggtgactgcaacctctgcctccaaggttcaagtgattctcctgcctcaccctccaaagtagctgcggttacaggcatgcaccaccacacccagctcagtttttgcatttggtagagacaggttttcaccatgttggtcaggctggtctcgaactcctgatttcaggtgatccacctgcctcagcctcccaaagagctgggattataggcgttagcctatgcgcccggtctgtatttcctaattttaaatatgggacccatggtgaatttgggtgtcactgtgtacaggggacatgggaatctctgtcattccaatttttttaatgcatgctgttctgtgtaggaattattcttcctgtgagcaaacaacatagagagctttctttttttgacaccgggtctcaaaaatatatcatatacattttattataatgtctgatattgataatataatcatacacacacaaaatactcttctgtacacagagaatactgatatcactttggggtttttttgtttgcgtgcgttttttgggattttggggtgtttttttttttttttttgagacaacatctggctctgttgcccatgctggagtgcagtggtgcaattggctccctgcaacctccacctcccacctcccacttcagcctcctaaagagctgaatacaggcatgcaccaccacacctgactaacttttgtattttttgtacacacagggtttaccatgtttcccaggctggactggaactccagagctcaagtgatcctcccgacttggcctccttaagtactgcagttagaggtatgagccgccgagacccaccgtacttgtgtttttctattcaaatattattgaggagcttttatggcctaacctgtggtctatcctggaggttgtttgtgcgtacaatacatagtcttcaatatcttttttttttttttcattttttgagagggagtttcgctcctgtcacctaggctggagtgcaatgacatgatctcagttcactgcaacctccgcctcctgggttcaagtgattctcctgcctcagcctcctgagtagctgggattacaggcacccgccaccatgcctagctaagtttgtattttcagtagagacgggcttctccatgttggtcaggctgggctcagactcctgacctcaggtgatccgcccgcctcggcctcccaaagtgccgggattacaggcgtgagccaccgcgcccagtcatcatatattcttatcatatatatagtaggatgtttgtgtatataacaatgtacattttcaacattgtagattccattttggatgctcccattgggactgtgtgtccctgtgctggaactcaagtgaacacttggctcaaaatccattgctgttctctagaaatccagcccaattctcttggttaaatataaggtatgtgtagtaggcattgctctttctctttagagacaaagctcaggattgccccttgatgaacaaggctaacctgctgattctttgaagcaaggaactggagatggtccttttagtggtttatgttctggattccagaaaacatgcaaacagggccaatacatgcatctttacttttgtgtccattttaacccggtgaaggaaaattccaacaaaaaacccacaatgctggagcaagatctcaggctgtgaccctctagagggaagcgctttctgttggctaaaagaaaagaaagcgcttcccttcagagtgttaacgctttgagaaaagcaacgttgatcttggtaatacacttgcagagaatgcttataatcaaccatggaaggtggtggggttttgtgtttgtttgttttgttttgttttctaagacagggtgtctgttgcccaggctggagtgtggcggcccctccaacctagatctcttgggttcaagtggccctcttttttgggacagagtcttgctctgtgaccctgccctggctggagtgtcctgtcaggatctccactcactgcaacctctgcctcctggggtcaagggattctcctgcctcagcctcccgagcagctgggattacaggtatgtgccaccacacctggcttatttatttatttatttatgagacagagtcttgctgtgtcatccatgctggagagcagtggtgcaatctcggctctctgcaacctccacctcccacctcagtctcctgaattagtatctacaggcatgtaccaccatacctggctaacttttgtatttttacagatgaggttttaccatgtttcccgggctggtgtctaactcctgagctcaagtgatcctcctgccttggcctacgtaagtgctgcggttagaggtgtgagccaccgcgccccacctgcccttgtgtatctctgttcaaatgttactgagaagcatttacgggataatgcccggaggatgtttgtgtgtgtgacagtgtacattcttcaacatcttagattccattttggatgctcccctcgggactgtgtgtctctgtcctggaattcaagtgaacacctggctctccatccattgctgttctctagaaatccagcccaattctcttggttaaatataaggtaggtgtagtaggcattgctttttctctttggggacaaaactcaggaggattgccccttgatgaacaaggctaacctgctgattctttgaagcaaagaactggagatggtccttttaggggtttttattcaggattccagaaaacatgcaaacagggccaaaaattgcatctttatttttgtgtccattttgacctggtcaaggaaaatttcaacaagaaacccagagtgccggagcaagaagatctcaagctgtgactgcaaagggaagccctttctgttgtctgaaagaagagaaagcgcttccctttgctggattacggtttgagaaaaacaacactgaagctgatgccgatcgtggtaatacatttgcagagcatgcttatcatcaggcttggacaatgccggggttctgttttcggttttgcttttttattctaagacaggatctctgttgcccaggctggagtgcagtgacatgtccaacccaggtctcttgaattcaaatggtcctttttagggggcagagtctttctctgtcacccaggctgatatgcagtgaggcgatctcggctcactgcaacctctgcctcccaggttcaagcaattctcctgcctcggcttcccaagcagctgagattacaggcgttcatcaccatacctggatgatatttgtattttttaaaatttatttatttatttatttttgagacggagtctcgctgtcacccagtctggagggcagtggcacaatctcggctcactgcaacctctgcctccccggttcaagcaattcttctgcctcagcctcctgagtagctggaattacagaagcacaccaccgcacctagttactttttgtatattttttttaagtagagactggatttcaccgtgttggctaggctggtctcaaattcctgacctcaagtgatccacccacctctgactcccaaatttctgggatcacaggtatgcgcccccatgcctggcctaatttttgtatttttagcagagacgtggtttcaccatgttggccaggctgaactcagctcctgaccttaggtgatctgcccgcctgggcctcccaaagtgctgagaatacaggcgtgagccaccgtgcctggccattaacaccttttggtccacggaaattattctggcactggtttatagaacctcgcttggggtcaggtagagttgaaggggaccccaatgtccttgcaggtgggatgtgcactgcttagcaagaacacggaggtggaatgcatggggtttgagtttttattggagaaataaagccaaaatcttgggtgcatgaccaggtcgtatatgcaacaatacgggcgtctcactatgccgcccaggctaatgtgggcttagatcctcctgcctctgcccctccccagtccttagtagctgggactacatgtgaatattaactcacgtacaggaagaggaaagtaaggactgttctttgattcacgtcccacccccagttaaatttgtattttagataaacaatgtatttgagatgtacttgaacaacaa

SEQ ID NO: 731 - DNA, 18061 bp, Homo sapiens
atgggaggtaatatcttagataggaggcactcaaattattgattaatgacctgagcatgctgacgtgtaggccatttcttcttaatcttctctagatcaggcaattgcaaggaagaaactcatggaatcgctactttccagaggtgacatgggaggccaagccaaatggagaaagcctgaaataacagcatatttataatgagatataggcatggctttcacatatttgagtgattggcatagtaacacaaaagtactttggcataaaaggaaataaaagacttctgggtgactatggagaacattctagggacaaatttgcttcagctcattaatctggtaacaatgctccctctgttcctgccattttggctctcttaaatatatataacatgaatatgtgcatatccatctgtgtattgctatcttactgactgctatcagttctggaaggtcaatgattaggaattcaatgatgatacaagtatacaaggaagacttagagttcccaaatctaattgaaatctggaaattctaaattctctttgacattctgttcccctgtcatcctcactggctggctggctgacaagtcaaaagaggctcctgcagtgggaatacagagttcaatgagctgtgcattcagggccacagaggaggagaatacaagccatacacatacagagaacccaaacacacaccacatccccattcatccactggcagaggacagagacttcttcattctgaatctcccactggcattcaagaattgcaagttctgtacaaactaggaggtgacagccacaacaaggggtcactgttactgtttccttttatatgtcttctaatcatcgtcagggaaactgtattacttacaagttttgttccttgtgctagttattgaagcatctctcggactccagagctactcttctatactatgtgttgtggggcccagactcagcaggctgtgagctgatacttccctaagagttacctgttgtctttaactcacatacaccatccataccacacacacacacaaacatgcaccacacacacaaaccatgcatacacacacaccatacacacttagaccatcactcagtgatatcggatttttttttttaacttgggttttaattaggtacataaatagcaacatgagaatgaggagttctaaggcttgtacattatctctaggtgaagggattccaggttagtttgcttgtaggatgatttcacagaagataacagaggtctggtctagtttttcctgaagaagaaagccaatttaatacattcaatactgacttctatgccatttttctgtagaaatactgatttattctatggagtttccaatgtttacctataactaaaagaaagaaaagaaaaacataagtaactgtgccagaaaaaattttgcattatgaaaattcttcagatttaaatagagaaaccaggccaggcgcggtggcccatgcctgtaatcccagcactttgggaagccgaggcgggtggatcacctgaggtcagaagttcgagaccagcctgcccaacatggtgaaaccccgtctctactaaaaatacaaaaagattggctgggcatggtggcaagtgcctgtaatcccagctacgcaggaggctgaggcaggagaatcacttgaacctaggagacagaggctgcagtgagctgagatcatgccattgcactccagcctgggcgacaagaatgaaactccatctcaaaataaataaataaatagagaaaccatagaaaatatttacatcaccattatatgaccataagaaacatgagccagagaaaactgtaattattcccattttaaagacagttaaactaagaatcagaaaggtcgagtgtggtggctcatgcctgtaatcccagcactttaggaggccgaggcaggtggatcatctgtggtcaggagttcgagaccagcctggctaacatggtgaaatcccatctttactaaaaatacaaaaaattagccgggcatggtggcgggcgcctgtaatcccagctaatcgggaggctgaggcagtagaattgcttgaacccgggaggcagaggacgcagtgaaccaagactgagccactgcactccagcctgggcaacagagcaaaactctgtctcaaaaaaaaaaaaaaaaaaaagattttgtgttccatcaacattacatatacactacattcagatcctcaattggctgtgtatctgagtgtaattaaccaactagatggatgaataaataaaaaacaaatgcctaaatggcacagtacacatcacatctgaagattaaacaactacatttccatctatctgctggaaagcatgattacatcaccctcagtttgatgtgtaattttcctcgcatcacccccatcatacttttctggaataaaatacacatatagtcaaagacatgtcaaagacaaactgagtcttctccagattgcttttttcatattttttttttttttgagatggagtcttgctctgtcacccaagctggagtgcagtggcgtgatctcggctcactgtaacctctgcctcccaggttcaagcaattctgcctcagcctcccaagtagctgggattacaggtgcccgccaccacacccagctaattttttatatttttggtagagacagggtttcaccatgttggccaggctggtctcgaactcctgacctaaagtgatctgcttgcctcagcttcccaaagtgctgggattacagccgtgagccaccacgcctggctttttttcataatttgtaatgaatatactcagcaattagagatttttttttttttttgagacggagtttcactcttgttgcccaggctggagtacagtggcgtcctctcggttcaccgcaacctccatctcccgggttcaagcaattctcctgcctcagcctcctgagtagctgggattacaggcaggcgccaccacgcccggctaattttttgtatttttagtagagatgtggtttcaccatgttgggcaggctggtctcgaactcctgacctgaggtgattcacccgcctcagcctcccaaagtgctgggattacaggtatgagccaccgtgcccggcacaattggagatttctaaatattttagaggccagtgactattcacttgatcttttaatatacaaccaaaaattcttaaacatgtaaactactagcttattttttctatctcagtttattaatctgcttttgtcttccccaggaatttgatagatttattgcattgttaaaaactaaaaactggaaacaacctatgttggtaaggattaagtagatcatggtagtccatactaggaaatcattaagcaactagagaaggaatgcgtagctctattaagtactgacagggaaatacttacacaatatgttatgtaaaacaagttcattcattcatcagcatagattaatatagtactgtctatggcaaaaaaaaaaaatgaacctaagtctaattaagccttcggatccaactataagtttatgggaaatatagagaagaaagaaaccaagagataaacagaatgatactaaatggatacattcggccacagccagaacatgagaaattctttttttcccctcccagctcaatccttgtagaaaacaggaattctaaaggacaaataagccaggtttttcaacagataaatagcaagggacaatgagggagcggaaactattacagttctaagagacctatcagtcaaacacaacaggcagatcttgtttggatcctggttcaaacgaaccaactgtaaaaagttattcatgaaacaaccaggaaaatgtgtacattgaactggatattagatgatgttaaggaattagtgcaatttctttctttctttgagacggagtctctctctgttgcccaggctgggagtgtgcagtggcacgatcttggctcactgcaacctctacctcccgggttcaagcaattctcctgcctcagcctcctgagtagtttgaactacaggcatgagccaccatgcccggccttaatttcctttttttcttttttcttttttttttgagacagagtctcactctgtcacccaggctggagtgcagtggcgtgatctcggctcactgcaacctccgcctttcgggttcaagcgattcccctgcctcggcctcccgagtagctgggactacaggcgcacgccaccatgtctggctaatttttgtatttttagtagagacagggtttcaccatattggccaggctagtctcaaactcctaacctcatgatccgcccacctcagcttcccaaagtgctgggaccacaggcgtgagccaccacgcccagccccagcctaatttcttttttttttttttttccccaaatcaataggtcttttattgcatcatttaaatatcacaagtaggtcttaagtgtcatctggcatcttctttctgtagccaggtaactcttagatcttattcatcagcctgctgaacagttcctttttcagagacatagataccatccaaaaatttcctgatatccttgtttttaactgttgtggcttgctgaatcaaagccgctgaatttgaaacaagctcaatgtcatttccttcaaggattaattcatctttctgggcttgagatactgaacaagcaacacctggtctcatccgaaccctgcggatgtatttttcacccaaaaaatttcggatttcaacaagagacccattctcctggataacaacgttgatggggaagtgagcatacacagacctcatcttgtaacggaagcccagtgtaacacccttgatcatgttctgtacatgactacaaatagtccgaacggtagccagttcctttctgttaccccaccatttgtcaacccggagcctcttttttttctttccaagaaggctgagttctacattgatgtgattgaagtccctccgcagggttcctctggggcccttcacgataactgtgcgtcccttcagagtaatgtcgacattttctggaatgtcgacagtctgattgctgagaatagtcttcattctcgcagtagacgcagcaaagaaagcctaatttctttatgtatgataatataattacaattatatgccttcagtaagttttctgtgcagctactcagaagggtgaagtgggaggatcacctaaacccaggagttgaagtccagcctgggtaacacagcaagatcccatccccccagataaataacagtaaaaagaaagttttctgtgaacttgtaaaacaatatgtggaatatgatcccattttgtcaaaaaaccaaaaacatgcatgtatgcatgaatatattataaatgtataaataaatttatttaatttataaataaattttaaatataaataaatatatatatttgtttttgagacagggtatcactctgttgcccaggttggagtgcagtggagtgatcatggctcactgcaacctctttctcccaggctcaggagatcctcccacctcagcctccaagtaactgggactacaggtgttcgtcatcacactcagctaatttttttaattttttgtagagacagggtttcgccatattgcccaggctgttctcgaactgccagactcatataatccacctacctcagcctcccaaagtgctaggagtacaggtgtgagccactgcacccggcctatctatctatctatctatctatctatctatctatctatctatctatatttaaaagtctggaatgatataccaaactattaacaaaaattacctctggaaaaaagaataaaggggccagatgtggtggctcacacctgtaatcccagtactttgggaggctgaggcaggtggatcacctgaggtcaggagttcgagaccagcctgaccaatatgctaaaaccctgtctctactaaaaaatacaaaattagctgggcatggtggtgcatgcctgtaatcccagctacttgggaggctgaggcaggagaatgacttgaacccgggaggcctcagaggctgcagtgagcaagattgctccactgcactccagcctgggcaacaagagtgaaactctatctcaaaaaaaaaaaaaaaaaaaagaaagaaagaaaaagaaaagaataaaggataagacaagcttttttgttttgtttttgagacagagtttcactctttttgcccaggctagagtgcaatggcacgatctcggctcactgcaacctccgcctcctgggttcaagcgattctcctgcctcagcctcccaagtagctgggattacaggcaactaccaccatgcctggctttttttttttgtatttttagtagagacgggctttcaccatgttggccagggtggtctcgatctctcgacctcgtgatctgcccaccttggcctcccaaagtgctgggattacaggcgtgagccaccacacccggccaagacaagcttttaaaacagttagctaaaaacattttttacaaccaacacgaatcacttttataattaaaagctacacctcctccaataaagatctaaaaacaataaagaatgaagtcaaggttgtgtatttcagcaagctgaactctggtgcagagtatctttgaaaattgaaatggatatttacctaatttccctttattctatgtctttttcattgtccctgtacagaaatatatccattctggctgacagggatttaaaaaaagagagaaatataaccatattaaaagtcaagtctctagaggacatgtgtcactctgtggctgctcaccctccagtcatccttctaatggcacatcccatgcatatctggccccattcaccagagatactgattctggggtgccctttgccttttaccaagctccccgggtaatagtttgtatctgagaacatactgatgttgggttactgtatgaacagctatgctgtgaaagaggaactggatttgttttctgtgaccactaaggagacatatttttgcttagcagaggaaacagcttccaaaaactcagaattgtcccaggatggctgccccatagggtgagtttcccatcagtgctggtgtaaaagaaggaacatacagggtttcaggggagtctgcttgaggctgggggttgggccagataaccactctcaaattctcagtttatgtgactctttgggtctccaaaaatataaagaaagcttgaggaaaaaagacccttcaaactcagggttttcataaattttaagtaagggccatgatttacaataaatgtaacaccaattttcaaaaaattttctgattataaaatgcatactcattgcagaaaattttttaaatacagaaagttataaagaagaaaaaaatataaaaatcatcatgccactgaaagatacacactttctgtcgtatctcctggcttcatcccctctataaacatatcacactacctttttttcatttaacaataattgtgcacacgttcccatgcaattaaatactgtagaaacagaataataatattcttctttatagatataccataattaagccattttcctgtagttgaatatctaggttgcttccaaattcaattacagtcttctaattaccaggaaatcacaagtgctattatacaatttttcatatatacacaaacaatataactagtgttttgagcctctctgtaacagtcatgcattccagtgttcactgagtattagataaatacaagtgtacttactataataaagtgttgtttgaaaaaaacctaaggaataatgacacttttcaattgtttgaaatacatttgtagacaaatcccaactgtctggttctagcttgtctaaaaaacccaggtaacattagtggaacaaacacaaataagtaagtcacagcatttaagcccagaaactaaaagatggaataaaatattttcacatcaaattgaaactgttataattaattaaattaaattaattaaaaacaagtcatttcagctggcactacaatgctgaaaataatcacagaaatttcttgttttttacctgattaagatggcagagcatggagttttctacttagttccaggtgaattcttcacatttcctggcttttaaaacaaaagaaagagcttgaatgcagtttgaaaagaaatagtgcaactccttagtgtcctgagtatttggctgaacatgaacattaaaaattattatgggggacagggtcaaaccattttattgaggacttggggggttgttgaagaaaggctgaggaggacaatgagatcccacattctcgcagttaccgaccattaaatattattttactgcaaagtgatccatctgtcagtaaattgaagaagttactagggctctctgagggccctactgtagagtgacttgggcagagagagcaggaaataaagctccattaatcctcattatgcagattcagccaaacagttgattctaattaaaaaatcaatatatcttccttttatttcctgaaataaaggttttacacctatgggaaggcttcctgtaggtatttactccatgcattattcaccattatccaccataggggccaatccacaaaacatgtttactctgaaagaagttagaccacacccattctgcccagtggccctccgggaacatataattaggccatgtaatccataagaagcagtgtaggaaaagcttctagtgggaaaagttcacgtgctaaacttttaaggccttactttcttttctatacgttttttagactttaattctgaaaacacattaatagtcagagatcagatggcagtctgaaaaacaggaggctgcagctgggcgggccatgggggctaagattctgttgtatagacttggagcagtttctcctggtgcccctctttcagagttattcatggatgaaggaagaggaaaaggtgagaaagcaggagcacgtgactaaccctgtcatttcagagcatggtttctaggcaactttggggctccctggagtggctgagaactggtctataagtactgttttatacccgttgtcccaacataattaatagtgtcccctttcactctcaagagtatcctggtttgccgggcatgttggttcacgcctgtaatcccagcactttgggaggccgaggcgggaggatccattgagcctgggaattcaagaccagcttgggcaacatagaaaaagaagtttaaaaaaaaaaaaaaaaaaaaaaagagtatcctggttttgatgataaagtatatggtcaccacatccacttgatgatggagttctgggaaacaaggccatacgaactgcttggcggaccaatgatcaacatacaattctcaggtctacttgatgctctgaacaagagtgctacaggactgagaatctgtgcccttctcctcctccagagccactccccaccctgcctcctcacatgcatgcacacaagcgaacacacatacccatatgtgaacacacacccacctacaacccagaggcctttttgctgttgctcgaaattgacaaactccctactgggacaagacctttgcaaaatataccccactgaccgagaccagacaatcccaatttttgcctagctaaatgttattcatcctttacatcaaggctttctttgtaccctgtccttcaatttagcagaaccttctattccctttcatagcactcatgtacttcctgattgtgtaattatttctttcatgtttgagtctttcattaacctgtaagcttcatgagggcacaatatccctagggcctcctagcacacactattcaaatatttgttgcataaacaaatggaaagccaggggcagtggctcacacctgtaatcccagcacttcaggaggccgaggcgggtggatcacttgagcccaggagttcaagatcagcctgggcaacatgctgaaatcctgtctctaaaaaaaatacaaaaattagccaggtgggatgacacatgcctgtggtcccacctactcaggaggctgaggtgggaggatcacttaagccagggaggttgaggctgcagtaagctgtgactgcacaactgcactacagtttgggcaacagagtgagaccctgtctcaaaacaaacaaacaaatggaatggggtagaacttagagatctgatgaatgtaaaaaagcttgggtttctattttcttaacacatccatgaacacgaataacaatttctgttagcaaaattaaaacttaaaaaaaaatcaaaacattgatttctaattagtatgactgccatgtgaaggctgattgccagccaaacctttgaggtatagcagcctactgaaatgtctgggtccctcaccagactaatgaagaacaagaagagagaaaaaaaggcttataagggccagtgagataatcatgtccaacaatcgggtctggcataaaaacaaggtggttctcggcagggcgtggtggctcacgcctgtaatcccagcactttgggaggccaaggtgggtggatcacctgaggtcaggagttcgagaccagcctgaacaacagggagaaaccccgtctctactaaaaatacaaaattagcagggcatggtggcgcatgcctgtaatcccagctgctcgggaggctgaagcaggagaatcgcttgaacccaggaggcggaggttgcagtgagccaagatcacgccattgcactccagcctgggcaacaagagtgaaactccatctcaaaaacaaacaaaaacaaacaaacaaaaaaacaagttagttctctacttaaatacagtttaggtctgaattaacatactgcttgccaaatacttccaatgatattcttatatattctactatctatactcgccagtacctcaatctcaaaaaaataagatgctaaattcacaagcttttttatcttttggacaataagaaaatgagcacacaaaagcattcttctgattcaggaaaacaactttgttgctaggaaaattttcttgtttggttacatatcacttatagtataacaaaacagcacagtccaatatctcattaaaaaaatattgagcccatccaccaccctgtcacaaatcagatctctcttggcagagaactccaggatctcagacaaaacaacattctgacttcaaaaaacagttcgtgatttagcacaagccagaaatcatttttttttgcattttcagacagagaaagttttatctagaatattttgtaactcattttcatacatatctgatttcagtttttattttcttaccacgtccatgaacacaaatgacaatttctttttttttttttttttttttttgagacggagtttccctctgtcacccaggctggagtgcagtggcgcaatctcagctcacgtaacctctgcctcctgggttcaaacgattctcctgcctcagcctcctgagtagctgggattacaggcgcccactactacacccagctaattattgtatttttagtgaagacagggtttcaccatgttggccaggctggtctcaagctcccgaccacaggtgatttgcctgcctcggcctacaaagtgctgggattacaagcatgagccaccgtgcctgggcacaaatgacaatttctgctagcaaaaccaaaactttttaagaaaatcaagacactgatttctaattagtatgcctgccatgtgaaggctgattgccagccagccaaacctttgaggtacagcagcctactgaaatgtctgactccctcaccagttgaattattttcaacaattacttaacttctccaaaatgcagtttcctcacttataaatggggataataatagaacccacctcaaagactcttcctgagcaaagagtttagcgccaagggccaagctcacagcaagtaagtgctcaataaacattatctatcctatatggcaggccactttattttttggatgaagaaaataaaaggtaaggataaatgacctgttaaagaccccaacacaattctagttcacttgatgaggtaggcagaataatggcccctcaaagatgtcttctatttctggaacctgtgactgttacctcacacagcaaagggaaattaaggttgcattggaattaagtttactaatcagttgcccttaaaatagggagatgatcttggattatctgggtgggcttgattcaagcataagagtgcctgcagtctaagagggaggcagaagaagaggtcagaagggggatctgcaaacgacttgctgcaggcttcgacaatagaggaaggaagctggaaacagccctcagccagcaaaacagaccttggtcctacagcctcgaggaactgagttctgtcaacaatctaaatgagcaggaaagaaattcccccctagggcctctagaaaggaacgcaaccctgctgacaccttgatttagaattggacttctgacccacagaactaagataatcatttgcactactttcaacctgtaaatttgcagtcatttattttggcagcaatggaaaactaaaacaatgacataaggattcctgactacagggtatggttccattttctatcagtggacattatcttctcaggcagaagcgaaaatgtgcagtatcacatgagtggtggttgatgactatcatgtggctagagtccagccatttcatatgttcctcacatgagataaccttatttaatcctcaaaacagctccaggaggtactatgccagttcccacagagctggagtaacttcccaaggtttcagggctagtaagaggcagaggtggggtaggagtctggtgctcccgctcctcttagtccactggacaacgctgtatcctgcccactgataccaagagtgcattcctttctaaagaggagatgacattattcaggatttctaacttttcattttggtaaataatggtgtttttaaaaagaaagaaaaaatcatttcaaaatcatttcctaatacctgtagttcttagaattttagacagcaaaaaattacaaagcacaaactcataactttatggaaaacccatcaagctgtcatttaaaaaaaatacagtggtaagaatacttaacatgacatctgccctcttggcagatttttaagtgtacaatacggtactgttatctataggcacagtgttgtgcaaggggtctgtagaacttattctctttgcttgactaaaactttgttgattaccaactccctatctctccctcccccaatccctggcaatcgccattctattctctgcctctatgagtttgactattttaaatacctcatacaagtagaatcatgcagtaattgtccttctgtgattagcttacttcaaagatgaacattttaaaactacatgacttactttcagccaaactttgccatgtttagagagccgaggaacttctaatggaggaagaaaaagcagggcatgtttactcagggtggtggctgctgcttccctttcattttcctgctgagccagcaagggcctgaataaaactattaacagctcagctttagaagttctgctcagttttcacattggtaacaggtttatgcttctttattaatttcctgccttttaaataattagtgttggccttcagcagtcattgtacaattctgtgatagtaatttgttgcattaaaaaaaagctagtgaaaaactaaaatatgatatttactgagacatactgctgtgtttagctaattataagacaactctaagctgggtgcggtggctcacgcctgtaatcccagcactttgggaggccgaggcagggggatcacctgaggccaggagttcgagaccagcctggccaacatggcgaaaccccgtctctactaaaaatacaaaaaaaaaaattagccaggcatagtagtgaatgactgtaatcccagctacttgggaggctgaggcggaagaatcgcttgaacccagaaggcggaggttgtaatgaaccaagatggcaccattacactccagcctgggcgacagagcgagactccatctcaaaaaaaaaaaaaaaaaaaagacaactctagtcgggtgcagtggctcacgcctgtagtcccagcactttgggaggctgaggcgggtggatcacttgaggtcaggagttcaggaccagcctggccaagatggtgaaaccctgtctctactaaaaatacaaaaattagccaggcgtggtggcgcacgcctgtaatcccagctactcaggagcctgaggtaggagaattgcttgaacccaggaggtggaggttgcagtgaacgcgatcgcaccactgcaccactgcactccagcctgggctacagagcaagactccatctcaaaaaaaaaaaaaaaaaaaagacaactctaaaagagccatctgtgaccctgaggactgacacccacaactgacctcctgacacccacaactggccttcatctctgatactgagaccttgggttaggactattctgaaagggtttcggattagcaatggacaatcaataaatatttcatgcttttattaagctcctagagtcaaagagtgaaaaccataatggaaaaggtcaataaatcaactacatgaagaacttcttctgatcatcaagacaccaaaactgaaaagacaagccatattgagaaaagacatctgcaaacatctggccaaaactattaatatctaggaaaaaaataaagaacccttataaatcaataagggacaaatgacccatataaaaagtggccaaaagacatgaacaggcatttcaagaagaagccaataaacctgtgaaaagatgctcaatcagggcaatgtaaatgaaaaccacgatgggaaattctgggaacatcttcacatgctagatagtgaggtaactatcacagactacttgggtcatgtcaagaggactcagagccaacttccactagcaaaatgggacagtttgaactttaataagaccaagaattacaaagcattcaaaactatcaaatatgtttaaatctataaacccgtaatgatttttaatttatttattattttaagaaacagggtcttggccaggcgcagcggctcacacctgtaatcccagcactttgggaggccgaggcgggcggatcacgaggtcaggagatcgagatcatcctggctaacacggtgaaaccccgactctattaaaaatacaaaaaattagctgggcgtggtgacgcgtgcctgtagtcccagctactcgggaggctgaggcaggagaatggtgtgaacccgggaggcagagctagcagtgagccgagatcatgccactgcactccagcctgggcgacagtgcgagactccatctcaaaaaaaagaaaagaaaagaaaagaaacagggtctcgctctgtcacccaggctggagtggagtggtacgaacacagcgctcactgcagcctcaaactcctagactcaagtgatcctcctgtctcagcctcccaaagtgctgggattacaggtgtgagccattgtgcccagcctataattatatatatatatatatacacacacacacacatatatatccatctctatataaatatatatatatatttatttatttatattatttttttgagatggagtttcactcttgttgcccaggctggagtacaacggcgggatcttggctcactgcaacctccgcctcctgggttcaagcgattctcctgcctcagcttcccgagtagctggaactacaggcatgtgccaccacgcccaatttttttgtatttttagtagagacggggtttcaccatgttagctaggatggtctcgatctcctgacctcgtgatccgcccacttcagccccccaaagtgctgagattacaggcatgagccaccgcgtctggccctatttttttgagacaaaatctcactctgtcgcccaggctggagtgcagtgacgcgatcatggctcactgcaacctctaccgcccaggttcaggtgattctccagtctcagcctcctgagtagctgggactacaggcgcgtgccaccacacctggctaattttttatttttagtagagacggggtttcaccctgttggccaggctggtctcgaactcctgacctcaggtgatccacccgcctcggcctgccaaagtgctgggattacaggcgtgagccaccgtgcctggccattatttttaaagaaaaactaacaggtgatcttctgaggaaagggaatgaattcattattttgaaactggataaataagagaaaaaaatcaagtaattatcttgtttttcctatataaactataactgggtaactagtagataagagaaggggttctttatcaaaatatttcagctaatttgagaaaatgaaacaatagaagcaaaatatcaccattttcttttctttttttttttttttgagacagagtcttgttctgtcaaccaggctggagtgaggtggcatgatcttggctcactgcaacctctgccttgcagcttcaagcaattctcctgactgagtctcctgagtagctgggactacaggcacgtgccaccatgcgcggctgattttttttttttttttttttttgagatggagtctcactctgtcgcccaggctggagtgcagtggtaggatctcagctcactgcaagctccgcctcctgggttcacgccattctcctgcctcagcctcctgagtagctgggactacaggcgcctgccaccacgcctggctaatttttttgtatttttagtagagacagggtttcaccgtcttagccaggatggtctcaatctcctgaccatgtgtggctaatttttttgtatttttagtagagctggggtttcaccatgttggccaggcaggtttcgaactcctgatctcaagtgatctaccctcctcggcctcccaaagtgttgggattacaggtgtgagccactgcgcccggccaatatcaccatttctatcccccaaagattcaatgggtctaggcattgagcatctacagctgctaaaaccaataaaaacaaagcaaaaaccagacttatgtgcctacgtggatctagagcattgccaaaaggatcaaacaggatctggttcaagtagcccgtgcatccagctgccaatgtgcagggagtacagagaacacgttaaactatagcataaatgtgtaatcagcaaaacccaaaccgttggaaactctataggtgaaatgtgccagactgttttaacagataaactgtaaggaagtcaactccaaaagatggaaggggagcctgtagattaagagagacttaaaaaaaaaaaaaaaaaaaaaaaaaagttcgggcatggtggctcacacctgtaatctcagcactttgggaggccgaggcaggtggactgcctgaggtcaggagtttgagaccagcttgtccaatatggtgaaaccccatctctactaaaaatacaaaaattaggcgggggcggtggcgtgcgcctgcagtcccagctactcgcgaggctgaggcaggaaaattgcttgaacccagaaggcagaggttgcagtgagccaacatcacgccactgcactccagcctgggcgacagagtaacactccatctcgaaaaaaaaaaaaaaaatcaaaagttgtttaaggcaagtacattattggggcaactagggaaatttgaacatgggctatatattagataacatttgtgtaaataatgaaatgccaactttcctgagtacaataacggtattgtgatcatataaatgaatgtccacgttctttggaaatacatgctgaattagatacagatggaaaatgcaatgatatctacaattaattctcaaatggttcaggaaaataaaatatactcgtgtgtatgaacaccatgcataggtgaaaagatagattatgcaaatgcagcaaatgttagtgaatctaagtgaagggtatattcattgtactagtcctgcacctgatctgtagttttgaaattttctcaaaatgaaaattg

SEQ ID NO: 732 - DNA, 16698 bp, Homo sapiens
tccaatgtttacctataactaaaagaaagaaaagaaaaacataagtaactgtgccagaaaaaattttgcattatgaaaattcttcagatttaaatagagaaaccaggccaggcgcggtggcccatgcctgtaatcccagcactttgggaagccgaggcgggtggatcacctgaggtcagaagttcgagaccagcctgcccaacatggtgaaaccccgtctctactaaaaatacaaaaagattggctgggcatggtggcaagtgcctgtaatcccagctacgcaggaggctgaggcaggagaatcacttgaacctaggagacagaggctgcagtgagctgagatcatgccattgcactccagcctgggcgacaagaatgaaactccatctcaaaataaataaataaatagagaaaccatagaaaatatttacatcaccattatatgaccataagaaacatgagccagagaaaactgtaattattcccattttaaagacagttaaactaagaatcagaaaggtcgagtgtggtggctcatgcctgtaatcccagcactttaggaggccgaggcaggtggatcatctgtggtcaggagttcgagaccagcctggctaacatggtgaaatcccatctttactaaaaatacaaaaaattagccgggcatggtggcgggcgcctgtaatcccagctaatcgggaggctgaggcagtagaattgcttgaacccgggaggcagaggacgcagtgaaccaagactgagccactgcactccagcctgggcaacagagcaaaactctgtctcaaaaaaaaaaaaaaaaaaaagattttgtgttccatcaacattacatatacactacattcagatcctcaattggctgtgtatctgagtgtaattaaccaactagatggatgaataaataaaaaacaaatgcctaaatggcacagtacacatcacatctgaagattaaacaactacatttccatctatctgctggaaagcatgattacatcaccctcagtttgatgtgtaattttcctcgcatcacccccatcatacttttctggaataaaatacacatatagtcaaagacatgtcaaagacaaactgagtcttctccagattgcttttttcatattttttttttttttgagatggagtcttgctctgtcacccaagctggagtgcagtggcgtgatctcggctcactgtaacctctgcctcccaggttcaagcaattctgcctcagcctcccaagtagctgggattacaggtgcccgccaccacacccagctaattttttatatttttggtagagacagggtttcaccatgttggccaggctggtctcgaactcctgacctaaagtgatctgcttgcctcagcttcccaaagtgctgggattacagccgtgagccaccacgcctggctttttttcataatttgtaatgaatatactcagcaattagagatttttttttttttttgagacggagtttcactcttgttgcccaggctggagtacagtggcgtcctctcggttcaccgcaacctccatctcccgggttcaagcaattctcctgcctcagcctcctgagtagctgggattacaggcaggcgccaccacgcccggctaattttttgtatttttagtagagatgtggtttcaccatgttgggcaggctggtctcgaactcctgacctgaggtgattcacccgcctcagcctcccaaagtgctgggattacaggtatgagccaccgtgcccggcacaattggagatttctaaatattttagaggccagtgactattcacttgatcttttaatatacaaccaaaaattcttaaacatgtaaactactagcttattttttctatctcagtttattaatctgcttttgtcttccccaggaatttgatagatttattgcattgttaaaaactaaaaactggaaacaacctatgttggtaaggattaagtagatcatggtagtccatactaggaaatcattaagcaactagagaaggaatgcgtagctctattaagtactgacagggaaatacttacacaatatgttatgtaaaacaagttcattcattcatcagcatagattaatatagtactgtctatggcaaaaaaaaaaaatgaacctaagtctaattaagccttcggatccaactataagtttatgggaaatatagagaagaaagaaaccaagagataaacagaatgatactaaatggatacattcggccacagccagaacatgagaaattctttttttcccctcccagctcaatccttgtagaaaacaggaattctaaaggacaaataagccaggtttttcaacagataaatagcaagggacaatgagggagcggaaactattacagttctaagagacctatcagtcaaacacaacaggcagatcttgtttggatcctggttcaaacgaaccaactgtaaaaagttattcatgaaacaaccaggaaaatgtgtacattgaactggatattagatgatgttaaggaattagtgcaatttctttctttctttgagacggagtctctctctgttgcccaggctgggagtgtgcagtggcacgatcttggctcactgcaacctctacctcccgggttcaagcaattctcctgcctcagcctcctgagtagtttgaactacaggcatgagccaccatgcccggccttaatttcctttttttcttttttcttttttttttgagacagagtctcactctgtcacccaggctggagtgcagtggcgtgatctcggctcactgcaacctccgcctttcgggttcaagcgattcccctgcctcggcctcccgagtagctgggactacaggcgcacgccaccatgtctggctaatttttgtatttttagtagagacagggtttcaccatattggccaggctagtctcaaactcctaacctcatgatccgcccacctcagcttcccaaagtgctgggaccacaggcgtgagccaccacgcccagccccagcctaatttcttttttttttttttttccccaaatcaataggtcttttattgcatcatttaaatatcacaagtaggtcttaagtgtcatctggcatcttctttctgtagccaggtaactcttagatcttattcatcagcctgctgaacagttcctttttcagagacatagataccatccaaaaatttcctgatatccttgtttttaactgttgtggcttgctgaatcaaagccgctgaatttgaaacaagctcaatgtcatttccttcaaggattaattcatctttctgggcttgagatactgaacaagcaacacctggtctcatccgaaccctgcggatgtatttttcacccaaaaaatttcggatttcaacaagagacccattctcctggataacaacgttgatggggaagtgagcatacacagacctcatcttgtaacggaagcccagtgtaacacccttgatcatgttctgtacatgactacaaatagtccgaacggtagccagttcctttctgttaccccaccatttgtcaacccggagcctcttttttttctttccaagaaggctgagttctacattgatgtgattgaagtccctccgcagggttcctctggggcccttcacgataactgtgcgtcccttcagagtaatgtcgacattttctggaatgtcgacagtctgattgctgagaatagtcttcattctcgcagtagacgcagcaaagaaagcctaatttctttatgtatgataatataattacaattatatgccttcagtaagttttctgtgcagctactcagaagggtgaagtgggaggatcacctaaacccaggagttgaagtccagcctgggtaacacagcaagatcccatccccccagataaataacagtaaaaagaaagttttctgtgaacttgtaaaacaatatgtggaatatgatcccattttgtcaaaaaaccaaaaacatgcatgtatgcatgaatatattataaatgtataaataaatttatttaatttataaataaattttaaatataaataaatatatatatttgtttttgagacagggtatcactctgttgcccaggttggagtgcagtggagtgatcatggctcactgcaacctctttctcccaggctcaggagatcctcccacctcagcctccaagtaactgggactacaggtgttcgtcatcacactcagctaatttttttaattttttgtagagacagggtttcgccatattgcccaggctgttctcgaactgccagactcatataatccacctacctcagcctcccaaagtgctaggagtacaggtgtgagccactgcacccggcctatctatctatctatctatctatctatctatctatctatctatctatatttaaaagtctggaatgatataccaaactattaacaaaaattacctctggaaaaaagaataaaggggccagatgtggtggctcacacctgtaatcccagtactttgggaggctgaggcaggtggatcacctgaggtcaggagttcgagaccagcctgaccaatatgctaaaaccctgtctctactaaaaaatacaaaattagctgggcatggtggtgcatgcctgtaatcccagctacttgggaggctgaggcaggagaatgacttgaacccgggaggcctcagaggctgcagtgagcaagattgctccactgcactccagcctgggcaacaagagtgaaactctatctcaaaaaaaaaaaaaaaaaaaagaaagaaagaaaaagaaaagaataaaggataagacaagcttttttgttttgtttttgagacagagtttcactctttttgcccaggctagagtgcaatggcacgatctcggctcactgcaacctccgcctcctgggttcaagcgattctcctgcctcagcctcccaagtagctgggattacaggcaactaccaccatgcctggctttttttttttgtatttttagtagagacgggctttcaccatgttggccagggtggtctcgatctctcgacctcgtgatctgcccaccttggcctcccaaagtgctgggattacaggcgtgagccaccacacccggccaagacaagcttttaaaacagttagctaaaaacattttttacaaccaacacgaatcacttttataattaaaagctacacctcctccaataaagatctaaaaacaataaagaatgaagtcaaggttgtgtatttcagcaagctgaactctggtgcagagtatctttgaaaattgaaatggatatttacctaatttccctttattctatgtctttttcattgtccctgtacagaaatatatccattctggctgacagggatttaaaaaaagagagaaatataaccatattaaaagtcaagtctctagaggacatgtgtcactctgtggctgctcaccctccagtcatccttctaatggcacatcccatgcatatctggccccattcaccagagatactgattctggggtgccctttgccttttaccaagctccccgggtaatagtttgtatctgagaacatactgatgttgggttactgtatgaacagctatgctgtgaaagaggaactggatttgttttctgtgaccactaaggagacatatttttgcttagcagaggaaacagcttccaaaaactcagaattgtcccaggatggctgccccatagggtgagtttcccatcagtgctggtgtaaaagaaggaacatacagggtttcaggggagtctgcttgaggctgggggttgggccagataaccactctcaaattctcagtttatgtgactctttgggtctccaaaaatataaagaaagcttgaggaaaaaagacccttcaaactcagggttttcataaattttaagtaagggccatgatttacaataaatgtaacaccaattttcaaaaaattttctgattataaaatgcatactcattgcagaaaattttttaaatacagaaagttataaagaagaaaaaaatataaaaatcatcatgccactgaaagatacacactttctgtcgtatctcctggcttcatcccctctataaacatatcacactacctttttttcatttaacaataattgtgcacacgttcccatgcaattaaatactgtagaaacagaataataatattcttctttatagatataccataattaagccattttcctgtagttgaatatctaggttgcttccaaattcaattacagtcttctaattaccaggaaatcacaagtgctattatacaatttttcatatatacacaaacaatataactagtgttttgagcctctctgtaacagtcatgcattccagtgttcactgagtattagataaatacaagtgtacttactataataaagtgttgtttgaaaaaaacctaaggaataatgacacttttcaattgtttgaaatacatttgtagacaaatcccaactgtctggttctagcttgtctaaaaaacccaggtaacattagtggaacaaacacaaataagtaagtcacagcatttaagcccagaaactaaaagatggaataaaatattttcacatcaaattgaaactgttataattaattaaattaaattaattaaaaacaagtcatttcagctggcactacaatgctgaaaataatcacagaaatttcttgttttttacctgattaagatggcagagcatggagttttctacttagttccaggtgaattcttcacatttcctggcttttaaaacaaaagaaagagcttgaatgcagtttgaaaagaaatagtgcaactccttagtgtcctgagtatttggctgaacatgaacattaaaaattattatgggggacagggtcaaaccattttattgaggacttggggggttgttgaagaaaggctgaggaggacaatgagatcccacattctcgcagttaccgaccattaaatattattttactgcaaagtgatccatctgtcagtaaattgaagaagttactagggctctctgagggccctactgtagagtgacttgggcagagagagcaggaaataaagctccattaatcctcattatgcagattcagccaaacagttgattctaattaaaaaatcaatatatcttccttttatttcctgaaataaaggttttacacctatgggaaggcttcctgtaggtatttactccatgcattattcaccattatccaccataggggccaatccacaaaacatgtttactctgaaagaagttagaccacacccattctgcccagtggccctccgggaacatataattaggccatgtaatccataagaagcagtgtaggaaaagcttctagtgggaaaagttcacgtgctaaacttttaaggccttactttcttttctatacgttttttagactttaattctgaaaacacattaatagtcagagatcagatggcagtctgaaaaacaggaggctgcagctgggcgggccatgggggctaagattctgttgtatagacttggagcagtttctcctggtgcccctctttcagagttattcatggatgaaggaagaggaaaaggtgagaaagcaggagcacgtgactaaccctgtcatttcagagcatggtttctaggcaactttggggctccctggagtggctgagaactggtctataagtactgttttatacccgttgtcccaacataattaatagtgtcccctttcactctcaagagtatcctggtttgccgggcatgttggttcacgcctgtaatcccagcactttgggaggccgaggcgggaggatccattgagcctgggaattcaagaccagcttgggcaacatagaaaaagaagtttaaaaaaaaaaaaaaaaaaaaaaagagtatcctggttttgatgataaagtatatggtcaccacatccacttgatgatggagttctgggaaacaaggccatacgaactgcttggcggaccaatgatcaacatacaattctcaggtctacttgatgctctgaacaagagtgctacaggactgagaatctgtgcccttctcctcctccagagccactccccaccctgcctcctcacatgcatgcacacaagcgaacacacatacccatatgtgaacacacacccacctacaacccagaggcctttttgctgttgctcgaaattgacaaactccctactgggacaagacctttgcaaaatataccccactgaccgagaccagacaatcccaatttttgcctagctaaatgttattcatcctttacatcaaggctttctttgtaccctgtccttcaatttagcagaaccttctattccctttcatagcactcatgtacttcctgattgtgtaattatttctttcatgtttgagtctttcattaacctgtaagcttcatgagggcacaatatccctagggcctcctagcacacactattcaaatatttgttgcataaacaaatggaaagccaggggcagtggctcacacctgtaatcccagcacttcaggaggccgaggcgggtggatcacttgagcccaggagttcaagatcagcctgggcaacatgctgaaatcctgtctctaaaaaaaatacaaaaattagccaggtgggatgacacatgcctgtggtcccacctactcaggaggctgaggtgggaggatcacttaagccagggaggttgaggctgcagtaagctgtgactgcacaactgcactacagtttgggcaacagagtgagaccctgtctcaaaacaaacaaacaaatggaatggggtagaacttagagatctgatgaatgtaaaaaagcttgggtttctattttcttaacacatccatgaacacgaataacaatttctgttagcaaaattaaaacttaaaaaaaaatcaaaacattgatttctaattagtatgactgccatgtgaaggctgattgccagccaaacctttgaggtatagcagcctactgaaatgtctgggtccctcaccagactaatgaagaacaagaagagagaaaaaaaggcttataagggccagtgagataatcatgtccaacaatcgggtctggcataaaaacaaggtggttctcggcagggcgtggtggctcacgcctgtaatcccagcactttgggaggccaaggtgggtggatcacctgaggtcaggagttcgagaccagcctgaacaacagggagaaaccccgtctctactaaaaatacaaaattagcagggcatggtggcgcatgcctgtaatcccagctgctcgggaggctgaagcaggagaatcgcttgaacccaggaggcggaggttgcagtgagccaagatcacgccattgcactccagcctgggcaacaagagtgaaactccatctcaaaaacaaacaaaaacaaacaaacaaaaaaacaagttagttctctacttaaatacagtttaggtctgaattaacatactgcttgccaaatacttccaatgatattcttatatattctactatctatactcgccagtacctcaatctcaaaaaaataagatgctaaattcacaagcttttttatcttttggacaataagaaaatgagcacacaaaagcattcttctgattcaggaaaacaactttgttgctaggaaaattttcttgtttggttacatatcacttatagtataacaaaacagcacagtccaatatctcattaaaaaaatattgagcccatccaccaccctgtcacaaatcagatctctcttggcagagaactccaggatctcagacaaaacaacattctgacttcaaaaaacagttcgtgatttagcacaagccagaaatcatttttttttgcattttcagacagagaaagttttatctagaatattttgtaactcattttcatacatatctgatttcagtttttattttcttaccacgtccatgaacacaaatgacaatttctttttttttttttttttttttttgagacggagtttccctctgtcacccaggctggagtgcagtggcgcaatctcagctcacgtaacctctgcctcctgggttcaaacgattctcctgcctcagcctcctgagtagctgggattacaggcgcccactactacacccagctaattattgtatttttagtgaagacagggtttcaccatgttggccaggctggtctcaagctcccgaccacaggtgatttgcctgcctcggcctacaaagtgctgggattacaagcatgagccaccgtgcctgggcacaaatgacaatttctgctagcaaaaccaaaactttttaagaaaatcaagacactgatttctaattagtatgcctgccatgtgaaggctgattgccagccagccaaacctttgaggtacagcagcctactgaaatgtctgactccctcaccagttgaattattttcaacaattacttaacttctccaaaatgcagtttcctcacttataaatggggataataatagaacccacctcaaagactcttcctgagcaaagagtttagcgccaagggccaagctcacagcaagtaagtgctcaataaacattatctatcctatatggcaggccactttattttttggatgaagaaaataaaaggtaaggataaatgacctgttaaagaccccaacacaattctagttcacttgatgaggtaggcagaataatggcccctcaaagatgtcttctatttctggaacctgtgactgttacctcacacagcaaagggaaattaaggttgcattggaattaagtttactaatcagttgcccttaaaatagggagatgatcttggattatctgggtgggcttgattcaagcataagagtgcctgcagtctaagagggaggcagaagaagaggtcagaagggggatctgcaaacgacttgctgcaggcttcgacaatagaggaaggaagctggaaacagccctcagccagcaaaacagaccttggtcctacagcctcgaggaactgagttctgtcaacaatctaaatgagcaggaaagaaattcccccctagggcctctagaaaggaacgcaaccctgctgacaccttgatttagaattggacttctgacccacagaactaagataatcatttgcactactttcaacctgtaaatttgcagtcatttattttggcagcaatggaaaactaaaacaatgacataaggattcctgactacagggtatggttccattttctatcagtggacattatcttctcaggcagaagcgaaaatgtgcagtatcacatgagtggtggttgatgactatcatgtggctagagtccagccatttcatatgttcctcacatgagataaccttatttaatcctcaaaacagctccaggaggtactatgccagttcccacagagctggagtaacttcccaaggtttcagggctagtaagaggcagaggtggggtaggagtctggtgctcccgctcctcttagtccactggacaacgctgtatcctgcccactgataccaagagtgcattcctttctaaagaggagatgacattattcaggatttctaacttttcattttggtaaataatggtgtttttaaaaagaaagaaaaaatcatttcaaaatcatttcctaatacctgtagttcttagaattttagacagcaaaaaattacaaagcacaaactcataactttatggaaaacccatcaagctgtcatttaaaaaaaatacagtggtaagaatacttaacatgacatctgccctcttggcagatttttaagtgtacaatacggtactgttatctataggcacagtgttgtgcaaggggtctgtagaacttattctctttgcttgactaaaactttgttgattaccaactccctatctctccctcccccaatccctggcaatcgccattctattctctgcctctatgagtttgactattttaaatacctcatacaagtagaatcatgcagtaattgtccttctgtgattagcttacttcaaagatgaacattttaaaactacatgacttactttcagccaaactttgccatgtttagagagccgaggaacttctaatggaggaagaaaaagcagggcatgtttactcagggtggtggctgctgcttccctttcattttcctgctgagccagcaagggcctgaataaaactattaacagctcagctttagaagttctgctcagttttcacattggtaacaggtttatgcttctttattaatttcctgccttttaaataattagtgttggccttcagcagtcattgtacaattctgtgatagtaatttgttgcattaaaaaaaagctagtgaaaaactaaaatatgatatttactgagacatactgctgtgtttagctaattataagacaactctaagctgggtgcggtggctcacgcctgtaatcccagcactttgggaggccgaggcagggggatcacctgaggccaggagttcgagaccagcctggccaacatggcgaaaccccgtctctactaaaaatacaaaaaaaaaaattagccaggcatagtagtgaatgactgtaatcccagctacttgggaggctgaggcggaagaatcgcttgaacccagaaggcggaggttgtaatgaaccaagatggcaccattacactccagcctgggcgacagagcgagactccatctcaaaaaaaaaaaaaaaaaaaagacaactctagtcgggtgcagtggctcacgcctgtagtcccagcactttgggaggctgaggcgggtggatcacttgaggtcaggagttcaggaccagcctggccaagatggtgaaaccctgtctctactaaaaatacaaaaattagccaggcgtggtggcgcacgcctgtaatcccagctactcaggagcctgaggtaggagaattgcttgaacccaggaggtggaggttgcagtgaacgcgatcgcaccactgcaccactgcactccagcctgggctacagagcaagactccatctcaaaaaaaaaaaaaaaaaaaagacaactctaaaagagccatctgtgaccctgaggactgacacccacaactgacctcctgacacccacaactggccttcatctctgatactgagaccttgggttaggactattctgaaagggtttcggattagcaatggacaatcaataaatatttcatgcttttattaagctcctagagtcaaagagtgaaaaccataatggaaaaggtcaataaatcaactacatgaagaacttcttctgatcatcaagacaccaaaactgaaaagacaagccatattgagaaaagacatctgcaaacatctggccaaaactattaatatctaggaaaaaaataaagaacccttataaatcaataagggacaaatgacccatataaaaagtggccaaaagacatgaacaggcatttcaagaagaagccaataaacctgtgaaaagatgctcaatcagggcaatgtaaatgaaaaccacgatgggaaattctgggaacatcttcacatgctagatagtgaggtaactatcacagactacttgggtcatgtcaagaggactcagagccaacttccactagcaaaatgggacagtttgaactttaataagaccaagaattacaaagcattcaaaactatcaaatatgtttaaatctataaacccgtaatgatttttaatttatttattattttaagaaacagggtcttggccaggcgcagcggctcacacctgtaatcccagcactttgggaggccgaggcgggcggatcacgaggtcaggagatcgagatcatcctggctaacacggtgaaaccccgactctattaaaaatacaaaaaattagctgggcgtggtgacgcgtgcctgtagtcccagctactcgggaggctgaggcaggagaatggtgtgaacccgggaggcagagctagcagtgagccgagatcatgccactgcactccagcctgggcgacagtgcgagactccatctcaaaaaaaagaaaagaaaagaaaagaaacagggtctcgctctgtcacccaggctggagtggagtggtacgaacacagcgctcactgcagcctcaaactcctagactcaagtgatcctcctgtctcagcctcccaaagtgctgggattacaggtgtgagccattgtgcccagcctataattatatatatatatatatacacacacacacacatatatatccatctctatataaatatatatatatatttatttatttatattatttttttgagatggagtttcactcttgttgcccaggctggagtacaacggcgggatcttggctcactgcaacctccgcctcctgggttcaagcgattctcctgcctcagcttcccgagtagctggaactacaggcatgtgccaccacgcccaatttttttgtatttttagtagagacggggtttcaccatgttagctaggatggtctcgatctcctgacctcgtgatccgcccacttcagccccccaaagtgctgagattacaggcatgagccaccgcgtctggccctatttttttgagacaaaatctcactctgtcgcccaggctggagtgcagtgacgcgatcatggctcactgcaacctctaccgcccaggttcaggtgattctccagtctcagcctcctgagtagctgggactacaggcgcgtgccaccacacctggctaattttttatttttagtagagacggggtttcaccctgttggccaggctggtctcgaactcctgacctcaggtgatccacccgcctcggcctgccaaagtgctgggattacaggcgtgagccaccgtgcctggccattatttttaaagaaaaactaacaggtgatcttctgaggaaagggaatgaattcattattttgaaactggataaataagagaaaaaaatcaagtaattatcttgtttttcctatataaactataactgggtaactagtagataagagaaggggttctttatcaaaatatttcagctaatttgagaaaatgaaacaatagaagcaaaatatcaccattttcttttctttttttttttttttgagacagagtcttgttctgtcaaccaggctggagtgaggtggcatgatcttggctcactgcaacctctgccttgcagcttcaagcaattctcctgactgagtctcctgagtagctgggactacaggcacgtgccaccatgcgcggctgattttttttttttttttttttttgagatggagtctcactctgtcgcccaggctggagtgcagtggtaggatctcagctcactgcaagctccgcctcctgggttcacgccattctcctgcctcagcctcctgagtagctgggactacaggcgcctgccaccacgcctggctaatttttttgtatttttagtagagacagggtttcaccgtcttagccaggatggtctcaatctcctgaccatgtgtggctaatttttttgtatttttagtagagctggggtttcaccatgttggccaggcaggtttcgaactcctgatctcaagtgatctaccctcctcggcctcccaaagtgttgggattacaggtgtgagccactgcgcccggccaatatcaccatttctatcccccaaagattcaatgggtctaggcattgagcatctacagctgctaaaaccaataaaaacaaagcaaaaaccagacttatgtgcctacgtggatctagagcattgccaaaaggatcaaacaggatctggttcaagtagcccgtgcatccagctgccaatgtgcagggagtacagagaacacgttaaactatagcataaatgtgtaatcagcaaaacccaaaccgttggaaactctataggtgaaatgtgccagactgttttaacagataaactgtaaggaagtcaactccaaaagatggaaggggagcctgtagattaagagagacttaaaaaaaaaaaaaaaaaaaaaaaaaagttcgggcatggtggctcacacctgtaatctcagcactttgggaggccgaggcaggtggactgcctgaggtcaggagtttgagaccagcttgtccaatatggtgaaaccccatctctactaaaaatacaaaaattaggcgggggcggtggcgtgcgcctgcagtcccagctactcgcgaggctgaggcaggaaaattgcttgaacccagaaggcagaggttgcagtgagccaacatcacgccactgcactccagcctgggcgacagagtaacactccatctcgaaaaaaaaaaaaaaaatcaaaagttgtttaaggcaagtacattattggggcaactagggaaatttgaacatgggctatatattagataacatttgtgtaaataatgaaatgccaactttcctgagtacaataacggtattgtgatcatataaatgaatgtccacgttctttggaaatacatgctgaattagatacagatggaaaatgcaatgatatctacaattaattctcaaatggttcaggaaaataaaatatactcgtgtgtatgaacaccatgcataggtgaaaagatagattatgcaaatgcagcaaatgttagtgaatctaagtgaagggtatattcattgtactagtcctgcacctgatctgtagttttgaaattttctcaaaatgaaaattg

SEQ ID NO: 733 - DNA, 1217 bp, Homo sapiens
ctctatcagccacagatctcatggtggctgttgcatgataatgataggataaacaaaataccactgtcttcaagaaacattatcttaggtttgtttgtttggtttgagtttgatttggcttttatattttttaaaatcccttttgctaccccatctggttttataaactgagtttcttagcattcgttaaaattaaggggtttgtttggaataatatatattttttatgcttttgtctttcttacctgattgatattacattcacctttgattgttttttaaaagtttatttttacagaatatatttagtacctttcttaaggagtaactgaattgaatcaaccagtttgcatttaaataaaagaacaggctcagtggtcttcctgtagaatggtttacatgcctgcatgtgcagtagttgtgtctggaatcctagaattggcactttctgcctccttgctctaaatgtcacaaaaaattatacttccttaaagtaaatgtaatgatttcttcttttcctattgaccagtacagatagatatgttgtgtttgcttcatttttaatgatgacttcaagattgatgatgtgatccaataactgtggaggtagctttaacttggttctgtgtaaatagtatgtattttattataatatttctcattttaagatgcttggtttacattaaattatggtatttaactatttttatgtttatactaggtagggtctttcttatgtttctgtgtttttggtatgctaaataaagctatttttaaacccaagagattttttttctgccatgtgttaatcatattatggttaggtggtaaatacgctgcatatgttcttattaattatgttctttttaataaggtaaaatggttatgtttcttttttcttacggatttagggaatataggtcagtaaaaacaacagaaatcatctgatcaaaacctcagagtgttctcagcataagaaagaactttctatactacttttgaatgactttggcatgatacaaaatggaaacaattgctctaaaggaatagactgagctccctgcatagtgtagtttgtcaagtcctgggaatagtgttgtctatagacgccaaggagcctgttgtttcctgcttagcagaacagcttgcatttgaaaagaaagcacaagatgaaaacattgtgaccaaagggcatcttcctatgtgtagagctcaaa

SEQ ID NO: 734 - DNA, 687578 bp, Homo sapiens
  misc_feature (12664)..(12763): n is a, c, g, or t
  misc_feature (31773)..(32778): n is a, c, g, or t
  misc_feature (56221)..(56320): n is a, c, g, or t
  misc_feature (86122)..(136121): n is a, c, g, or t
  misc_feature (145293)..(145419): n is a, c, g, or t
  misc_feature (146936)..(147035): n is a, c, g, or t
  misc_feature (148716)..(148815): n is a, c, g, or t
  misc_feature (150516)..(150615): n is a, c, g, or t
  misc_feature (251273)..(251274): n is a, c, g, or t
  misc_feature (251288)..(251912): n is a, c, g, or t
  misc_feature (260826)..(260925): n is a, c, g, or t
  misc_feature (274962)..(275061): n is a, c, g, or t
  misc_feature (275597)..(275597): n is a, c, g, or t
  misc_feature (281352)..(281451): n is a, c, g, or t
  misc_feature (298664)..(298763): n is a, c, g, or t
  misc_feature (304942)..(354941): n is a, c, g, or t
  misc_feature (355893)..(355992): n is a, c, g, or t
  misc_feature (356976)..(357075): n is a, c, g, or t
  misc_feature (358228)..(358327): n is a, c, g, or t
  misc_feature (359748)..(359847): n is a, c, g, or t
  misc_feature (360794)..(360893): n is a, c, g, or t
  misc_feature (362393)..(362492): n is a, c, g, or t
  misc_feature (363898)..(363997): n is a, c, g, or t
  misc_feature (365776)..(365875): n is a, c, g, or t
  misc_feature (367989)..(368088): n is a, c, g, or t
  misc_feature (369701)..(369800): n is a, c, g, or t
  misc_feature (372033)..(372132): n is a, c, g, or t
  misc_feature (376157)..(376256): n is a, c, g, or t
  misc_feature (383108)..(383207): n is a, c, g, or t
  misc_feature (391127)..(391226): n is a, c, g, or t
  misc_feature (404351)..(404450): n is a, c, g, or t
  misc_feature (417010)..(417109): n is a, c, g, or t
  misc_feature (429522)..(429621): n is a, c, g, or t
  misc_feature (442967)..(443066): n is a, c, g, or t
  misc_feature (474456)..(524455): n is a, c, g, or t
  misc_feature (524516)..(524615): n is a, c, g, or t
  misc_feature (525965)..(526064): n is a, c, g, or t
  misc_feature (527800)..(527899): n is a, c, g, or t
  misc_feature (529611)..(529611): n is a, c, g, or t
  misc_feature (529960)..(530059): n is a, c, g, or t
  misc_feature (533550)..(533649): n is a, c, g, or t
  misc_feature (535102)..(535201): n is a, c, g, or t
  misc_feature (538525)..(538525): n is a, c, g, or t
  misc_feature (538538)..(538538): n is a, c, g, or t
  misc_feature (538618)..(538717): n is a, c, g, or t
  misc_feature (539114)..(539213): n is a, c, g, or t
  misc_feature (543095)..(543194): n is a, c, g, or t
  misc_feature (545114)..(545213): n is a, c, g, or t
  misc_feature (576465)..(576564): n is a, c, g, or t
  misc_feature (601651)..(601750): n is a, c, g, or t
  misc_feature (626564)..(626663): n is a, c, g, or t
  misc_feature (636320)..(686319): n is a, c, g, or t
aggaaaaactttctttcaaaaaaaaaaaagttgtaaattaaaaacccttcccattccgcttttattgatttcccccaaaaaactctgttgtatgagctgaaccagaggcaaacactgtttgccagaagactcacagatccccgtattaataaggcctttatccaatggagtcctccttctatgaaatgttgaggcatttgcttcctgttcataaatttctttttccttccgtgcttctttttttgtatcctgtaattgataaacagaaattgtttacaagtgatctcattaccaggtgtgaaggcacacaggctggctgagccctgaccccagtgccaagctatcccagcctctgtggctgccacacccatccacccacaggcccccacctgccctgttggaaaccccaactcatttgtgcagtttcaaacagtgtcttctttttacagatccaaggtctaggctgcctctgctgatgctctccagcctccttctgtgaagtccctaaaatccttaaccctgctaatggctcacacaaaacccaatgtgatcggctccacacacgcagcatccagctgctctgtaaggacaagaaggagctagaattctcacacacaaaagtcctggttcaaatgcaaatggcaaagccactttgggaaactatgaacacacactaaccccaggacctaacaaattccactccaagtgtttatccaaagggagaacatatgttcactgaagtacttgttcacagcacaattgtggcagctctacacggccaaaaaccagaaagcctgggcgcggtggctcacgcttgtaatcccaacactttgggaggccaaggtggggggatcactggagcccaggagttgaagaccagccttgcaacacagtgaaaccttgtctctacaaaaaaatcaaaaaactagccggacatggtgacatgtatgtggtccctgcaacacaggaggctgaggtgggaggatcatttgagcctaggagtacaaggctgcagtgagccaacatcaggtcactgtatacagcctgggtgacagagcaagaccctgtctcaaaaaaaaaaaaaaaaaaaaaaaaagaaaacaaaaaccaaaaacaattacatgtccttcaataggaaaatgaactaacaaacagtactacacctataaaatggaaaacttcccaataataaaaacgaagtcgcaatacacacaacagtgagcgaatctgaaaatcattctccaaggcaaagcaggaaagagtgcatactatacagttatattgctgcgacactcagagcaggaaaaatgaatctaatctcagggcaggggagtatcctggctgcaagtgccaaggagcacagggatctttccgggtgacgggaatggtctacatgaggaacaggttacctgttaacttcactgaaacagacaacatgcagtattttatcacaattaaatcatctcagtaatttttaaaattagcacaaaaaagaattttaatttaaaaaaatacttggatataagtttagtgttttactgttttcagttattcttcacatgtgtgagtgtggtatttccgatctcagcccaccaccaggtcacgtgtgcctccaaggccatacctggatctctgcagtaatggctgcgtgtaaggctgactccaaccctccagcagccatcaagctgcccaccagaagatcaatcaccaatcgatgacctggacttatgctcacttcattgcctgaaactgaaatagaaagtgtgtgccaatttgagtgaaacgccatcccctcccagcaccctgacccatggcctctcctgttccttccccgagcccacctccgcagggcaggagagcagagtgcccgggcctgcttctcagcggtgggcaacagcatggaccagccgctctgcagcatggcctgggaggccgactgctcggtgctcagcacgtctgcgctgcttgccagggtcaccaccgtctgcttcaggctgttcaggaagacgtccacacctattaaggggggggctggtactaaacacagtgacagctcaggtgacatgccctgcacagagcccagtacaaaggaagggccaacaaagcaagccactattttcgttgttcttttctggtattgatttaaaagtgcatgtttcaagcttggttctgtgctgacaaggaagtcggcgcgcactgatctgagtcttctccacaaacaagtggcctcccacacctgtctcatctgactcgctgctgttaccaccaaacacacagacaccagagaaaaacactgccatgcacaagcacgctggtcttgcgtaaaaaataactagactcgagtgccacctaaacacaaagttccatcatgacactcacgtgcatgtcgccctcggagtggggtgcatccttcctgcaaatgatgctctggaacctttgcagcaagggcaaaagcggggcgctggtgccctgggcggaacgctcattgtcagtctcctgtgccccgctgtcccacagctgaagcaacaacaggatggcagacaacatttggctaaagaagaaaacatatttattcctagtaaaaacagattaacttttttttttttcatggttgatcaaaaataaaagcaaacagctagatagaagtgaagaaatacttgggatatgaaaggaaacgaaagtaaagccgtggtagttaaatcactgaattgacactgagattttagcacaagacatcgccttctgctgataggaaagaccagttaagaagctcaaagagcacatttacatgaagatctagggtcttaaattcatggaataaaaataattaaatgaggaaaactgaaagaaaaaaaaagaagaacagttcccaggctagaaaactgagcataaaacaggaagtgaagaaaaggaaaagagagagccctgggacatggttctctgtagagcaccacacctgctgcagtcacacgattcagtgaaacgcacacaatgcaacaggtatttggatacagaggcgcttccccaaagcattcccggtctgcaccagccctcacctcagcatgcctctctgcacagccagctccagcaggatggccagggccaagtgctggtcctgtagggggatgattctggccctttagtgcctggtattccgtgaacatccctgaaatgaaaacagtggatgcaggaacgaagcgacctccagaaagacagcatgcttacaatcacagtaacacatttgctacatgctccctcccaaggaaggatgtatctttaatatttagaatcaagcttctgagacttgctactcaaatttattcacagatttttaaagtatacaattaatttacagaaatgtattttatttaaagtattcattcagatactatattacagtagatgacatactccaagtgtgtgaagcataaaataatttatctcattatccaaaacatgagtaggagaatatctagctatcttttccagtttcaatgacgtgtaagactataccagtatcaaccttctcccacagaattagagaaccaatttctaaaaccacttgaggatctggaggcaaaatgtctacactaatttctatctctgatcaaagattacctggttgcttactccatacccagctctccagaattgacttggccccatatacaggtgcaggagtttcatcttttttctctctgtcatccagatcttctttctttgttccacttggttcaacactatcatctgcagaattaaaatttttttaatctgtaaccgcttttcagaatgccataccatctgtcagtctctgcaaatgtccctccccgaaaagttacaacacacatcattaactgaacgtttgacaacttaaaaataaaatacatcaatcgtacctgtaacagatccagtataattttcataaagcaatatatcggccgggagtggtggcttacgcctgtaatcccaagcactctaagaggccgaggtgggtggatcacgaggtcagaagatggagaccatcttggctaacatggtaaaaccccgtctctactaaaaatacaaaaattcaccaggtatgatggtggacgtctatagttccagctactcaggaggctgaggcaggacaatggcatgaacccaggaggcagagcttgcagtgagccaagatggcaccactgcactccagcctgggcaacagagcaagactccatctgaaaaaaaaaaaagaaaagaaaagaaaacaaaccaatatatcaaattatttaaagcatgtcttccaaaatgatatttcattagcttcctagtagatttcacaacagagaaacttagtctttgatatttacctacttcagtttcacaccaattgcttttatccagtgagtcccaatgcatgtgcacccatgggaaaagggagggtgtagaacaggagtatgattcaaaaatcttttaactctttacaaggccctactccactgccaactgggaagcagtgctatgcaggggcactgtgactgatagcataattcaagagcactgggacacaaaggaaaagctgagaaaaatgactttaggccactgacaatgtcaagtttcagtcaaaaacaactgtcataaaactccttacacagtaagcgaagagaagagagaaccttaaccttgaagtgtaaacacactccatcacagaaggctgtgactaaatgtctaaacaacataattagaaaaatgtatctcaatcggtgaaagacatgatatcccatccagattacaaataatgagtatctaaaaatctctaaggaaacagttcctctgtttacaacacttctgacatcaaacgtatggacttttgcaccaagcagttctccagttctttgtgacacccagctatgtgtcccacaatgcaattcgattctgaaactaactacctagaattagcacagaccccacaggttaataacaggagagaaaaggtgaatgctgaaaaaaatatccaaagaactaatggctgaaaacttcctaggttcagcaaatgacataaacccaggcagattaaagaatctgtgcaaagcccacacaagataaatccaaaagaagccatgacaaggcacatcataatcaactgctaaacactaaggacaaaacccttcaaaaagtgccacagagtgtagatatataagaatgtcttgtgtggcctgaaatgaagactaaatattatgtgctgccttgacgtcggtaaaatcaagaaggcctcaaatagcctaaccacaaggtctcctccaagctctgctcccacagatcaggtcccaaagccaaacagcctccttatggcggagagctgactccagtctgctcatccctgccggcccagagttattcaaacaagccaatcacatcttcccatggaagcaaggtcatctcaccctcctgttactacaaattttgccttccacagcccctcgtggttcactctgttcccaagtgcagcccccgtgtggcatgcggtgtcccccaccccagggctgtgagcatgcatgactaataaactgctatttcatctgtccagtgtcggtgtcctacgttcagccatcccatatccctagggcaggaatcttctagggttataaacagaactttaatcaacctctccttggttattttactggttccatgatacagctttttctgtgcaaaagatctgaacagaaacttcacagaggatacaagagtggcaaagaagaacacgatactcagcattcttagccattacggaagtgcaaattaaaaccacaatgagatcccactagacttgttagaatggctcaactaaaaaacactgataacaccaagtgctaacaaagacacagagcaacagaaacgtgacagattgccagtgggaatgcaaactaaaacagccacttcggaaaacagttcagcacatgacccaactttcacactactaggtctttatcctagggaaatggaaactatattcacacaaaatctgtacagaaatgctcacagcaggattacaattgggaaagaaaaatggaaacaaccacaaggtcctacaatagcagaatggataaacaccatgtggtacatccaaatgatgaaataccattcagcaataaaaagaactattaatacacagaacaacaacaaatctcaaacatataactaggaataaatgaagatggtttcaaaacgttacttaaaatatggttccactcacatgacattctcaaaaagaataccctatactgatggagaacagatcagtggttgccagggtatgagaccagggaacaggtgataaaaaggagcagcacaagggagcttttggggtgatgacacgtctccgtcctgatgatgatgagggttacatgaatctatagagatcaaaatttactcaactagataccacaataaaataaatttcatataagttttttaataaaaaaaaatgttggctgggtgctgtggctcacacctgtaatcccagcactttgggaggccgaggcgaacagatcgcaaggtcaggatttcgagaccagcctggccaacaaggtgaaaccccgtctctactaaaaatgcaaaaattagccaggtttggtggcacgtgcctgtaatcccagctacttgggagcctgaggcaggagaatcgcttaaacctggaaggcggaggttgaagtgagccgagattacgccactgcactccagcctggaccgccaagtgaaacgtcatcacaaaaaaaccaaaaacaaaaacacaaaaaaacaaagaaaatatctaggtccaggttagggaagacagctggaatacagtctggtggaatcatgtcagagcagggagctgggtctggagggctggagtagggtgtggccccactctaggaaggaactaggaaacacatcctgggtaaagcaacagcagagtctcgttctgcaacaggtgagcatttatcctgatctgagaaactacatgcaaatttagtatgtctcacttagcctcttattttccttaacaacatggaaaatgagagaacaaacaattcagaaggttaagacatgaaacacattgaattcagaaatcatacacagaaaggtaggaaataaatgggggataaaagcagctaatgaaaagtgaaaatgggccaagtgcagtggctcacacctgcaatcccagcacgctgggaggccgaggcgggcggatcacttgaggtcaggagtttcagaccaacttggccagcatggtgaaactccaactctactaaaaatacaaaaattggcccggcgtggtggcaggcacctgtaatcccaacagctcgagaggctgaggcaggagaattgcttgaaccagggaggcagaggttgcagtgagccaagatcatgccactgtactccagcctgggcaacagagcaagaccctgtctcagaaaataaaacaaaatattcatagccttaataatagaaaataaaaacatttactgaatgccagaaaatctccctaaaaaccccaatcagttgggatctacataaagaacaattatgctctgctttctaaccacgatttttaaaagaacaaaggacaaatatattcatcaaatatgggccgggcggggaggctcaagcctgtaatcccaacactttgggacgctgtggcgggcggatcgtgaggtcaggagttcaagaccagcctggccaatatgatgaaactccatctctaccaaaaatacaaaaattagctgggcatggtgaagggtgcttgtaatcctagctactcaggaggctaaggcagagaactgcttgaactagggaggcagagaactgcttgaaccagggaggcggaggttgcagtgagccaagatcatgccactgcactccagcctgagcgacagagcaagacaccctctcgagaggaaaaagaagcaaacaacaaattcatcaaaggtaataaataaaacatatactttggatttttccatgtacttagcttttcttagagcatcttttagaattattgtttcacaaaaaacacttcgggaaacgttttaatttattaacaaatactggagggctagaaagaagaggttaaaactttttaaaatatacagaatgaatcacagatacgtgaaagaaaaaagaaaaaaaggttgctgactcctgccatggaaggcactatcatatggacactcttagcctcagcatccggaggtccagaaagcgaaaatttcaagtcagagagaattctatatataccatttatttggaaccttcagcccttaagatcccaacatcatgacttcagtttcaacacaattatccttagaccttgtactggctacaaacacaaaacaaatagctcgactgaactaactcacctctccagaaacacaaacacaagacctcataaagtcagtgagtttctacaggccataattactgcaacttacttctccaattttcccctccacagttaactcaacagctcaaaaacgatcagtaacaaacaacagtcaccatgatatggttaggagtgtggcagatttcttaaccagtaataataaataggaaaaaaattttgcctactaatagatctcaagtttcgtgcacttacaagaaactaattaaaaggcagccgcgcacgatctacaaaaacagccataaagactgttacattttaagttacaggaaataaacctgctcctctaattcagcaagatacaactgacttccccttacataccctaaaaaaaagctttacacgagaaatttaaacatggaagcagaaacacaccaagaaaaagacatgtcaaaccccacctgtatatctgttttcaaccatttggagtcgaggcgagcccgggcagccaaacacaaagattcagagggcatcttttctccagcttcctcccaggtctcaggcctgcaagtaaacacatacgttgaagacctaacgctttttaatagtttacaaagacactcccgaaaggttcaatgcagaaaggaaaaaagagagagagaacagaaaggggggagagaagagctggtggaggggagagaaggggagagagggaaacagggaagagatggagggagagggaggtggggaagggaaagcctccttccaaggtaggcagggtgtgccgagtttctgcaccacgctgacgagaccttgagaatggacggtcacaggaagccaagtcacaatgtcatccccctgccctcaaatccaagaagtacacacataacagggagcccatcgttttaacgacaaatgacagcagcatgaatctgccgctttaccccacagcagggcgcgtgcgtgaaacaaattactcaaaaggatcgcctgcagaaaaacccacagccaccaccacttaagagatggagagaggcccgaggctgccccgcgggtggtccgcgcaggccccggtgcggccgcgcccacgcccgcctcccgggctcggccgcccgccagccccacgcccgtaccgcccccgccaccggccgcccaggtgccccaggccaggacctgacgcgcagggccgggccgcctcgccccgccggcgtgcggacgcagcctcccaagagccgctggctcagccggcgcccgcgatcccggcgcctctcgcggcccgaggggcgggccgacgcgggactgccgccccccgcgtacggccaatcgcaacgaggctgctccgtgggcgcagccaatggggaagaggagcccttcgccgctcctcccgactctcccgcttccagcaatcccgcttatcttcctacttggagcgccctggctgcggccaaggccaacagcgggcgccggaaggcgggatttccgccgcacgcacgcactcccgcactcccacgggagactgcttggcccggagcgctcttgatcacgccgcggcgggtggtggcgctcacactaactatagctatccagggcgcgggtcgagtggcgagaccagctcccctgggtatgagaacgcatctttgtgcggtcggctggctggggcctgaagagcttcctcctgtgtgttcaactgaacgcagcaaaagtcttgggcagattccatggagcagctgtggaagcactgtgcagggaatcgaagaaggaaacacctccagcgaccacaaaacaaaattgaagaactataaaacaatataggccgggcatggtggctcacgtatgtaattctcagcgctttgggaggccgaagcgggaggatccctcgaagccaggagttggaggatcccatgttgccagactgggcaacatagcaagaccccatctctaaaaaataaaaataaaaaaatttaacaattagccaggtgtggtggcacacacctgtgatcccagctgctcgggaggctgagacaggagaatcgcctgagcctgggagatcaatgctacagtgagctgagatcgtgccactgcactccagcctgggcgacagagtgagatcctgcctctaagaaagaaaaataacggccgggcgtggtggctcacgcctgtaatcccagcactttgggaggccagagcaggtggatcatttgaggtcaggagttcaaaaccagcctggccaacatgatgagaccccttctctactgaaaatacaaagattagccaggtgtggtggcacgtgactgtaatcccagctactcgggaggccgaggcaggagaatcgcttgaacccgggaggcggaggttgcagtgagccgacattgcaccactgcactccagcctgggggtcagaggctgcaccactgcagccttgacttaccgggttcaggtggttctccacctcagccttgccactagctgggactgcaggcacatggaaccacacctggctaatttttgtagtttttgtagacgggattttgccatgttgcccaggctggtctcgaactcctgggctcaagtgatccgcccgcctcagtctcccaaaatgctgggattacaggtgtgagtcactgcactcggctaatagtaatgaactttgaacagaaggaaagttgttattattttcttggttatgttctatttatattttctaatttttctaaacatgtaaagataaaattctaaaaactcagtaagacctcagaacaaaaaaattagagtataaatatttattttagttaacttgtacaaatttggtttctggaaaaagaatggaatagattttctgagaaaaaaaatccaccactttggccgggcgcagtggtttacgcgtgtaatgcctgcactttgggaggctgaggcggtggatcacctgaggtgaggagttcaagaccagcctgaccgacatgaagaaacccctgtctctactaaaaatacaaaaattagtcaggcctggtggcacgcacctgtaatcccagctactcaggaggctgaggctggagaatcgcttgaacccaggaggcagaggttgcagtgagctgagatcgcaccatagcgctccagcctgggtgacaaaaggaaaactctgtctcagaaagaaagaaagaaaagcagactggctgaaaggattgaagaacaaaatatgatccaccaatgtgctatctacaagataaacattttaaatacagaaacagattgaaagtaaagggatacaaagatacaattaaaatagtaaccaaaaaagagctgaaggggctgtactaatatcaaatgtaatacactttaaattaaagcagggctgggcatggtagctcaggcctgcaatcccagcactttgggaggtggaggcagagagatacttgagcccagaagttcgagatcagcctgagcaacatggcataatccaatctctacaaaaaatacaaaaattaggcgggcatggtggtacccacctgtggtcccagctatttgggaggctgaggtgggaggatcatgtgagctggggaagttgaggccacagtgagctaagatcgggcccctgcactccaccctgggcaacagagcgagaccctgtctgaaaataaaaaaaaataaaaaacggggttgagagacaaaaaaggacatccttttttttattattatattttgagatggagtttcgctcgttgcccaggctggagtgcaatcgtgtgatcttggctcactgcaacctccgcctcccaggttcaagtgattgtcgtgcctcaggctcccgagtacctggcattacatgtgcctgccatcacgcccagctaatttttgtattttggtacagacagggtttcaccatgttggccagggtggtctccaactactgacctcaggtgatccacctgccttggcctcccaaaatgctgggactacagacatgagccaccgtgccagccgaaaccttcattttaaaaaaggctgggtcaggcatcatgcctcatgcctgtaatcccagcactttgagagggcaacgcaggcggatcacctgacgtcaggagttcgagaccagaccaacatggtgaaaccccgtctctaccaaaaatataaaaattaggcgggtgtggtggcacacacctgtaatcccagctactcaggaggctgaggcaggacgattgcttgaatctgggaggtggaggttgcagtgagccaagattgtgctaccacactgcaaccagggtgacagagtgaaacgccttctcaaaaaatgaataaaggctgggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgaaaataccgcatacaatatcctcttgagtagaatcataatttagaactctaaaaatgaccggaaacaaaactgtccaagtttgtttaacgtaatgtgtttcaacttatttgactagaaaacccttcattcgtgcaacacttataaatatcccatggcaaatctagttttctatgaataatgaacgaaacatttataatttaaaactaaaattgtcttctaagcagagatctacgtatcaataaaatgaagaaataaaatttccatactgttttcttcccaatacaaggattagaaggaaagggaaaagagtaacagcgagaatcaatagcccatgtctggccaggctccatggctcaatcacacctgtaatcccagcaatttcagaagctgaggcgggaggatcactggcctttagtgatccttgaatgaaactccatctctaaaaaattaaaaatattagcttagagaatcatttgggcccaggagtttgaggctgtattgaactatgactatgctactgcattgcagcctgggcaacaggctgcttaaacctggaggggcagagcttgcagtgagccgagatcgcgccactgcactccagcctgggcaaaggagccagactccgtggcaaaaaaaaaaaaaaaaaaaagagattctattcacaatagcaacaaaaccctgagaatatatctagcaaagtatacacaggcctttcatgaagagtattgccatagcctgaatgtgtctcccaaaattcatgtattaaaacttaattcccaagatgatagtactaagaagtggggcctttaagaagtgattaagacataagggtgagccctcatgcatgagattagtgccttccttataaaagggcttgtgggtggtggtaaatctgtcccttctgcctcatgagaacatagcatttgcctgctccagaggaagcagcattcaacgtaccatcttggaagcagagaccaggccctcactagacactgtgtctgctggagtcttgatcttgttcttcccaacctccagaactgagaaaataaacttctgctctgtgtaaattacccagtctcaggtgttttgttatggcactatgaagggactaagacaaatataaaaattacccagggacttaaaggaagaactgactaaactgaaatatatgccatatatattatgaatcgtaggactcaatgctataaacatactacttctcaacaaattaatctataaattcaagaaattcctacacaaatcccaatagaatttttttgtggaactcgagaggctgatcctaaaattcatacagtcacttgaggggccaagaatagtgtaacagggctggcggggctggtggctcacacctgtagtcccagtactttgggaagtcaagactggaggatggtttgaacccaggagttcaagaccagcctaggcaacatagcaagatgttgtctcaaaatattaaaaataaataaataaataaataaaaagaaggttaagtatgcacattttgttgtgaatttcaattttatagtgattttttttttttttttgagacagggtcttgctctgtcacccaggctggagtgcagtggtgccatcttggttcactgcaacctctgcgtgggctcaagcaatcctcccgcctcactctctggagtagctgggaccacagttatgtgccaccacacctgactaatttttatatattttttttgtagagacggggtttttccatgttgcccaggttgttctcaaactcatccacctgccttggcctccgcaagtgagatcacagacatgggccactgcgcccggtctagtgcgcttttttttttttttttttaaccaaacaaacgatgaagtctcaggagtaaaagttgatacacaagtaaattttattggtaatgtttttgtgtggtctttaagcagagggaaaattagtctgcattatggtgtatccagactaaataactgatattaaaatgaaattatccttaggatttgcaatcttagagaaaactttttcattttttttgagttacaaattatcttcacttacatttgagaacagtgagtcacagagggattaagtatcttactcaagatcttgcaagtgtttggtttgaacccaatcttttcactctgcagaactcagagtcactcttatttggaaactttttaactgatgtggatcctctaatatgggcttcctattattcattccgtattagtcagaagttttgcaagcaggcagaattcattttgccaattacgggattttccctcagttgcagtcaaggttcataaaactataactatttatctttaattataaattttgtttttgagacaaagtcttgctctgttgctcagactgggatccagtggcacagtaacagcccattgcagctttgaactcctgggctcaagggatcctccgcctcagcctcccaagtatctgggactacaagtgcatgccatcatccctggctaattttgttaaaaaaaaaaaattgtagagatagggtcttgcttcgttgcccaggctggtctcaaactcctggcctcaagcaagtcttcagccttggtctcccaaagtgctgagattacaggtgtcagccattgcacctggccaaaactgtaactatatatacacacacacataactacatatatatgtgtgtgtgtatgtatgtgtgtgtgtatatatatttttatataaaaatagatatatctgaaaggcatcaaaagaaaaaagctgtaacttttagtcttgatcttgatagtgacttgattaggctatctgtttaacatcaaagatgcaaattaatgctttctttgggtgagcatattaaaaatgcagaaaatattggagtagttttttatgttaaataaattgtattctgtgtatttaaggtatacaacatgattttgtgggatgcatatagatggttaaaaaaattactacagtgaagcaaattaacgtatccttcaactcagatagttacccgttttctttttgtttggtggcaagaggagcttaaaatctcatttagcgtgaatcccaatacagcacaattttattacctatatttctcgcgttgtacattatatttctaggcttgttcatcctacatatctgctactgtgtaacctctgagctatgtccacccattttctctcttgccccccaagtaatttcctaaagtgtctcatataaaaaggcagtagctttcagcttaaactttttctctgtatatatttaagtcaatttctttgaggtatgtttttctctccagaatagttagatgtaggcataccactttaatgttgacactagttcacctagaacttatcttctgcaaatctgtctctatgtccatctctgtctccatctttgtctctatctttatctctgtctatctatctatccatccatccatccatccatctatctatctatccatctatctgtctatctaactaaagcaaattcatgcccttctcctatttatggaatcgagaccataaacagaggtgagggaaagaatttggcaggaattgcgatgtgtattacctgtggcataaggaaactttacagaactagggtcaaaagtatactttctagttctttcccatggcttttcactttgatgtagtccttatcaggcaactgaggttttatataagtcccctgattcttagaacatgaaggtgtagtattcaagtttggtcccttgaaaccacaatttttgttaaaaaaaattaagaaaattgtatgatttcctcagcaaatacatattgatcatctgttatacagccatgagaagtggttctgttgaacacgtttattttatcagatcccaattctaaaccaggcatagaatggaaaccatgaaggtaggatgaaataacttctgaatgtttgaaaatagtgtacttaaaaataaatatcaggtgtttttgttttgttttttgttttttgtttttgagacagggtctcactctgtcacccaggctggagtgtggtggtgccatctcacctcattgcagccttgacctcccaggctcgggtgatctcccacctcagcctcccaagtagctgggactacaggcacatgccaccatgcccagctaattttttgtattttttgtagagacagggtttcaccatgttgcccaggctggtctagaactcctgggcttaagcgatcttcccacctcagcctcccaaagtgccaggattacaggcatgagccaccatgcctggctgaaaataccaggtttttaagtatcagcactgcctcttcaatcttttctattactatgttgtgctcagtggtattttttattgaattagagcagtgctgttcaatggaaccttctttgaggatggaaatattttatgtctctgctgtgtgggtatggtattagctgggtatggggcacctgcctatagtcccagctactcaagaggctgaggtgggaggatcacttgagcccaggaggccgagtctgcaggttcgtaccactgcaattcagcctgtgtgacagaatgagactcagtctcagaataaaatgaaataaggaaataaaaatgtaattgttgaaataagaaactagtggatggattagacacgagaagaaagaattaattgtttagacgattctctccaaaaagtaagtcagcatgtcacacagagagacatgaggatagatgatagggcagaagttggtgggcttggaggggagaggaagatcagaatgaggtccaaaatgtgtcttagtgaaatcccaggaggagatattaaaattatattagaaagtgaaagaaatagaagttttatttatttatttatttatttattttgagaaggagtctcgctctgtagcccaggctcgagtgcagtggcacgatctgagctcactgcaagctccgcctcctgggttcacgccattctcctgcctcagcgtcccaagtagctgggactacaggcacccaccaccacgcctggctagttttttgtatttttagtagagatgtggtttcacctttttagtcaggatggtctcaatctcctgacctcatgatccaccagcctcaggctcctaaagtgctggaattatacgcataagccactgcacccggcccaaaagctttgtgtttttacaaatattacacatgtttcttgtttaagaaaaaaagtcttcacaataacgtaggagaataagagaaacatttttccaaaaaagagaagtcattgtgattattttatcttattggaatgttggataatatagtctgcttcagtaatcatcaagcatgctatggattttccattttcataggatctgtatctcggttaaggtaatactggtaatttttgtactctatgaaaaatataggccagaatcatagaccttgcatagaagctggatcatgaagacagctctggaggaacacacaggtacacacacacagacacacatatatataaagtatacacatatatattttttaaaagcttttaaagcaaaagccggccctgcccctctcccagagttggcggcctctcccctctcttagggtgggtggggacagtggttgcatgggcagctttccttgtgagccaaagatccctctggacacatgatgcctggccacgccccctttccctttcatctttctcattaaccaatgggcttggagcattaaggccacgcccctattctgccttctactgcatccctggttacgcctcctctggctcagtcgcacagctacctggtaggtgactggaggtgttgatcagtgcttggtgggattttgctgatgtggccccaagcccgcctccctccccaccctgcgatggcagaagaaactcgacaaagtaaattggcagcagccaagagaaaggtaaaaacacaccaggtcacggacccccaacccagccatagatcctctccaacgacaagactgctgccagagtccataccactcccgaggttcaccggactgggacccccacaccggtgcctctgggctacccccaccaaagttttgccagtcagccccaccccttcagcaagcagcccagtctctgccctcaccaatcaccccagggtgactttgggcaggtgaatcctggggctccccgctcctttactgggccctcatctcctgccaccccaagcttgacctcccagggctttttgggctcacatctccaaggacctgggtcccacagccccagaccccaccctcaccagtcatccctggctgactttaggctggtgaatcctggggctccctgctgctgactcttcccttccctcctgctgcctcaaggtggacctccctaggctgtgtgcactggcgtctccaaggacctgggtcccagctctgtttttccctcccctatcatggagcggtgactcggacatcatgctgatgtggtccctccccctcaccaggaagagtggaatgtagtgatgtcacggtccatccagtaactgtcattactgcgagactggcctttgatcttatgacccagtcccctaagcattgccaccccatttctggttcctcttgtcacagcacaaatttccagctggaaggggaatggagattgggacctaggagcaagaggtttcaggctgcctcactcccttaacataaacattgacagcgggaaaagcctacacttcccctgtgagctcaaaacattgacagtacctctggatggcaactggagaatgggtttgacttggtttggttttctcccaggcttctactttccagagagattttaacaaattttttgtgagttctccacctcacattctaattctccatggttctgggaccagactgcccttcagtcagtggtctgtgaagtgagatttgctcatcttctgtggaatagatcttgggaaactgaacttgacagcttgaatcttcctcatattatgtaaacctggggtactttgagtgccacaggatacatatgggacatctttctgaagcatcagtttccattgattctcttgagatcaagagaaaaaacattaatgtacttagggatgacagtcacataggtttctaacagtataccagacttctctctgaaatgaggcttgggttgtcctctttctgataaattcccagatttaacagaaaggctgccttctgccatgaggacacattgatataaaagtttgagaggtacaggtgcacttcttcacactaacagacgtgtgaggatgtatgactaaaccacatggcatacagttcctgcctacttaatgtttacttttctagctctgcctctggttttggtccctggcagctgatgattcttggtaaaaccccagagtttggagtcagaagactgagtttcaaagttcgtctgtcgcctttttcttttcttctttttttttctagccatgatatcaatctctttgagtcactaaatgattgtgacaacaccttgtacagttgttggtatcattaaatcagatggtgtataagagtattttataaaaactgtaaaggaggatgtggctgcaggggctgatagttctcatgagtattactgctcttgtttctgacagttaaaagaatattggcagagaaacagccctggtgttccagcaggagccaagaggaacaggaaaacaaatggcagcatccatgagacagccacttctggtggttgccactcacctggagatgtgagtcttggctgactaggttcctggggacaggggacccaaggggcactagagggtaattgttaagatgtggatggactgttgggtacctgtgaagaattctgggtttgaatcctgcctctttgtctgctagggatatgaattagggcaagttgctagacctcatcaggcctctcttttcacatctgtataatagaggtggtattgtttcacttccatttgtgaagtttaaatgagatttgttattgttgtttttatgttaatccctagtacatggcctgctgtaaacacccagaacacccaggatatggtcattgctgttcgattttcctcatccccagtctcaaggggaagccaggacaatgagaacagtcacttggcacaggagtcactgaaagggccgcagggtgctgtggtggggagataagaaccatgagagaagttggcacaaaggagttatgggacaaagggtccaagataggcagaaaagaaaattgtgccagttgatggggaagaaaagaagtcagagggcttagatactgagtgggacagaacatcttcatgtgcactctcatctcttgtagtcagcaacaggtatccacggggagagccctacatcatctgctaccctgaaggatctggaggtaagaggctctgggcagaggtgcagtgaccctgcagggcagccctccaacctcctcctccaggtgggacggggtgcccctctgccagctgagacagtccacacacaccccagccctaatgattgctctctctacctctccccccactcctcctccacctcctcctctctgcatgcgcctcagagcccgtgccaagaactagcagtagtcccagactcgaggtccgtaaaagtcagtcaactgaagaacaccatcaaatctttggtaagagtccactggggtcccctgattccacgctgccaatcctgggctctagtttccccttggggccctgaagaaaggggacggcggcccctggtgccaagggcgaatagggagctggggcgcccaggcctcacctggagggaccccggagcatgcagcatggctctttttttgctgccctgtttgctgactctcccctctccagacgcccctgctcgagtccttgctacacacgccctgggattgttgcctcttggggaagtgctagcctgactggttgtcaggggccctgtatttctgccatgactcagtccctaatttgctctttgattctggacaagccacctctcctttttgggctcatgtttccagaggaagtagtgagtatcaaaggtctctgttagctctcgagtctgagatttaaaggcctcctagaatggaaacctcagggccaaaggctcctgtctgtccttttccgccctaaatcttctgtgaagaaccgtacttggcccgtacgtgctcagtaaatgtttattgaatgaatgcacttttctaaatcacaagctggcagaagggggggcctttctcaaactccatctctagaggtttatattgctgtcctctcaagagattccagattcagaccttgagttctgtggctgtgggcaaaagccaacaaagacccaaatcctctgtccttgggagcttgaggagagtttaccagttcgagttcccactgggtctgagaactttgcctttaaaatccattcctggtccctgcctaccacttcctgctctggggaatagagttgagggggccaccctccatcaccttaatgtgactctccccacagaaacaacagaagaaacaagtggaacatcagctggaagaagtaacatgatttctttgtttgctcgcgacatgactgctcggtttgggggacactcagatgtagaggccccgagtctcgtctcacccactcccagcctggggaagaaggctcaccccccagagtccaccccatcccccacagggtctctgataacccggtcccatgggtgggcctgtcccggggcaggggcagtggtggcattctggggacatgtctcttgcagtaccatctctgcctctgcctggttagatctctgtcttcctcttcctacaggaaaagaaagcaaacaacgagaaacagaaagccgaaagggagctagaggtgagtggacggtgtgcagtttcctcctgtcctccggagaatgtttctttccttctctttcagcacttgcttggcttttctcccaaaggttcaaatccagagattgaacatacagaaagggaaactaaatacggacctgtaccacacgaaacgttctctcagatactttgaaggtgggaatctgggtaccctgtcatccttcaacctggaactttgacaggtcttcagggggagtcctttgggccccatctcaactctctcattacagaagagtccaaggatctggccgtccgtctgcaacattcattgcagcgtaaaggagagttagagcgggctctctctgctgtcaccgccacacagaagaagaaggcggagagggtgagtccaaccacctgccccgtcccctgggagcctggcttcgcagacagaggagtgagcctaaaggtcccttctgcaggatggagtgtcctgcccagaaggcagcatggccatttctcactgcttttttgtatggttgttagcggcagcttgggactgagtcagctgctgtgggtgagttggggggcactctggggagagagcacaggacgtagagcttggaggccaagtgcctgccatgcctttacctggctgtggtcttggccaagtcctcagtgggtattgggtacttgtactgtgaaggtacagaagagtacctttagtatgttaccatttctgtagagagaggaaacgtgtgtgtgtgtgtacatattatgataatatacataaaatatgtttgcaagtgttcataaaaactcaggagagagcaacagggtggctgggagatacttcccttctgtaccttctgagtctgggactatgtgaatgtattatcctttcaaaaagtgaacaaaagattaattttccccttcctagctgtgcccccacccccagcaagaaaaatgggcttagagaattggatagatctgggtgtttaaatcccagctctgcctaagtgatcttaggcaagcacttaacctcaaatactccatgttttttcatctacacaatagaggtcatcatagtaactgtctcccatggtggttgcgaggattaaatgggattgctagcatggtatctggtgaagcactccataaaagttcaaacagtggtaataataacagtaataacaatagcaatattatctgatctctctgggcctctgttagccagctataaattcgatctctttccctgtcccttccaactttactgagttctttaaaaaccaaaccacgggcttggaaatgccttgatctttactgaccgagttgtatattgggcctagccctggcccttttaaggggcactgtgtggaatggcccggcctccccagattgaaacttctcactcttcagcagttctccagccgcagtaaagcacgtatggagtggaagttagagcagtccatgcgggagcaggcactgctgaaagcgcagctgacacaggtgaggtgttcagagggagggatgtggaaggaagatgaccccaggtaaccaggagcaggtgaggaccagtgacagcccttcctaatttctgtgcccattcttgcagttgaaggagtcacttaaagaagtccagctagagagggatgaatatgctgaacatctaaaaggagagagggcccggtggcagcagaggatgagaaaaatgtcgcaggaggtgagatctgacccttcagcccccccacattagataggtcactggatctttctgggcacctgtaaaatgggaatagtacagccagaggtggtcatgggtctgggctttgtggaggtgggggcagagagagagatggtagcatgtccagcctccagcccctctctccagggccctttccccctgtgctttgggcaggtttgctcgttgaagaaggagaagaagcatgataaatatcgggtagagaagctggagaggagcttgtccaaactcaaaaaccagatgggtaagatggggctggcgtgacctggcagcaggactggcatcagagggctgtgagggtggcttggagtgccccagcgaggtgggtggatggaagggctttgaggcagagggaaagaggtctgtgccaggagacggcaagtcttgtcatctcaatgagcctcagtgtccccatcagcaaagagggcccgttgtcagccacccgcagtgctctttctctgaaagtgctttggaagactggctacccatctgggtgcgaggaatcattagcagtgaggctaagtttgaggagccggagaggagctgtgcgccaagaggagggttttttcttttcttttcttttcttttttttttggaatccagaggctcttattatctgcttcctttctcagctgaacctctgcccccggagcccccagcagtgccctctgaggtggagctgcagcacctgaggaaggaactagagagagtggcaggagcgctccaggcccaggtggagtacaatcagcgcataagtctcctgaatgaggggcaaaaggagaggcttcgggagcaggaggagaggcttcaggagcagcaggagaggcttccagagcaggaggagaggcttcagcagctggccgagccacagaacagcttcaaggagctggtgcgttgccccagctggggagcctgccctcctccctagccctccaggcctttgtttccccacctataaaatggggcagtgtagccctcaagtgaaatgttactcctaaaggcacctgtgagccagagccctgctctggtggctgtgggagacaggggatgatttttctaacctgcctccacccttcccggtgccatgggaggcagtcaccaagttctggggtctccagctgcagtgggtggctgctgattgcttctctctgtccagaacaatgagaacaagagcgtactacagttggagcagcaagtaaaggagctgcaggagaagctaggcaaggtgaaggagacggtaacctccaccccatccaagaaggtctgggaggtgggcaccagcctctggggaggggaggtgccaggccagaggcagctccagcccaggggcaggtgaccccagcaccctccagggcagtcctgtggctgtttcttgcttcctgccctctgattttagaggtgggtagccctgggctcctcccaggtctggacatcatcattccagctagagacatggagcacccccaatcacaggggaagagacagagtggtataacagtcttcttatgccagacgcggtggcttacgcctatagtgccaacactttgggaggctgaggcaggagaatcacttgaggtttggagtttgagatcagcctggccaacatggtaaaacctcatctctactaaaattacaaaaacaaaaaacaaaaaaagaaagaaaaattagtggggcatggtggtggcgcatgcctgtaatcccacctactcaggaggctgaggcacgagaattgcttgagcccaggaggtggaggttgcagtgagctgagattgcaccactgcactccggcctgggccacagagtgacactctgtctcaaaacaaaacaaaaagactccttagattaaaactggattccagcctcagttccactggtcaccattcaagtacttcacatctctaagtctctgtttctttaacttcaaaaggaagttagcattttccttacagaggtgctgaggattaaatgagataatacatgggaagcattaggcctgtagcacatttagcagatggtggttggctcccactacttttctaccattctgtggcctacagttgaaatggtgggaagaggacatgagatttgaggctggggaaggaggcatggggttctaggaaagggaggcagtcacttaggcctggagtaaggggccaggggcctgggcaggcgacagagccccacagtgccctcgctaccctattaatgggcccagaatctgcaaaccagccaccacgtcccctcacacccagggtcttcctgcaggtggagctgaagagccaagaggctcagagtctgcagcagcagccagaccattacctgggtcacctgcagcagtacgtggccacctatcagcagcaggtggccacctatcagcagctgacctgtgagaaggaggcgctgtacaggcagtgactgcagcagacccagctaatgaaccagctgcagcagcaggaagcttggggcaaagcggtggccgagatggcctgccaaaagttgcaggaggcccaggggagggagctgccgaggatggggccgtgagggggacgagctggcaaactctgtgccttctcactctttcctggccccttaggagcgtctggaagctgccagccagcagaaacagcagctaacggcccagttgagcctcatggctctccctggggaaggtacgggagaccgctcagaggaagaggagagagccccaggaggaaggggggactgctagcagcataggattgaggagttggaagagacctttagaacagctggtcattatactaaccgggtgcctgcactaagttcagcatcaatatggtgacctcctgggagcggggggccaccaagttgcctaaggatggctgaactggccgaggtcagaaagggagcaggtcagaactcccacatcgaccagtagtgggaatatgcctgggcagtatagcaagatcttggttcttcaaagtaaaaataaataacagcagctcattcctctctggggagggcctggctcagggttacacaatgagggtggaggcagaggtgggcccacaatacttcccttgttgagttgtctgaagacccctctggccaccccccacaggacacggaggagaacatctggacagtgagggggaggaggcacctcggcccatgccgagtgtcccagaggacctggagagcagggaggccatggtgagcctgactccccctgcacccattttgccacctttctctgtggtccctccaagacccctttatgctcttcgtttccctgccttctgatttctctggaccctcaccccttccgagagccagtggtcagacaccatttcacctgtgaccaacatgtgcagtctctggggccccaagggaaggggctgcgctccacctctctgccccatttcttctgtgtatgcccctagaagaatgctcacatcttgccctcaggtggcatttttcaagtccgctggagctagtgcccaggagaagcaggcacagttacaagagcaggtgaaagagcagagggtgtgctgccagcgcctggctcacccggtggcctcggcccagaaggagccagaggcagcggtcccagccccagggcctgggggcgagtctgtgagtggggagacccaccgggccctgcaggaagtcatggagaagctggcccatgccggaactcacctccgccttctccatgacttgaaaatgccacctgagggcaggtcgctggcgagatgtgaccccattattttggctccagagcggctttatggaccacctggaggagaaggcagacctgagtgagctggtggagaaagaagaacttggattcttccagtactacagagagggatgccatcagtgagtgggaggccagggcatggcagggggagctgcagggctgttggaggggccccagcgtctgagccctgtcctcccgcaggaaagtttatcaccctataacaaagccagggggcagtgccaaagatgcagcaccgggaggaggacaccatcaggctggccctggacagggaggagatgaaggtagagtgtgcaacatctctgcgggggtgggggtggctgtgacggtgagcgctggcagcagcgtgacagctgagcacccctccctccaggtgaagctgctggagctgcaggagatggtgttgcagctggtggcgactacaagggacacagcaaattcttggtgactgcccagaaccctgctcatgagcccagtccaggagccccagccccccaggagcttggggctgcccacaagcatggtggtgagtagagccctcaggcggggtgggcaggcaggagcaggggggctctcactgagctcagatccccgcctccctctctccaaagatctttgtgaggtgagcctcactgacagcgtggagcctgtgcaagtagaggccagggagggttctccccacgacaaccctactgcacagccgatcgtgcaggaccaccaggagcacccaggcttgggcagcaactgctgtgtgccattcttttgctgggcttggctgccaagaagaaggagataaacatcaccatcgtcaaagagctgctcaagaaatttttaaaaaagaaacaaagttatggggttaatctcctacacaattcatttacttcgtttgaatgttatagccacttatgattatttgtgtttctaatttatagtttaagtttatttgtaaatagttaaaagagagtgggtctctgtggctttcactgatgttcactctggcatactttcgcaattttctttttcaatttcatgattgtaggtcattagcgtgcatattgagtttgcccttacgtggtggggttcaaacacacaaagacccactatttgcacaaaactattcttgctggtttggaataggctgccatgtgtttttaatgttattgcagcatgtatattcattacagaattcagataaaatttgcctatgttctgctattgtttgatctaatcttaatcacagtgagctcttcattagcacaatatgtggtttgccccaagtgtgcactatttaatactttgtaatatgccaccaagagtactgacatttagagttgtttaaaggccgagaactggaaacagcctttccctcattttctgtgtattggtgatgggagtaataacattttgggggagctttttaaatttcacagaagaggaaagttgcctgctctggcaggtatgtgcaagatagagtgtgtttcatttgttctgttgccaagaattagtgctgtactattgtagttcctttaggatttgtatgtgctctgggctcatgaagatattgcatcatgagctgcagcagttgtactcttttttgatgacctaaaaagggcttatttctgaggaatgaaaggttcccatcattgactatggatgtggaaaacctttcctagcttagagcatttgtatctatattttaaagtcagagttcatgttacctgttttaatcacatgactgcatgtcccagtacacaaaagggcactggttggcattcttcttaatgtatttagtaaagatcagaagaaatcctttaagagtttaaatgtccctggaacacgcatacaggctctagtcaagaatgaattagagtgaaggaaagctgtgtgacacctggcattcctctgttcatggagcttctttgaggcttgaagattgattttaccatctagaccactctgcctattcttcaaccaccttggttactttgacataggaattgacttcttttccttgaatggaaaacactttgaaataataataaacattgttataaactaatatatgtgagagtgcttagttgaaacaaaaaggagttttagtagacagtattatactatctttgaaaatcaaggagaagtttatgcaacttaaaatgtgtacaaactgcagtgcaatctactgttggtgaatgtcagtgtattatcaggaaacatgtctatacaatcacagagttatatttcctcacaaacttctttgtgaagagtgaaatgtgtttctgtacctctgggtttcacttacgggcatattttgtgcagtatttatgtgattgtgcctatgcatgatgaatgaatgaatttcagttgtacattgcctaaatcataacttgatgatgcttgggaaagactcaacagttaaaacttcatgaagttctaatgtctgtgttccaaaacacatcacattattaggatgtagggagatatgtatgtgtgctccctggggtggggatttctagttactagaccatctccatttttagcagttggcatcctcatgatacttttataaatacgacattaacaggagagcagcagtacgattttgccgatggaataacagatttgccggcaatcactgaaagagtgcaaatatcgggtccttgtgacttcaacggactcttccaaattgtatgaatgtatcaatgtattagataaacccagtttcagaatgataaagaaaaaatgttagaccaaataatgcggctagttaacagtggtacgatttctagcccgtgggtttaaaatgcacttaaagtcctgtccttgccttttattttctgaacttgatgtttttgcattctttgagttcagtttaaagacaactacgagcatctgcaaccaatctgacaataatgtgttcatcaggtgcctatggattaaatcacatactggcatatttaagctgaatgtcaatctggaaaataaattgactatattaacagaaataccactctttgtgtagatatttgtcgtatatttaagaaaaagctaaaaagaatggaaatcgcatgactataacttaagtctttcttcaaagtgcatgcagtcttttgcgatacctcattcagccaagtattggtattcttcctcattcggtataaggcagctttcaatttgcttagaaggcaacattggaaggttagagttcatcagaaacagaattctaaaatgtgagttcaattcaataaatttgaatttctgtaggaagaatcaaatcaccgatttaaagagtgcaatatataataatcatttttaaagtattggattaaatctgataggttttccagaaatgaacaaaaatcagctctaaaaccaaagctgatttttagaaaatttgaaaatgtaaatcagccctatccatactatagtttctctaaaactttatctgaaagagtcattttaaaataactattaaacaatgtaactgctatcttaatgttctgaaataagttaaaacattttaaaatatgaatactgtaaaggaaataaatggtgggaaggaaaagtagagaaagaaatgccaattccagtccaaagctttatttgccaagttttcttggaatgaattttaccaatttatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattcttcatgaaaggcctgtgtatactttgctagatatattctcagggttttgttgctattgtgaatagaatctcttttttttttttttttttttgccacggagtctggctcctttgcccaggctggagtgcagtggcgcgatctcggctcactgcaagctctgcccctccaggtttaagcagcctgttgcccaggctgcaatgcagtagcatagtcatagttcaatacagcctcaaactcctgggcccaaatgattctctaagctaatatttttaattttttagagatggagtttcattcaaggatcactaaaggccagtgatcctcccgcctcagcttctgaaattgctgggattacaggtgtgattgagccatggagcctggccagacatgggctattgattctcgctgttactcttttccctttccttctaatccttgtattgggaagaaaacagtatggaaattttatttcttcattttattgatacgtagatctctgcttagaagacaattttagttttaaattataaatgtttcgttcattattcatagaaaactagatttgccatgggatatttataagtgttgcacgaatgaagggttttctagtcaaataagttgaaacacattacgttaaacaaacttggacagttttgtttccggtcatttttagagttctaaattatgattctactcaagaggatattgtatgcggtattttcaaaccaactcatcctgcgtcaggttgtggttacgctttgggagaggaagctataatcttatactgagactgtaatgaatgtattaaggtaattttcgtagctttctctttttggagttacctgagaaattatgacacccttttccaaacaggccaacctgctttgcaaacacgatttccataattttaacaatggtgaggccaggcacggtggctcatacctgtaattccttccagcactttgggaagcctaggcaggaggatcacttaagccaggagttcaataccagcctgggcaacatggcaaaaactcatctctacaaaaaatacacatattagccaggcgtggtggcacacacctatagtctcagctactcagaggttgaggtgggaaaattgcttcagctcaggagctcgaggctgcagtgaacggtgatcacgccactgcactccagcctgggtgacagagcaagaccctgtctcaaaaacaaacaaaacaaaacacaaaccaagggtgagagagatgttagatgtttttgtccttgttacagatgtaaatgctcagttggaaagagggaactatttagagtgaaaaagtttcggtggaacacacacaaaaataggaagatcaggtataactgttccaaaaaaaagagtatggcagtatagaagaaaaggtctccatgaaaatgcagaagaacaatttcacagctggtgctggcatttcagagaccttgagctgggaatcaaaagatgggaatttcagtctcggatgtgccactccttagaggtttaatatctactaaacccggcgggctccacttggtggtgtttgctatttaaaaaaacaaaaacatgtggcaatgatcttccacgtgattctgacttgagccccacgcgagtctgcagacttacccttccactgctttgcccttcaagtttgtgcccattagcaaagagaaattttctctttgggatcactgctgtgttgatctcaggaatatttggcgttgaatttaacatatttttcatatgtgtgtgcaatagggaggctgagaaagttgtcttttttttaaggtgttcatttttggggtacaggtagcagcctgctctacaatccacacagaagctggaaatagcctctagagaatttccacgtttagagaagataaatttatacatttgtatctaatcaacattttttagctaacatagtagtctaattatactatgtataattatactatgtataattatgggtactgaaatgacacctggcatatgctgtatgctgtgttatatatacatatatatttacacatatacatatatattacacatatacatatatatttacacatatatatttacacatatacatatatatttacacatatatatttacacatatacatatatttacatattttacatttacattttacatttattttacattttacatttacatttgacattctacatttattttacatttacatattttacatttacaaatatttacatattttacatttatatatacatatatttacatacatatatttacgtacatatttttacatacatatttacatgtgtatatatttacatacattcacatacatatttacatatatatttacatacatacatatttacataatatttacatacacatattacatacatatatgtacacatatacatatatttacacatatacatatactatgtataattatgggtactgaaatgacacctggcatatgctgtatttaaaaatgtgaggttcagtgagaacacatggacacaggaagggaaacaacacatactggggcctgtcagggcgggtgggggaggagcatcaggaaaaatagctaatgcgtgctgggcttaacactgaggtgatgagttgataggtggaccaaaccaccatggcacacgtttccctacgtaacactcctgcacatgtaccctagaacttaaaacaaaattttaaaaataataaaaaataaaaatgtgaaattcagcacataaactgttggttttattattcatattttcttaattcagaaattattttctgaactatggtttattagataattttgacgtaacaattttttaagaggaaatttaagttttactttttaattggggctcttggttctttttaagaaagacagagataaatcatttatacatttaattagaagagactgggcttgaatttttaaaaagtactagaaatcgtagccactatatatgttatctttgaaatgttttagacaataattacctaaacaaggagcaaataagttaaacctcttggattttaataagaactaaaatgtacagttgtattttctggttttttaaattgttacagtctaaatttattcttcctaatgaagaaatgtatgtgccgtcaatatcaggttctttgtgggtactcacagttccctttgccttttacgcagtgaatgtgggcaacatgcgtggaacagaaatgatgtcgttttctttcttttgaatatcactatgaatctaataattcaaagattcctaactttctgaatgccattattaattggattcacaatgacttaccaggtacagagttgtcccgtgtgtcttggggtgaactactgagagtggtatgagggaagcgattctcagctagcgctgagtggggccacttccaaagaggtgatggggtaagaagcacacacaatgtggcattttcactgcaaagggaggtttgtgctgcctctcctcctgtggcaggtctgctcgcaggggaggctccaaagtttggctttgctgggtttggcatgtgagaactgatgaaatatctgtatgtagtatctttcaaggatttatatcagttggatttctgtgtaaatttgcatatccctttgactgctttaccccatagaagctttgtatgcttaacaaaatctgtaacttttctgtcactttctcatttagcatctgcctttctggctttttactttatctttttattattgtttttagtttaatgagattatggttagagagaaagatgggtgcatgattccgcttctttggaatttgttgagattttccttatggctcagtacatatgtacttgggggggtgaatgctgtcactttggagagatatgttttttctgtacattaagtcaagcttgttaattttctagagagatgtaaatcttctatgtctatgctgattgttttttgtctcttttatcagacactgagatatgtatttaaattgccctctgagggttgcaattttgtcatattttgctttcatgtattttgagtgctagttattagatacattaacattttagattaccttctcccttggtttattagaatttttatcattatattgtggccttaaaaaatctcccatattgctttttgcccaaagcctattttatctgataataatatagcttccaacccttctttgggttaggtacatatgacaggtgtatcttttttcaatctctctcagtctttctgtgactttatgttttagatgtcttttcatactgtttattttctgttttttgtgtttttttgtgtgttttttttttttgatacggagtcttgctctgttgcccaggctggagtgtaatggtgtgatctcggcactgcaacctctgcctcctggattcaagcgattctcctgcctcagcctcctgagtaactgggattacagatgttcaccaccacgccggctaatttttgtattagcagagatggggtttcaccatgttggtcaggctgctctcgaactcctgaccttgtgatccctccgcctgcctcatcctcccaaagtgctgggattacaggcatgagccaccacgcgtgccctaattctgttttatagtcattttctcttaattattcagtctatttacatttattgtgattgttggcatagtttcttttataactttcatcgtattttgtgctatttgttccatctgtttttatttcttcatgtcttttttgtttcgtttttgctaattccttttatattcatggttattctgctcttgaaatgtatgctatgtgaatatatttgtgagttgacaatactttattagcaattaaatatactatttctctttttttttagaacttgctcaaatgttacataacctcaatatccttagtatctaaattaaactgactttctgaacaatcatcattttaaggcagttaccacgatctactaaaaaataaaaaaaaattagccgggagtggtggtgggcgcctgtaatcccagctactcaggaggctgaggcaggagaatcccttgaccctgggaggcagaggctgcagtgagccgagatagcgccactgcactccagcctgggcgacagagagactccgtctcaaaaaaataataataataataataataaaggaatttaaaaaaagactgggtttaaccatgttgcccaggccggtctggaactcctaggctcaagcaatcccccacgcttggccagtccaaagtcctggaatcaaaagcgtgaaccaccacgccaggccgatcacgcctgtcatcccagcacttggggaggcggaggtgggtggatcaccggaggtcaggaatttgagaccagcctggccaacatgatgaaaacccgtctctactaaaaatacaaaaaaaaaaattagccgggtgtggcggcaggcgcctgtaatcccagctactcaggaggctgaggcaggagaaccaccaaaacccgggatgcagaatttgccgcgagcggagacccagccactgcactccagcctgggcaacaagaaggaaactccgcctcaaaaaaaaaaaaaataataataataagagacagattttcaccatgttgcccaggcaggtctggaactcttaggctcaagcaattccccacgctcggttgtccaaagtcctgggatcgaaagcgtgagccaccacgccaggctgatctatttctttctgattaataaattgggccgggagcggtggctcacgcctgcagtcccagcaccccgggaggccgtggcgggcggatcacctgaggtcgggagtttgagaccagcctgaccaacatggagagacctgtctctaccagaaaaaaaaaaaaaaaaaaaaaagagccgggcatggtggctcccgcctgcaatcccagtcactcggaggctgaggcaggagaaccacccaaacccagaggcagaggccgcggggagccgacaccgcaccactgcactccagccctgcaacaagagggaaactacgcctcaaaaaaaaaaaaagagagagagagagagaccggttttcaccatgttgcccaggctggtctagaactcctaggatcaagggatccgccacgctcggccggtccaaactcctgggatcaaaagcgtgagccaccacgccaggccgatccttcctgtcatcccagcactttgggaggccgaggtgggtttacctgaggtccggagttcgagaccagcctggccaacatgatgaaaacccatctctactaaaaatacaaaaaaaaaaaaaaaaaaattagatgggtgtgctagcgggtgcctgtaatctcagctactcaggcggctgaggcaggagaatcgcttgaacctgggaggcagaggttgcagtgagccgagacagcgcaccactgcactccagcctgggtgacaaagtgagactccgtctcaaaagtatatatatataaaaataaaaaatgaaataaaaataaattgggtgtgtgcgctggctcacgcctgcaattccagcatccccggaggccgaggtgggcggataacctgaggtctggagtttgagatcagcttgcccagcatggagaaaccccgtctctaccaaaaacaaataaaaaaaaattagcagagcaatgttggtcaggcctgcaatcccagccactccggagactgaggcaggagaactactaaaaccctggaggcagaagtcgctgcgagcggagacccagccactgcactccaccctgggcaacaagagcgaaactccgcctcaaaaaaaaaaagagagagagagagagagagagagagaccgggtttcaccatgttgcccaggcaggtctggaactcctaggctcaagggataccccgcgctgggccatccgaagtactgggatcacaagcgtgagccaccacaccaggacgatctattcctttctgattaataagttgggccgggagcggtggctcaagcctgcaatcctagcacctcgggaggcctaggcaggtggatcacctgaggtcgggagtttgagaccagcctgaccaacagggagaaaccccatctgtaccaaaataaaaataaaaaaaaaatacaaaattagccgggcttggtggcttatgcctgcaatcccagccactctggaggctgatgcaggacaacgaccgaaacccgggaggcggaagtcgcggcaagcagagacccagccactgcattccagcctgggcaacaagagcgaaactccgtctcaaaacaagacaaaacaaaaagaccaggtttcaccatgttgcccaggcctgtctggaactccaaggcacaagcgatccaccctacttggccgtccaaagtcctgggatcacaagagtgagccaccacgccaggcagatcaaagcgttgagctgaataaagagttatcttttagcattttgtggagcccgggtagatctgtgcagggggaagcatattacagaagcgagaaacagagagttatttaattgaagcacgcattatgttttttttttttttacgtttttaggaaaaatatgttttgtgacttgcatttgtttgtttagtcaccttgcagttgcacagttagggaattagggttttgataatgcctgggaagggagcgataaggctcactagccataggaaaacaggtagtttttttaaaggactaaggctctttctcattctcagggggaattgggttttttttacatacagctgagtttttgcttacacattttttcatttcttttaattcctgttccaatcccagcatccttgcggtgcggtttcccagcggctctcttgccttgcagcttgtgtcgggagttgcagacagccatggcccatgggcctggcgctgacggaccctggagcggtgtctgagggaggtgggcaaagccactggctggcccgagtgcatcctcacgtaagtgcacagatcccgggctcgggtgcgactgcggtcgcacgtggacacgggttgcagacccctggcaaattgtggagctgggggaaggtaaggggaaatgtaaatcacttttccccacatttcagaggacctaggctatcaaaattttaaaaattgttaaaacttttacagtatggatctctcagttgaatgttattgaaatcaacctaacctcagttattcacgcctataagctccccttgaggcttattacggcccccatccccctacacacaactgtgttggtttctccttccgcctgtgctcctaaagcactcagtgtttacctgccatcatactttattgaaagcacaaacttgtcacttgtctgtctaccccactaagcttcttgagaattagaactttcatgtctcttcccaacacaaacgttttatgtgtattttgttgaagaacttcaaatatgacctataaaattatgactcatttatgtttcaaactccaacctctcccttgagttccttgctcacaagcaactccagactgagcttagttggaattcagtagcgcacaactgggatatccgcaccgtacggcttttaacaattttttaaattttggtcctctcagcatcacaaattcaccgtgtccaaaatacagtagaatgttgtttctacccacctacactctgccatccgctgaagtcctttccccttgctccaccactcaagccttgcctatcgcagtaaatggcagttctgtctctccagttgctcgcacataaaactaggctgctattttgatgtcttcacttttctctattctgtatctaattccttagcaatcctgtcagttctacctccaaactgtactcagcatattcactgctctaactccagcttaaatcaccatcatcctttgcctggaatgctgcatcaaccttctaatcactctactttcctcctcctccttcctccctttcttcttccttcgtataaatcatcatttcatccttctgcttaaaatcttctcacattttcttattacacttaaaacggcaaactcttacccttgagccctgcagaatttggctcccatcagtctctccgacttcaccttctgcctccttcacgctatagccatgctcacttttttattcctcaggcttaccaagctcaattgcatcttagagaatttgttcttgctgtttcttctgcctggaatacatgtttcccaatctttataagactatacttgtctgtaagtttcacctcagatgtcacatctaggagaggttttccttgaccactgtaagccaaagcaaatgttgatcattgagtgaataagggaatgaatgaatggagtggtatataatgtagcagagtagaaaatttaaggctaattctctatacatctccaagcaaatagatttgtaatgcttttcctgccaacaatctatacagctgattcacaaatacttggttgacaggttttatatatcactgtggctcatcagcttatatattgttggggccagaatctatacttacactttattcaaatttgattttacagaagagttgaggtttttatttttcttttaattaagagggctgtgaaattattatctataattctaaatctcatttaattcctcccaataggtttcaagctggattggaaccaaagttcacttctttaacgaaagtgctttatgactttaataaaacagtagagaatggtagaatccatggcagctctttacaaaaacttgtgatagaaagttttgatgatgagcagactttgcaacaactggaattgcaaaatgaagcaattttacagtgcttccagaatgcggttagtgaaagaaagatgaagatatcagtcttctcccagagagtgaagaacaggagcatgaagaggctggttcagaaacagaggctgatggccaggaggacctagaagatttagaggaggaggaggacgtgtcagatatgggtggtgacaatcctgaaatgggtgagagagctaaaaactcaagcaaattcagggccaggcgcggtggctcacgcctgtaatcccagcactttgggaggccgaggcaggcggatcacgaggtcaggagatcgagaccatcctggctaacaaggtgaaaccccatctccactaaacatacaaaaaattagccaggcgtggtggcaggtgcctgtagtcccagctactcgggaggctgaggcaggagaatgccatgaacccgggaggtggagcttgcagtgagcctagatcacgccactgcagtccagctgggcggcagagtgagagactgcatctcaaaaacaaaaacaacaattacttaactttaggatgctccaataatcaaaattgatagtggcttgtgaacagatagattacttgaatagaatagagcccagaaataaacccaaatgcttctgggggagtttggtacattataaacatgacattttaaatcaatgaggaaaagaaatcatttgcagctcaccccaccatacacagcaggaataggaagtcattggcagaataaaaagatggtaagaacagaacagaattgtagaacagtacatttcttgcttccccacttttcaaagtattttttgctttttcacaaatgtaagtgtaattttattttctaaatgtatactaattcttttcttctctttcttagatgaatgacaaaaattacatctttagaaaaagagttgttagaaaaaagccttggctgcatgtgggggaagtgacagcacagaagagaccagagaagagcctcctggaggagagcctgcactttgaccatgctgtccggatgggtgcagtgctcttttctgcaaagtgttcacttctctgctttttctgtggtcccatttcatagaaagatttggggtgatgtttctttccctcaacttttattttgaaaacttgcaaacacagaaaagttgataaaatcatacagtgaacatctgtatgctattcaactggattcactagttaatgttttgtcacacttgttttctgtcttctgcgtatggaagattgtatatgtgccctttttccccctgaatcatttcaaagtaagttggcagtatcagagcatttcactgttaagtactttcgcagatatcttctaggaaccaggacttctcctatataatcacaataccattaatccacccccaaaatttaacatcaatacactaatgatacctactgtatagattataatcagcttccttgcagcaatctgtttagaaggcttgcatcctgtcactgtccactgattaaattttgaactctaacttgaaaccctggtcatctcattgccttcttgcttatacccattaagtcaaaaggagctctcattttatttcaacagaaaagagaatggaaaagaggggaagagtccctagtaccttggataaagtatgagcacttactaccatatgtattctagttctgtagttttcaaacttcagggagcatctcaaggcttattaaagcacagatagctgtccttccccactttctgattcaggaggtgtggggctggcccaggaatttgcatgtctaacaagttcccacgtgtttctgatgctgagggtgtaaggactacaatgcgtgaatccgtggtttagtggatccacctaatgaatacatgttgtatttcctttggcacccgtgattacagaggaaacacctttcaactggaaggtatcattaaacagaggataagagatcaggtcagtaagaattaaatttcacttaattgaaatgtcactcaaatgtttagaaataatatgacaggccaggcacagtggctcatgcctgtaatcccagcactttgggaggccaaggcagacggatcacttgaggtcaggagttcgagaccagcctgtccaagatggtaaaacttcctctctactaaaaatacaaaaattagctgggcatggtggtgcatgcctatagtcccaggtactcgggaggctgaggcaggggaatcgcttgatctcgggatatggaggttgcagtgagctgagatgcgccaccgcactccagcctgggcaacagagtgagactccatctcaacataaataaataaataaataaataaataaataaataaataaataaataaataagataaaaataaaaataaagggaagatggggcagctttgtgtattgcatgtcctgaaaatgggctgatttctctcaagaggcagggatttaagctctgtagcctatgtgggatacatacaggagaaaaaagaagaaaaagaaaagaaatgtaaatataaataaatgaaaataacacttttccatgattataaaggaaatcacattgtttttgtaataatttggatgacaaaatgtaaagaaaaatctttaattttgccactcaaaacattccggtttgttgcttttcacactttttatgctgtaaacattttaaaaagtagaatcacaatacatggtcttttgtcacttactatattttaagcatgtttctatggagaaatataccctggcatcatcactggatgtatgttaagtgagtcattgccaccccagaggtggatttccttctatatatattttaatggactcgagtcaggatttttgcactgaattcatagaagtagaatttctagaggaaagtaatataaaacagttttaggatttttaaaagaaatgttcaaatcatcctacaggaaaattggttgagtttatgctcccaccaacagggacagagctccaggttcccccttccatttgtcatcttcgctggtctttaagcagaaaatctcattgttttcattacctttctttgatttctagtgcttttgaatctttttcatttgctcattggccatttttattcttgtgggaagtgctggtttctccattgcccattttctgctgcaaatcattcatttttttttctgagtaattttaaagatttctttataggctaaggctacaaacctttaatctgtcattgaggttacaaagatcttctcccagtaagtaatttgtcacttcactttatttatttattttttgctagcaaagcaccaaagtcaaatttcacttaatttttatcctgctgaatgaacacattttaagttagtgattttagtggaaacaggagcaggacagaatgtaataattagatctcgctctgtcaccccaactggagtgcagtggcatgatcatagctactgcagcctcaaacttctgggctcaagtgattttcccacctcagcctcccaagtagctctaggactacaggtgtgtgccgccaagcccagctaatttttaaattttctttgtagagatatgaattcgctatgctgcccaggctggtctttaactcctgacttaccccaccttagcttgccaatatgctgggagtacgggcgtgaactactgctcccggccaagagcttactttggtttgctagcaaggttcttggtatctttttatatttgaggctttcgtgctagtgctgaagtattacactcaccatctgaggtttacaggacttttgttttaatattgaaccgagggaactgtttagttttgcatctttgcaggtatacaaaatgtgcctaccaggactctgctttatatccattgaaaagcaagaagtaatacagtaaaagtttgcctggctacaggctttggaagaatggagtattctggtttaattctattaacttggaaggatgaaggtggaaaaaattcaaaactttaatttcctgttgaatgcaatttgaaaatatagccaatgagtccacttttcttctctagtaagtttggacattcagatctacttggtcttttatcatagaactcctagtgcgcctgagtcttacgttgtgaaaatccttttctaaaactttagatgtaagaggatagaaatgatattggatgagatcaggctggatgagaactgatacctgtagatatattttttagatgaaatctctgattgccacacgttttcttattgaactcataaaaataaaacacactggctggagggtggaagtaggaaggagatttatgtcttttaattgcatgtcattgtttcatattgagacagaacatatagtatccctggctttggacctacagaaggaaacacatttttctacctgctgtatggcagaggttcctgagcacctggagggattattgcagcacggattgctgggccctactgcagagtttctgattcattcatgtctagggtggggcctgagaatttacatttataagaagttcccaggtgctcctggtccggagactacatgtttgagagccacccttacatactaactgtaaattgtagaactctagaaaaaagcgtagtttggactgggagaagaagcacacaggtaatggagcaaatcatgaaaaagtcaacccttgatcccaggtaacaagcaatacacagtgacataacacaattcttggttttcatgattgcaagtcatagccaagtatcgagtgagaaattcagtttcattttcagggcttagaggccaggtgattctagaaaaatcggatttagtgattaactcatgagagtaggagttatttatgtcctttttctctcccccatcacttagcatttagccttactttagaagggtcctgtatttgctttaaccttgtaaagaactttgagtgcttattaaatggaaagccttgtgtgtgtgtgtgtgtgtgtgtgtgtgtgtgtgtctgtgcgtgtgtgtgtgtgtgtgtgtatttagagacagagtcacattctgtagcagcccaggctgaagtgcagtggcatgattttggctcactgcaacctctgcctcacaggttcaagggattctcctgcctcagcctcccaagtagctaggattacaggcacctgccaccatgcccagctacttttgtatttttagtagagacaggatttcatcatgttggccaggctggtcttgaactcctgaattcgggtgatccacccgccccagcctcccaaagtgctgggattacaggcatgagccatcacgcctggctcaaagctttgtatttttaaagatattagacatgtttcttgtttgtttgttttttttaaaaaaactaaacgctaatgtaggagaataagagaaagtttttccaaaaaagagaaaacattgtgattatcttattggaatgttggataataaagtctgctttatcaatcatcaagcacactataaaatttccattttaataggacttgtacctcaattgaggtaataaagttttaaagtttttaaagtgaaagccagccccgcccctctcctggagtgggcggggacagcggttgcataggcagctttccttgtgacaacacaggtccttcatgacacgctgctgtctggccacacctccttttcctttcatctttctcattgaccaatgggcttcaagcatgaaggccacacccctattctgcattctagtgcagccctggttacgcctcctctggctcagtcacacagcgacgtagaggtgactggaggtatatacttgtcctcacctggatcatgctgatgtggccccaaccccacctccctacccatccccacctccctacccatccccacctccctacccatccccacctccctacccatccccacctccctacccatcctatgatgtccaaagaaaccagacagagcaaattggccgaggccaaggaacaggtaaacgcaccaacaccccaacccaacccgaggccccctctgacagccgaactgctgccagagtctgtgccactcctgagggacaccaggctgggccccccaccccagtgcctctgggctccccacaccaaaatcttgtcagccagcccaaccccctcataagtcctgcccctgctctgcccggcacaccagggtgactttgagcaggtgactcctggggcttccaactccatactccgcccttacctcctgctaccccaaacccgacctccctgggctccttgagctcacatctccaaggacctgggtgccccagaacctgccctcaccagttgccacagggtgactttggggatgtgactcctggagctccttgctccttaattggccctcacctcctgccgccccaagcctgacctcccggggctctttggggtcacgtctccaaggacctggctcccaattttgtgaccccctccccagtctcaaagcggcaacttgggcattgcactcatgtgtcccccccaaccactccaccgaggagtagaatgtagtgatgtcacagtcccgctacaaactgtcattactaccacaagaccggcctttggtcttaggacccagtcccctaagtgttcttgcccacttctgtttcctctggttgcagcacaggtttccagctggaaggggaatggggactgtgggacctagaagagagaggtttcaggctgcctgacttccttaccacagaccttgacagtgtgaaaagcctacacctcccccatgagctcaacacgttgacagtgtctctgggtggcaatgggagaacgggtttggtttggttttctcccaggcttctactctccagagagattttaacattttttctcagttctgcacctcagatttgaattctccattgttctgggaccagagtgcccctcagtcactggttctggagtgagatctgcttatcttctgtggaacagatcttgggaaactgaacttagcttgagtcttcctcatctcatctcaacctggggtactttgagtgccacaggataaatatggggcatctttctgaagcatcagtttcccttgattctattgagaggcaaaacattaatgtacttagggatgaaagtcacgtagatttataagcgtatacaagacttctctctgaaatgaggcttgggttgtcctctttctgttaaattcccagatttagcagaaaggctgccttctgccatgaggagacattgatgtaaaggtttgagaggtactggtgtactttttaacactaacagacgtgtgagggtgaataaccctaaaccacatagtgcacagttcctgcctacttaatatttgcttttctacctctgcctctggttttggtccctggcagctgctgatttagggcaaaatcccagagctcagagtcagaagactgagtttaagttccattactgccttttttttcagccatggtatcaatctctctcagtcactaagtgattgtgacaacatttcctacagttggtggcattaaatcagatggtctataagagtatttagtataaactgtaaagcaggatgtgactgtaggagcttgtagttctcatgagtatcactgctcttcctttccacagttgacagaccatcatccccagaccaaccctagtgttggtacagcagcaagcgacaccaaaaagaagaaaataaataatggcactaaccctgagacaaccacttctggtggttgccactcgcctgaggatgtgagtcttggctggccgggctcctggggacagagggcccaaggggtggtggagggtaattgttaagattgtggaagaactgccaggtactggctaagaattctgggtttgaatcctacccctccatctgctagggacatgatttagcgcaaattgcttgagctctttgggcctctcttttcacatccgtaaaatacgagtggtattgttttccttacgtttgtgaagtttaaatgagatttgtcattgtgtttttatgttaatccctcgtccaggacctgctgtaaactctccttcttgggcttgcgtttcctgaggtagagttagagagtatcagaggtttctgttagctctgagagcccgagagttaaaggcccactagaatggaaacctcggggccaagggctcctgtctgccttttctgacctctattcccgctgtgaagaaccgtccctggcccgtatgtgctcaacgtttgctgagtgaatgcacctttctaaatcacaagctggcggaagggtgggcttttctcgcactccacctctgaaggtttctgttactgtcttttcaagagaatctagtttcagactttgagttctgtggctgtgggcaaaaaccaaaaagacccaaatccttcttctttgggagttgaggagagttgaccagttcatgttcccattgggtctgagaactgtgccttttaaatccattcctggcccctgcctatcgcttcctggcctggggaatagagtcaagggggccaccctcagtcaccttcctttgactctccccacagaaacaatagaaccgagctcagctggaagaagtagtgtgatttctttgctcacgacatgaccgctgggtttgggggcactcagatgtagaggccccaggctcatctcacccactcccagcctggggaagaaggctcacccccaagattccaccccatccccacagggtccctgataaactggtcccatgggtgggcctgttctggggcagtggtgccattctgggggcatgtctcttgctgtggatctctgcctccccctagtaagagctctgttttcctctttctataggaacagaaggcaagccaccaacatcaggaagccctaaggagggagctagaggtgagtggagggtgtgaagttccctcctgccctctggagaatgtttctttgcttctctttcagcatttgcttgtcttttctcccaaaggcccaggttcataccatacgaatccttacatgtcagaaaactgagcttcagatggcactctactacagccagcatgctgtcaagcagttggaaggtgggaatctggcaccccatcatccttcaacctggcactttgacaggcctttagggggagtcctttgggccacatctgaatgtctctcattccaggagaggccagggatctgatcagccgcctgcatgattcatggaagtttgcaggagagttagagcaggctctctctgctgtcgctacacagaagaagaaggcggatagggtgagtccaaacacggccccgtcccttgggagcccagcttcgcagatggaggagtgagcctaaaggtcccttctgtaggatggagtgtcctgcccagaaggcagcatggccatttcttgctgcttttgtgtgtggttgttagaggcagactggggctgagtcggctgttgtgggtgagttggggagcactgtgaggagcgagcactggacatagagctcagaggccaagtgcccgccctgcccatacttggctgtggccttggccaagtcctaagtggcggttagggtacttgtaccataaaggtacagaagagtatcttgagtatgttattatttgtgtggagagagggggcaggtgtatatgtgtgtgtgtgtacgtattatggtaacatacataaaacacgtttgtaaggattcattaaaaaactcaggatagaggcacagtgttggggggagatatttcccttctggactttctgagttttggactatgcgaacgtatcatcctttcaaaaattcaacaaaggattaatttcctccttcttaactgtgcccctacctccagcggaagaatgggcttagagaatcagatatagctgggtgttgaaatcccagctccaagtgatcttaggcagcacttaacctttaataccgcatgtttttcatctacacaatagaggtaataatggtaaccatctcctatggaggttgtgaggattaaatgggattgttagcatagtgcctggtgaagcactcaataaaggttcgaacagtggtagtactaacagtaatagcaataacaatattatctgatcgctctgggcccctgttagccagccctaaattcaatctctttccctgtcccttccacatccactgagttctttgaaaaacaaatgagggccaggtgctctcgctcacgcctgtaatgccagcactttgggaggctgaggtgggcggatcacctgcggtcaggagttcaagactagactgaccaacacgaagaaaccccgtctctactaaaaatacaaaattagcccggtgtggtggcacatgcctgtaatcccaactactcgggaagctgaggcaggagaattgcttgaacccaggaggtgtaggttgtggtgagctgagattgtgccattgcactccagtgagggcaacaagaatgaaactctgccaaaaaaaaaaaaaaaagaaagaaagaaagaaagaaaaacaaatgagaccatgggcttggaaatgccttgagaacacgtcaggtgtgattgagagtgaggaagtgttactgtggagtagtcactgtagcagttgttcctggtcgtccagctactgctgtgcctgctctatcctgacttaacctttctctatttgcagtacattgaggagttaacaaaggagagggacgccctgagtctggaactgtacaggaacacgtaggatgggggaaggtggaatgggaggtctgggggcccttagcatgggtggtgtgctgggaggtggggggtccaggtgagtgtggggagaggctcatacatgttttcatgtgtgcacacggaagctctagtgctggctgtgccactgactcatggggtagcctcaggcaactcatgtcttctctctggcctgccacctgggacttttaattcctggggtcccttccagcgccacggttctgtggttgtggggcgagggtagggggtcaatcaccaaagtggtcttttatgttcttcattcattcctttctctactgcctctggccatagcataactgatgaggagctgaaggagaaaaatgccaaactacaagaaaaacttcaacttgtagaatctgaaaagtctgagatccagctcaacgtaaaggagctaaaaaggaaactggagagggccaagctcctgctgccacaggtgagcagctgcagccccgggggttgtgggagacccatccagctgggaccatggtctagggatcatgcagggtatggggaggctccagccaagagctggaaaatttgggtccttgttctggtcccgccatagaatcctctagagtgtactaaaaatgtacaaattggggccctgcctggggaatcagaatctcaagagttagggcttaaaaatatttttttaaaggatcatggatgaaaaccattattttatagattacatttatttatttatttatttatttatttatttatttgagaagtagtctcactctgtcacccaggccagagtgcagtggcgcaatctcggctcactgcaagctccaccccccggcttcacgccattctcctgcctcagcctcccaagtagctgggactacaggtgcccaccaccacacccggctaattttttgtatttttagtagagacggggtttcactgtgttaaccaggatggtctcgatctcctgacctcgtgatccgcccacctcggcctcccaaagtgctgggattacaggcgtgagccacggctcccagcctatagattacatttatgtggctagctcatgattctgcttccttctgaggttcaaaaaaaaacactttcactattccagcagcagctgcaggcggaggctgaccacctgggtaaggagctgcagagtgtgtcagcaaagctccaagcccaggtggaagagaacgagttgtggaaccgcctgaaccagcaacaggaggagaagatgtggaggcaggaggagaagatacaggagtgggaggagaagatacaggagcaggaggagaagatacgggagcaggaggagaagatacgggagcaggaggagaagatgcggaggcaggaggagatgatgtgggagaaggaggagaagatgcggaggcaggaggagatgatgtgggagaaggaggagaagatgcggaggcaggaggagatgatgtgggagaaggaggagaagatgcggaggcaggaggagatgatgtgggagaaggaggagaagatacgggagctggaagagaagatgcacgagcaggagaagatacgggagcaggaagagaagaggcaggaggaggagaagatacgcgagcaggagaagaggcaggagcaggaggcgaagatgtggaggcaggaggagaagatacgggagcaggaagagaagatacgggagcaggaggaaaagatgtggaggcaggaggagaagattcacgagcaggagaagatacgggaggaggagaagaggcaggagcaggaggagatgtggaggcaggaggagaagataagggagcaggaggagatatggaggcaaaaggagaagatacacgagcaggaggagaagatacggaagcaggaggagaagatgtggaggcaggaggagaagatgcacgaccaggaggagaagatacgggagcaggaggagaaggtgtggaggcaggaggagaagatacgggagcaggaggagaagatacgggagcaggaggagaagatacgagagcaggaggagatgacgcaggaacaggaagagaagatgggggagcaggaggagaagatgtgtgagcaggaagagaagatgcaagaacaggaggagaagatgcggaggcaggaggagaagatacgggagcaggagaagaagatacgggagcaggaggagaagatacgagagcaggaggagatgatgcaggaacaggaagagaagatgtgggagcaggaggagaagatgtgtgagcaggaagagaagatgcaagaacaggaggagaagatgcggaggcaggaggagaagatgtgggagcaggaagtgaggctgcggcagcaggaggagaagatgcaggaacaccaggtgaggctgcaggagctggaggagaggctggggaagctggggcagaaggccgagctcttggggggagcaggcggaggtgtgtgcaaaccctggagatcatacagaatgacctcaccacaacttagcagatggtggttggctccctctgcttttccaccagtctgtggcctacagtttaaatggtgggaagaagggtgtgagatttgaggctggggagggaggcatgggcctctaggcaagggaggcagtcatttaggcctggaggaaggggccagggccaggggcctgggtaggcgacagagccccgcagtgccctcactaccctgtttatgggcccagaatctggaagccagccactacctaccctgacgcctatcctgcaggtggagctgaagagccaagaggctgagtctgcagcagcagcgagaccattacctgggtcacctgcagcagtacgtggccgcctatcagcagctggcctctgagaaggaggcactgcccagctgcagcagcaggaagctcagggcgaagcggtggccgagatggcccaccaatagttgcaggagacccggttgagggagttgatgagggcggggccccaagggggatgatctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccactctttacaaaaaaaacaaaaattaggcgggcgatggtggtacccacctgtggtcccagctattgagagggttgaggtgggagcatcatgtgagttggggaagttgaggcccacagtgagctaagatggggcccctgcactccaccttgggcaacagagcgagaccctgtctgaaaataaaaaaaaataaaaaacggggttgagagacaaaaaaggacatccttttttttattattatattttgagatggagtttcgctcgttgcccaggctggagtgcaatcgtgtgatcttggctcactgcaacctccgcctcccaggttcaagtgattgtcgtgcctcaggctcctgagttgtaaaacgacgaccagtagacctgcagatctgatatcatcgccactgtggtggaattcagacggggtttcaccatgttggtctggtctcgaactcctgacgtcaggtgatccacctgcgttgccctcccaaaatgctgggactacagacatgagccaccgtgccagccgaaaccttcattttaaaaaaggctgggtcaggcatcatgcctcatgcctgtaatcccagcactttgagagggcaacgcaggcggatcacctgacgtcaggagttcgagaccagaccaacatggtgaaaccccgtctctaccaaaaatataaaaattaggcgggtgtggtggcacacacctgtaatcccagctactcaggaggctgaggcaggagaattgcttgaatctgggaggtggaggttgcagtgagctgagattgtgctaccacactgcagccagggtgacagagtgagacgccatctcaaaaaataaataaaggctgggtgccagatgtggtgcataggcctagtttgttgactcctgtacttaacatataaaactctaaagaacagtgggaaggagcttccctctagaggcacaggagcggccaagttggtccctgagcagtgactttataataacatgttacactgtgttttttgtttttgtttggttttttgtttgtttgagacggagtttcgctcttgttgcccaggctggagtacaatggcgtgatctcagctcaaaacaacctctacctcccagattcaagctattctcctgcctcagcctccaaagtagctgggatttcagtcatgcaacaccatgcccggctaattttgtacttttagtagggatggggtttctccatgttggtcaggctggtctcgaactcctgacctcaagtgatctgcccgcctcggcctcccaaaatgctgggattacaggcgtgagccaccacacccggcctatattttttttctttttttttagacacagtctgactctattgcccaggctggagtgcagtagcacgatcttggttcactgtaacttctgcctccctggttcaagcgattctcctgcctcagcctcccaagtagctgggattacaggcatgcaccaccacatccgactaatttttgtatttttagtagagatggggtttcaccatgttggccaggctggtctcaaactcctcacctcaagtaatccgcccgcctcggcctcccaaagtgctgggattacaaggcgtgacccaccgggcctggccctgtgtgttgttttatgtatgtttctatatgtgttatatttcacaataaactaaatattaaaacaaagaataactgatagctatgcacaaaggtatttaaatttcaccctcacaaataatttttttttttttgagacaggatctctgttacccaggctggagtgcagtggcaccaccttggttcactgcagacttgacctcccaggcccaagcgatccttctacctcagcctcctgagtagctgggactacaggcacactccaccacacccacctaatttttgtatttttggtaaagatggggtttcaccatgttggccaggctggtctcgaacttctgggatcaaggaatcctccaaccttggctttccaaagtgctggtattacaggcgtgagccactgtacccggccaagaatagtttcttctccttacctaggtagagacctctgcagaaatgctgggagatctttggagaggggagattttttaaataaaaaatttaatacttggaggggcgtggtggcttacccctgtaatcccagcactttgggaggccaaggcggacagatcaggaagtcaggagattgagaccaccctggctaacacggtgaaaccccatctctactaaaaaaaatacaaaaaattagctgggcatcgtggcgggcgcctgtagtcccagctactcgggaggctgagtcaggagactggcgtgaacctgggaggcggagcttgcagtgagccgacatcgggccactgcactccagcctgggcgacacagcaagacttcgtctcaaaaaaaaaaaaaaaaattaatactttgggatgccaaggcaggtggatcacgaggtcaggagttcaagaactgcctggccaagatggtgaaaccccgtctctactaaaaatacaaaaatttgccgggcttggtggcaggtgcctgtaatcccagctattcaggaggctgaggcaggagaattgcttgaacctgggtggcagaggttgcagtgagccaagatagcaccactgcactccagcctgggcaataagagtcagactctgtctaaaaaaaaaaaaaaattgatctagttcaaaacctcactttgaatccacccacattgctctaaaatactttcatctttcctgtggctaaaaccttaaagccttgccagtaactcccattgcacttaaggaaatccaatctcccttgttgtggcccctgaacaggctgctgctggcccaccacggtgcctctagtttgtgtaaaatgcatatgttaatttacaataaatcatatgaggcttttttagctctaaaaggctattattcactagttgctgtgtgaatcagtatttctgggtgcagttagaaattattagagttgatgcccaagactcatctccatcagcacgggggaggcatctgctcgttttatggtcagtgactctgggcctcctgctgggcttagtcctgaggtgggtctgactcaggtcagggctgtgcaccccggccctcctcctcaacgtgcatgagtgctctttaggatggagctgaacactggcttctcaaaaccacttggccccatcacaggccctgagaactgattgggtcactctggtgggctccccagccctagccaagaagggtttctctagggagcctggccccccacttatgagatctggagccccaaagatcctgaccaggggcctgcctcctccagggaggggccactcgcccccaccaagctcccttcacagagacccatccaacagagctgaggaaaaccatgcctcataaatgaataaatacataaataaggatgccggggacctgtggattttgtaattcctgaaagaaggcagagtggctggctcacagcaagcgcagtaggagatactgctccccggccaggctgttctctgtctctttggagggagccctagggtacaagaaaagccagaggagaccagctggcccagaaggtgcctctccaccccttccccagagtttctgggaaacaaagcccacccgagggacacatgccttcttgggagttgtaccaggcctccttcctcatccggccatgcagtggttttcagtgcccgaaacagatgaataaaataggccctttactggatgttcttcaggaacatgcgcacttctttggatcttaccatcgttttatctctatttaaagttaaatgctgtgttatacagagtattggtaaagatgtagagctacaagaactgtcaagctggcagtagcataaaattgtataagcacattggaaacctgtttggcagcttccactaaagctatatctatgcctaccttcagaaattccatcctaagcatgtacacaagagaaacgagtgcatatgtccacaaaaagacttatataagaatgttcactgccatttttattcataagagccccaaatgaaaacaacctaaatgtccatcaacaggagagtgaataaatggtgatacagtcacatcatggaatactacacagccaaaaaagaaaaatgaagtggtaggaacactcaacgacatgggtgaatagagggagccaggtatgagagacagtgcacagtaccagcccacctagatgaagcgcaggaaggcagaactgacgatgattgaagtcagaagagtagtttcctttgtgggaaagtgtaggtcaggaaggagccttctggggtactacaaatctgccgtattttggctgggtgcaacagctcacaccagcacttcgggaggcataggcaagagggtcacttgagcccaggagttagagaccagcttgggcaacacagcgagatcccatctctacaaaaaaattaaaaattagcgtggcatgctggtgtgcacctgtagtctcagctactcaggaggctgaggcaggaggattgcttgagcttaagagtttgaggttgcagtgagctcccaaagtgctgggattacaggtgtgagacactataccagcctgatttttaaatactgaccaagccttgtgttactgggataggcatcacttggccacaatttactactctctttcttttttttttttttttttgagacagaatctcactctgtcacccaggctggagtgcattggtgcaatctcagctctctgcaacctctgcctcctgggttcaagcaattctcctgcctcagcttcctgagtagctgggattagaggtgtgcaccaccacacctggctaattttgtttgtttgttgtttgtttttagtagagatggggtttcaccatgttggccagcctggtctccaactcctgacctcaagtgatccaccctccttggcatcccaatattcctatgattacaggcgtgagccactgcgcccggccctattctgtttctatattgctaaatttgacttgctaacacgtttttgaggatttttctgttgatgctcatcagggatgttggtttgcagttttctttctttgtattacactatctcgtctggctttctgtcaggggaaagctgaccttatacaaagtattggcatgtgttccctccttttccattttctctaagggattgtgtagaattagtgttatttcttctttaaatgtttttgaatccatctgaacctggagatttctttctaaaagattttacgccgggcgcggtggctcgtgcctataatcccagcatgttgggaggccgaggcaggtggatcacctgaggtcaggagtttgagaccagcctggctaacatggtgaaaccccgtttctactaaaaatacaaaaaattagtcaagcttggtggcgtgcgcctgtaatcccagctactcaggaggctaaggcaggagaatcacttgaacctgggaggcagagattgcagagagctgagattgcaccaatgcactccagcctgggtgacagagtgagactccggctcaaaaaaaaaaaaaaaaatttttacaaattcaatttatttaacagatacagaactattcaggtaacctgtttgtttctaggaggattttcctggtttgtggcactcggacattgctttatttcatctaagttgtctgatttttaagtgtcaagttttccttagtgttctcttgctaaccgtctgaagtctgtggggcctgcagtgatgtcccttcattcattcctgatactgataatttgtatcttttctgtttttttgtcagttttcctagagtttttcaattttgttgatcttttcaaagaatgatctttaagtttcattaatttttcccttctttttttgctttcaatctcattagtttctgcttttatcttggcatttgttcctttggcttgttttgcgttcactttgctctttttctggtttcttaaggtggaaacttagattgctgatttagacctatcttttttgtaatatataatgatttgatgctataaattttcctctaagcagtgctttaattaaacccacaaattttggtgcattttcatttatgttcaaaatattttctcatttctttggagaattgttctttgacccatggatgatgatgatgatgatgattattattattattattatttttcttcaatacggagtttcactgttgttgcccaggctggagtgcaatgacatgatctcggctcactgcaacctctgtctcctgggttcaagcgattctcctgcctcagcctcctgattagctgggactacgggcacccgccaccatgcccggctaattgttttgtattttcagtagagatggggtttctccatgttggccaggctgatcttcaactcctggcctcaggtgatccccccaacttggcctcccacagtgttgggattacacgcgtgagccagtgcgcccggcctgacccatggattattaagtatgtggttttattttgaagtgtttgcagattgttttgttaatgatttctagtttaataccattgtgattggagaacaaactgcatatgatttcatttcttttaaatttgttaagatttatgtgtcaggttatgttctcagtgaacattctgtatgtgcttaaaaagtatatgtatggtctgtatatgtatggtctgtatatacatatatgtatacatatatgtgtaaaaagtatatgtatggtctgtatgtgcttaaaaagtatatgtatggtccagcactttgggaggccgaggcaggcagatcacaaggtcaggagatcgagaccatcctggctaacagggtgaaactccgtctctactaaaaatacaaaaaaaattacccgggcatgatggcgggcgcctgtagtcccagctacttgggaggctgaggcaggagactggcttgagcctgggaagcagagcttgcagtgaactgagatcatgcgactgcactccagcctgggcgacagagctagactccatctcaaaaaaataaaatttaaaaaaagtatatgtaaagtatatgtatggccgggcacggtggctcacgcctgtaatcccagcactttgggaggccaaggcaggtggatcacgaggtcaggagatcaagaccatcctggctgacatggtgaaaccccatctctactaaaaataaaaattaaaaaaataataataattagccaggcgtggtggtgagcacctgtagtcccagctactcaggaggctgaggtaggagaatggcgtgaacccaggaggcagagcttgcagtgggctgagatcgtgccactgcactctagcctgggcgacagagcgagactctgtctcaaaaaaaaaaaagtatatgtattttgctgttgttgggtgaagtgttccataaattagatccagtttattgaaggtgttctacagttctcctagatttttgccgattacttgttctctcactatgaaagatattgtgtgtgttatatgtgtctaacaattcattgtctagttagagttgctattataccacttcaagtggatggagagcctccctgccatccattaatgtgcattaatcattttgagagtgaaaagattttttaaaatgtttttactcttttaggtatggccaagtgagatggggctagtgaaatgggtgggagaattggaagctgatagtgtgtgagctagacacccatgaatgcttttccactgggcagttagagggatgataggtaataatataaggcagctccatcacacaagctggtgactcctgtgcgacagaccaagagctgcatttggagattcatttccgattgttgcgtttcctcttagagcattgcttggtcatcgtgttctgagtggtccattggcctccatgtcccttttggggtggatatttgctcagtgacttttgagcagctggatctcctgcttcggcaggtgagtgaggggatggatggctccgcggactggcccccgccccaggagaaagagtgcgtggccgtggcaacgctgaatcttccccgacttcaggtattcgtgatttcccttcctcttgctccttttataagtgtcttagcgatttgtaagaaggtttatgtattttgaaggacataggttttagcctgttgggggaagtattttaaagtaagattgtaatgcactaataatggacgcaaggcttaaaaaacttgatctgtttattttatgtttgtcctggaagtcagcctcggcatgcaggaagagtgtatatggattgtgttatttttgctataatcattagtttgttggtattcttactgttttactgttgttgcgtgtggagaaatgactgggtgagatcacaggtgatggagagagacagcgctcagctgagagaccagtgctggcctgtctctcctctgtcctgtgaaaaccctgctccaggagggtccagtcttttggtttccctgggccacactggaagaagaattgtcttgggctacacataaaatacacttatgatagctgatgagcttaaaaaaagaatcccaaaaatatctcatgatgttttaagaaattttactttgggccacattcaaagctgccctgggccacatgctgccctcgggccgtgggttgaacaagcttgatctactcagtaagctcggctcccaaagcaataccttcctttcctcaccatgaaggctgtggttagggtcaaaataaaagctacaaaagccttcctccctagcaaaactaaagctgaagtgtttgatcatcatcttttgtctttgtaataaaaccctctaacttaatgacaagaaccacggttttctcgacatagtaatttttcccttttattacagtggtttcttgtaacaacccgtcatgtccctcttccagcccctcccctttttgccctgcttctagaatgtacagaactgagtgtagtgtttagttgcagtaatgaactgagcagaggtctggagcatgcttctcctctagtcctctgtagcactcatttatcaccatatctgtggcatcctggcgtttgcgtggttgcgccccaggtgtttgctgcccctcctggtttgcggtgatgtgtctgttctggtcagtgctgtggggcgtggccttgcgtatgtcttaggctgtcgaggtgtcccagcgtatggttttgcatttgcctctccggggtcctgaaggttctgtaggtttcacagactccaggtgagtttcggtggtcatttcctgacctgtgatatctatacctagatgagtggtgtgcttttgatttcacttctactcacagggcaaggccgggtctctgatttctcatggggcctcttgctacccagagcctgggacgggcagtgtgttgccccctggctgcggttggctggcaggcaggtgatcctgagtggctcccagccttctgcaggaagctcgggttcagtgggtccttgtgtgcattcccgtgtgggaggttgtgctgaagcctggcggcttggctctgctttcagagcccggaacctcttgactcctgctgtgtgtgcccacgtgaattttggttttgcacttgaggagtttccctgtgtactctcagctccgcagtctaatttttagcagctctttttttttttttagacagggtgtcactttgtcacccaggctggaatgcagtggtacagtcttggcctgccaggttcaagtgattctcctgcctcagcctcccaagtagctgggactacaggtgtgtaccatcacacccggctgatttttttatagagatggggtttcatcatgttggccaggctgatcttgaactcctgatctcaagtgagctttcccgtcggcctcccaaagtgctgggatgacaggcatgagccaccgcctgtggcagcttttgtggttacattgtagccattatttctgtgtttggtgcagattgttggggcggggtggaggttgctgttgctagttgtttagctcttctgctcatcttgagcttttccatatatgtgttcatagtggggttaaaaaaaattcctctagaaaatacttcaactattgtgggtaagagtttttttagtccagtttttaaaaatacgtaaactgagaagttattttgtctatttagataatacttcaaattgacttttattcagtgtttaataagactttgaaattcactcatttttaggggttctaagtgaaaattgtttttctcctttcagttgcatgctgccattagtcaccaggttgacctggaattccttggtttaggtctgggcagcgtcttcctgaacagcctgaagcagaaggtggtgaccctggcaagcagcgcagacgtgctgagcaccgtgcagtcggcctcccaggccatgctgcagagcggctggtccatgctgttgcccaccgctgagaagcaggcccgggcactctgctctcctgtcctgcggaggtgggctcggggaaggaacaggagagggcatgggtcagggtgctgggaggggatggcgtttcactcaaattggcacacactttctatttcagtttcaggcaatgaagtgagcataagtccaggtcatcgattggtgattgatcttctggtgggcagcttgatggctgatggagggttggagtcagccttacacgcagccattactgcagagatccaggtatggccttggaggcacacgtgacctggtggtgggctgagatcggaaataccacactcacacatgtgaagaataactgaaaacagtaaaacactaaacttatatccaagtatttttttaaattaaaattcttttatgtgctaattttaaaaattattgagatgatttgtgataaaatactgcatgttgtctgtttcagtgaagttaacaggtaacctgttcctcatgtagaccattcccgtcacccggaaagatcgctgtgctccttggcacttgcagccaggatactcccctgccctgagattagattcatttttcctgctctgagtgtcgcagcaatataactgtatagtatgcactctttcctgctttgccttggagaatgattttcagattcgctcactgttgtgtgtattgcgacttcgtttttattattgggaagttttccattttataggtgtagtactgtttgttagttcattctcctattgaaggacatgtaattgtttttggtttttgttttctttttttttttttttttgagacagggtcttgctctgtcacccaggctgtatacagtgacctgatgttggctcactgcagccttgtactcctaggctcaaatgatcctcccacctcagcctcctgtgttgcagggaccacatacatgtcaccatgcccggctagttttttgatttttttgtagagacaaggtttcactgtgttgcaaggctggtcttcaactcctgggctccagtgatccccccaccttggcctcccaaagtgttgggattacaagcgtgagccaccgcgcccaggctttctggtttttggccgtgtagagctgccacaattgtgctgtgaacaagtactttagtgaacatatgttctccctttggataaacacttggagtggaatttgttaggtcctggggttagtgtgtgttcatagtttcccaaagtggctttgccatttgcatttgaaccaggacttgtgtgtgagaattctagctccttcttgtccttacagagcagctggatgctgcgtgtgtggagccgatcacattgggttttgtgtgagccattagcagggttaaggattttagggacttcacagaaggaggctggagagcatcagcagaggcagcctagaccttggatctgtaaaaagaagacactgtttgaaactgcacaaatgagttggggtttccaacagggcaggtgggggcctgtgggtggatgggtgtggcagccacagaggctgggatagcttggcactggggtcagggctcagccagcctgtgtgccttcacacctggtaatgagatcacttgtaaacaatttctgtttatcaattacaggatacaaaaaaagaagcacggaaggaaaaagaaatttatgaacaggaagcaaatgcctcaacatttcatagaaggaggactccattggataaaggccttattaatacggggatctgtgagtcttctggcaaacagtgtttgcctctggttcagctcatacaacagcttcttaggtaaatcatattagctgtattgtattgtgttttatttatttacttttttgttttttgagacagagtttcgctcttgttgcccaggccggagtgcagtggtgcgatcttgactcactgcaacctccgcctcccaggttcaagtaattcctctgcctcagcctctcgagcagctgggattacaggcatgcgccaccatgccccactaattttgtagttttgttagagacagggtttcttcatgttggtcaggccggtcttgaactcccgacctcaggtggtccatccactttggcctcccaaaatgttgggattacaggcattagccaccacgcctggcctatttatttacttattaatggtgttttttttttgttttttttttttttgagatggagtcttgctctatcgtccaggctggagtgcagtgtcacgatcttggctcactgcaacccccgcctcctgggttcaagctattctcctgcctcagcctcccgagtagctgggactacaggcgtctgcaaccacacctggctgatttttgtatttttagtagagatggggttttaccatattggtcaggctggtctcaaattcctgacgtcaggtgacccacctgccttggcctctcaaaatgttgggattacaggtgttagccactgtgcctggcctgtattgtattttaataggtgattattggttttcatattaagatagtgaaatctagcgcaaggatctcaaaaatttgtttgatgattgaaggaatattctgaaaattacctagtatagatgttaggataaagagcagacccttttcaatataggtgagaggagaagttggagggtgtgatgatactcaaaagtttttcactgaagagaaattggggcgtgcagtaaacatgtaaaaagattcttactaataagcaggtggatgcaaatgaaaatcatcatggaaggttatttttaaaactggttctatcattgcctcactttatatattacagagttatacatactactttgtaagataacttttcttttcaaaactgaagtcaatgtgatagaatggtgagcattattttggaaggccagactaggaggaggtgggaggaagaagtcagactcagcctgtgaacagacgctaaccttggcagaagccaaaacagtcagacagtgttgtctaaaaatgatcattcaagaagagcgaaacagcaaggtgatttgtgaaagagatttattagaaaatgaaacacatttatacctctgttcaataaaaatctgcttttcgtcaactgatgctcctggtttttgtttctacacatagagaaagcagagccctggcagcttgggtcaggcagccgagtacagaccagggagccctgggcagtggctgcagctctcagctggcctgttcatggggccatggtgggtctgtggcgtggggtgggcctgtggcgtggggtgggcccgcggcgtggggtgggcctgcggcatggggtgggcccgcggcatggggtgggcctgctgtccacagccagaaaaactaacttagtgcacacacagtgaaattttgaaacaggaagttttagagctagtttctgtcatagattttagtaaatgctattttgcaaaacctttttctgatgtttgttttgtttttctaatctgataatgcatatttcacacattctggtctttaacaaatggaaataaagagaactaaacaatatagtttgtgtcgatggaaagagcttgggatttgttctcagaaaatttcagttacaacagtttgttcatataggtggacttccaacacagtaactatgggagtaagaataaaagctgtgtttactttcacagagttaattaagaatacatgagaaaatggatgttaaaaaccttgtaattaaaatgtacagttacatgcaaagttttaaagtgagcattttccagaggtgcttttctaagttcttgaatgcctctcccttttctgaagtggctgcttcgtggggctgttggtctttggcagggggtgagtgcagggttcctgttgtgggtcctttgttctcacgagggcagtgcccgttttccccgtctcctgcttgcccagactgttcccgtgcgcagagagactggcctgtttgacctgcagctgtgctgtttgagctgcagctgtgtagcctgcgctggcccatctggctacactcaacaccgtttgctgatcagcacttgaagtctgtccgtcatagctgagacactgaatattttatctgtttaatttttattcattaaaatgcaggtttgaaaatttgattctgttattagaaagcacttaagtatgtttagaatcacttggccttgggagtctactttgtcaactgtgtattttatgagtctaaatggagatcagatgttttcaatgcaaatttcacggtccaaattgaaatgtgttacatatgtaagctactcagatggtttttgaggacttaatatgaaataacctatgtaaaatatctcaataatttttcttagattgatttcatgttgaaatggtcatatttttgatctgttggaataactatgatacattattaaaattatttttattttttaagatggaatcttactctgttgaccagactggagtgcagtggtgcaatcttggctcactgcaacctccgcctcttgtgttcaagtgattctcctgcctcagcctcctgagcagctgggactacaggactacagactcccgagcagctggcactaccaccacgcctggctgatttttgtatttttgtagagacagagtttcaccatgttggccaggctggtctcggactcctgacctcaagtaatctgcccgctttggcttcccagagtgctgggattacaggcatgagccactgcaaccagccattattacaattaattttatgtgttgttgtttttcttcttggtgtttttttttttttttttttttacttttgttaatgtgactaagaacaattttttttccccacccggagatggatcctcactctgttgcctggactggagtgcagtagcacgatctcagctcactgcagcctctgcctcctgggttcaaatgattctcctgcctcaacctcctgagtggctgggactaacagaagcatgccaccatacctggctgatttttgtatttttagtagagatggggtttcaccatgttggccaggatggtcttgaactcccaacctcaggtaatctgcccacctcagcctcccaaagtgttgggattacaggcgtgagccaccgcacctggccatgtttattaatacgactaagaacattttgaattgcacctgtggctccattggtgtcctgggcaggtggctctgtgctgtccacacaggttgtctcctgtgtcttcgtcttcgctgcgtgtgactttttggttcctgtggcacgtggggtcctgtatgggacattggttctacagcagatttatagtaaggatgtacctactaaaaaatacaaaataaaaagaatagacacaaacatagaaataagtatcacctcacaaaacttttggaaagtagaaaaagaaaaatgcattcgcagctttccagtagccgatatccaggctgtcttcatcagcatggatcatgtgtccctctcctgcatgggtagacactgttttctcaccttaagtgtttgtgagtgaaggattcttgatgtgttgacttggcagatgcagttgttgaacagtagtttatctaaagatcgtaagagacttttggagacatttcatgtccttttttcccttggaaaacgtgggttggagaaatcgctgcttgccaaaaataagccgtgaaatgtatttcagagtagatcgttatttacatgctggcgaggagccacagaataccatttacatttgaaaatagagcgctgcgaagtttttataagtagtgaatcccatcagaattacacattttgattatggctctaaattttatattaaataaactaaaaatttcattgtattgtattaccgtctcttgctccttcaggtgtagcatacatgctagattctagacctgtttcttgtgttacagtggtgttatccaggcagggtatcatgtagtgaaggtgatgtcgagtggtggtggtgagcccagtgaaggcgcatccttgccgtgtgtgatgagggcctgtgggttgctatgggattccccaaccctggctcctctgtctcctgcttctgtccttactcacactgctggtagttttctggtgtgagacacgggggcaagtgggattgacaagcctgctgtcacattaggaacctgagttaaagtggagctgaaagcatgtcctcgctcttgatgttgtgcagagagccacctgtgctcctggctcaacggggcgggtgtggtgggtctggaaccaggccctggtttggctctcctcccctccatgttcccctgtcctgtctgatttgcttcacactgacataagagttactttccctcggcctcccaaagtgctggtattacaggcattagccaccgcgcccagctagcatcctttcaagtactggggtacacccaagctcccagcttctagctaggagtcattttgtccctctttatcccaaaggacttgccaccatctttggttcccaaagcccaggagggtccaggctcttcagcctccaaccactttgcatttcttgtctgcttttcgttcatggagataattaacttatttttcagcctgggcatgtcttttttatttactttattttttatttttattttttgagatggagtctcactctgtcgcccaggctggaatgcagtggcgggatctcatttcactgcagcctctgcctcccgggttcaagtgattctcctgcctcagcctcctgagtagctgggactacaggtgtgcaccactatgcccagctaatttttacatttttagtagagacagggtgtcgccatattggccaggctggtctcgaactcctggcttcaagtgatcctcctgcctcagcctcccagagtgctgggattacaggcacgaccaccgcacccagcctttatttactttgtatatctcatctattactgctgcagtttgcagaagagaggatgccctcaaacctaacttctccaaaccatcccaaatgggaagtctgctccacgtcaacagcattgttgcttttaaagactatacgtcaacatgccagattatagcaaaaggatgtcgagggagcaataggaaagcaagcctgagagtcctggagagaaggtggcagagctgccttttgaaggtggttccttcctcagaccctgcccttcctgccttgttcctccagttgccagatttgctgttggagctcctccacgggcgaagaggtgaggctggactgagagggagatggagaagctgccagagattcttttggatctagaattgagacagcagttccagccaggtccagaggtgggggctgtcacccagcccccaggggaatggtactgattgcagaatgtggcgagaactccctggctgggagagggaggtgcttgctcccttgaatcacctgagcccaggctggaaggcccaagggggaggacgaggccagctcactccagctccatcccctccctttaaccctaagctagttaaccctcccagactccagtcctttttcctaagtgccctccctgcaaagtctgcaccgagcagcgctccctcgcaccagctcaccctgcactgtcttgtctttcagcaaccccatgggtttgaacttgagacgattcatgttcctaaaagcctctttgggctgagggaaggcatgggtggctctgccagttttggagtgggggccgactcttctcagagccgctgcaagggccagggccaccctcccaggcgggtgtctctgggctgggcagcagctttgtaggcagcctgggtcatccccactggcctgggaagctgggggtgcaccggctcctgctcctgatagggccaaggcaccttccttacctaagagctgactttcttgaagagtgggcacagaggagccggcaacctgggctgtgtaggcacccaggagaaaatctgcagctcagtatcagaagtctccaccagcacggctgttgcagagatggggaaactgggctgagagggaagggggcttgcccaaatcaccagccctggaatgttttgagctttgggggtggatctcccaggaaacgtgtttttatggcaccaccgcctctggtcacccaccccgaggtgtggcgggcctggacagccagcttgactgagggccaggctggtgaagtcaaaactaccactcaggaagaagacctagcccttctccagacagagttcaaatgtgaggactgccttctttgggcctcaaattccccacgtgaattccaaggacccctctagctcctacactctgggccaaggtttcctctgagccgcagtcagcctagaggacctaggatacatcttccttggacagagacccaccataggggcagcaggaggtaggggtgggggtaggcaagattcctgtggggaggtggagctgtcatcagagatggtgtctgcaggcagtgggtgtatcgtggctctgctactacttgctgggtggccccatgacgtttctttccccactctgacctcagtttccctatctgttccgtggagataagatgcctgcctacatatttgtggactgggatgtgtgtgggccagttgcagtgtttcttggtgtggtcctggggcaggctgcaccaccccatagagatttctgggccccaccctaggctcacaggaccagaatctctgggaatgaagcctgggaatttgcatttccacaggcatctggctgattctgacatgactgaaaagcactaatagtatatagcaagctctttataaaaggtaaattcatagctgccttttactaaacataaatctcaccttcccttcctcagttaaggacacacaccgcagttgaaaatcactgtgcctttccagatgcagaatctgacctttccgataagattctgttaactgctgctttctgcagtttgtattccaaaacaaggggaatatgtttccattttttcaatacaaatgtttaagtcggatatgctttctcaaactggacacgcactcacacagcttagggtttcagctatggcttcctctcaaattattagcctctttctgccagggagcagtttttcccagacaagaccctggacagaggttggtggggccctcctcatcagaatcactagattatgactgacccctagaggtggcttttctgcttaagtgtcagcccatgggctgggttgtgacccccaaagctgcggcagaagcttccacccatcctgggccccccctgccatctatggggaaaggcctgtcccttgtcttctgggcccagccggcctcacaggcattcagcagattggaaagtcgaagcatgtgctgtgcttggctgggctctcctgcgcccctttttggggtgaggtggagtgcatccagcccccagcatccctgccgtttattcccacccctcatccccacccccatacacactcacaagtacaaacacaagcacagtcactggcacacaccactctggacagcaccatttccagcctcagcggggcagtttccttacagggaagttaatgaggcactaacgaaggctcaggggacagggggaacctctatcgagaagaggctcctagacctggttctgcctctgaattgctgggggtccttgagaaagttgctatccctctctggtctcagtttcctcaggtgagaaatggggggccggccaaatggtctaaggttctgggaacctctaaatcagagcccgtagctggtggtcaagatgagggagaggccctcagggtcagccgaatgcctgagaggccggacaggcccaaaggtgagcaacgtgagcacatcaggtgggctcagagctggcgcatgagccccacagcctgcagagcagccctgtactcgggagcccgctcgcaccaacccagtgggacttcagagatgtggggtccagcctttcctactattgctgggctgagggctgggagctgcagattctgaccccacagctgccttagacatgccagatggtctggggcaagacacacccctctctatgaaatgagcagccagtccaaataggtacattagagaagggctgtgggatggacccagctgtagcctggggctacagactggcttccggggtactcaagcagctggcctctggggtagcagccccaggtatgagaggcaggactcagaatctaggccaagcctccataggaatcccctctggagagcccgggcactctgcaggaggggcagcaggcagcaggtgcaccaggagcatgtttcacaaggtgcccaatatcgcatctgctcagataggcagcgagttggaaagtggatgcaataggcagggtggcggctgctccccacagccaggagtccggcccagcacccacctgagtccgcctcagtcctgctcaattgggttatccgtgctcttggccctctggtcccacccacagagggaggtctttggggcgaccaggtgagctggcccttgtgggaggatgtaactgactcctgagcctggcgagccaggcagcccctcgccaacgtccccacccctacctctccagcccccccgcattccctgatcctcccatccgctcccctgacccagcagttgcctctgctcactctcttttcctgctcccaggctcgcctggtcatgtgtccttcactctcctctgagtctccctctttccaagccgcctccactctacttgacacagtctcccttaagacaccagagtacacaagcgcaagtccctgcacctcacctttactcccagacatgggagggagatgacatgaagacccaaacgccacttagcaggagatctggggtatgcagaggggcagaacggaggctgtggaagctccaggggctcccttcaggaggccacatgtaagctggctattgaatgtggctctgagctgagacctctccttgaagctccagaccaggagccagctgatagctggacccctccatttggtgcctcagagaaactttgcactctctaggtctaactttgaacccagaaaattcccccatgtcggccctgtctcttcacagggaaagcaccacctcagacccagttctgcaccaaacccacatttgagtcacgaggctcctgccctgcactgtgagcactctggataagccagtgctgagggggaaagagctctgaatgccaagccaaaacatgagcttcaactccacctccagctctgagagctgtgggtagggaagggccctagtccagtttgctgtagaaagaccagtctgccactgtatggcacatggatggcaggggcagagtgcaggtggagagaacagaaggtgggcagggcgggggaggcagggacatggctgtagccgtggagatgggaggacagacaggacttggtggccacttgggtgaaccaagggaggagtcaggaagagacacccagttttgtatcagatgtgtagagcgtgggatgctgttcattgacggagggaggaggaggaggaagaggtatggcatggggaggaggtagctgagctctgtcgtgaatgtcatttgaagtccccagggaaagccaggccggccagcaccttcactgcttcagccagctctcagggtgtctgtgctccctggccctctcagctcctgcttcatagctgtcagctgcagtgggagacagctgcacaagggcccagcatgtctgtgtgtttacccaggggactgccgcatggcccatgccgagcagaaactgatggacgaccttctgaacaaaacctgttacaacaacctgatccgcccagccaccagctcctcacagctcatctccatccagacggcgctctccctggcccagtgcatcagcgtggtaggtgcagagggtacctgtggctcaggctcaggtgaagaggcagctcatgcccaagccctaagcagtcaatgtccagaggaatgaaatgactagagttgacttagactcaccggtacacggtggggaggctggaggagggtccatgaggtttataggtgtccagtatttaatgaggtcatggttttgttaacaaagaagaaatgagggtgggagcgagatcaccactggctaggcagccaatgggcctgcagagactctgctcagctgagtctccagcacgaccatgagcttctcatcctgatcctcccatccccaccctacttttctcccccagcttgctcaacaggtgaccttacaggctccctactctttgcagggaataagaaccagactgggggaactgacgggtacagaggcccaggtgtaggcgcaggaccacaggcagtgaagcgtctactgacccaggcgggtgagggtctggagagtgggcatggctgctgcaggcatggaaagcaggcacagatggcggcactcccagggcccattgtcagggtctccacatgtggacgtgtgcagaggtgggggtgctgagggaggaggggcagggaatttctcatcttctctctactgcctctgagttggagatgtcagagggagccatggcccactgtaaagtaacacaatgtccccacccacaggattagaacccctcccctggaagcagctctgaggggaacagtcacatgtagagagtgcagggcactgtgtccagccgggggaaggaggtcaccaagggggttgacccccctctggccaggtggctgccttctgacacaccagcctctgtctctagcacggtggcccccacacacccagcctgtgaaacctacagccctcaagaaggctttggccaaattaaggagcggctccctctcccaggaggaagcacaggtgaaggatgtggagggcagtagagttgtgtgtgctccgccccctttctccacagtcggatggaaagaagggggctttcagccaggctcgcccaggctggggtctgagtgtcactgtccagctattggcttcttgcttaatgggtgagcccagctgctcccgtgcagctgccgccctagtgagggtgaaccggcaggcgagttacatttctgaaagcctgggaatacagtaaatattaggctgtgggctgctgggccaggaagagttgtttatttttcagggtttgtttatctattgacttgatgagggagggttataggtacaaccagtttaaagatggaaattttgagagagcaggcagggatttagtgctgggtaagcctggtcaaagcggctcttttggggcggccagaatccagtaccaatgtcctcagcatgttcatcagctgctgggggagtgcgggacagcatgaaagcacaggagaactttctggatgatagaaatactctgtatcttcaaaggaggtgggttccatagtaatgttaaatgagttaaaactcatcaaaatgtaaaccagacctgtgcatttcactaatagaaattatacctccaattaaaaacatgttttaaaagacagatgggccggatgcagtggctcatacttgtaatcccagcactttgggaggctgaggcaggtagatcacctgagtcaggagctcgagaccagcctggaaaacatggtgacatcctgcctctattaaaggtataaaaaaaaattagccaggcatggtggcacacgctactcgggaagctgaggcaggagaattgcttgaacccaggaggcagaggttacagtgagcagagatcgtgccattgcactagagcctgggcaacagcgcaagactccatctcaacaacaacaaaaaaaggacagatgaaggttttcaactttcagtaaaggcagaggagcttgttacagattcgcctccccacaagagcagttagaaaaactggataaaaatgtgccccgcccccaatcaaaaacaattgttggaaggtaattggagacctcagtcaggacttgagtgaccaggcctaggaggtgatcctgacagtctgtagtgctttcccacatttggtgattggtcaacagtagagggctaagaggctaagaaactgagtatgaagtggtagttaagaggctggagagcctagctgaatgtttggcactctcacagggctgaaatgacctaatgagaatttgggtcccaggaaggagatgggaccttggtggggaccctggaagggccacccctgggagtccaaatgaataaaacatagaccagccatcagaaaacctaaaacctgctttgaaccagcttagtcccaaagtagatgaaggcgatctgcccttactccaattgtgtgccataaactcaaagtcaatactctctggaggcagataaaagtttactatgaatgtcaaaagacaacacaagactaaatgagaaagaccaagaagaaaactaatagaaacatacatgtaaggaagaaacttttttttttgagacggagtttcgctctgtcacccaggcttgagtgcagtggcacgatctcagctcactgcaacctctgcctcccaggttcaagcgattctcctgcctcagcctcccaagtagctgggattacaggcatgcgccaccatgcccggctaatttttgtattggccaggctggtcttgaactcttgacctcaggtcatccatttacctcggcctcccaaattgctaggattacaggcgtgagctaccatgcctggccagtattttgccacaatttaaaataaataaaatttttttttcaggtttgtgctcagactatattctaaacagtcacatggcggcttactcttctccaggccttgctgccggcttttacatgtttattgtctttgccttcttgtcatgtgctcattagatggcagcttccaggtgctcctaaggggccaggaaagagagtgagaaggcacggaggttgccagatcatcccccttggggccccgccctcatcaactccctcaaccgggtctcctgcaactattggtgggccatctcggccaccgcttcgccctgagcttcctgctgctgcagctgggcagtgcctccttctcagaggccagctgctgataggcggccacgtactgctgcaggtgacccaggtaatggtctcgctgctgctgcagactcagcctcttggctcttcagctccacctgcaggataggcgtcagggtaggtagtggctggcttccagattctgggcccataaacagggtagtgagggcactgcggggctctgtcgcctacccaggcccctggccctggccccttcctccaggcctaaatgactgcctcccttgcctagaggcccatgcctccctccccagcctcaaatctcacacccttcttcccaccatttaaactgtaggccacagactggtggaaaagcagagggagccaaccaccatctgctaagttgtggtgaggtcattctgtatgatctccagggtttgcacacacctccgcctgctccccccaagagctcggccttctgccccagcttccccagcctctcctccagctcctgcagcctcacctggtgttcctgcatcttctcctcctgctgccgcagcctcacttcctgctcccacatcttctcctcctgcctccgcatcttctcctcctgttcttgcatcttctcttcctgctcacacatcttctcctcctgctcccacatcttctcttcctgttcctgcatcatctcctcctgctctcgtatcttctcctcctgctcccatatcttctcctcctgctctcgtatcttctccttctgctcccgtatcttctcctcctgctcccttatcttctcctcctgcctccgcatcttctcctgttcttgcatcttctcttcctgctcccccatcttctcttcctgttcctgcatcatctcctcctgctctcgtatcttctcctcctgctcccgtatcttctcctcctgctcccgtatcttctcctcctgctcccttatcttctcctcctgcctccacatcttctcctcctgctcccgtatcttctcctcctggtcgtgcatcttctcctcctgcctccacaccttctcctcctgcttccgtatcttctcctgctcgtgcatcttctccttttgcctccatatctcctcctgctcccttatcttctcctcctgcctccacatctcctcctgctcctgcctcttctcctcctcccgtatcttctcctgctcgtgaatcttctcctcctgcctccacatctttttctcctgctcccgtatcttctcttcctgctcccgtatcttctcctcctgcctccacatcttcgcctcctgctcctgcctcttctcctgctcgcgtatcttctcctcctcctgcctcttctcttcctgctcccgtatcttctcctgctcgtgcatcttctcttccagctcccgtatcttctcctccttctcccacatcatctcctccagcctccgcatcttctcctccttctcccacatcatctcctcctgcctccgcatcttctcctccttctcccacatcatctcctcctgcctccgcatcttctcctcctgctcccgtatcttctcctcctgctcccgtatcttctcctcctgctcctgtatcttctcctcccactcctgtatcttctcctcctgcctccacatcttctcctcctgttgctggttcaggcggttccacaactcgttctcttccacctgggcttggagctttgctgacacactctgcagctccttacccaggtggtcagcctccgcctgcagctgctgctggaatagtgaaagtgtttttttgaacctcagaaggaagcagaatcatgagctagccacataaatgtaatctataggctgggagcggtggctcacgcctgtaatcccagcactttgggaggccgaggtgggcggatcacgaggtcaggagatcgagaccatcctggttaacacagtgaaaccccgtctctactaaaaatacaaaaaaattagccgggtgtggtggtgggcacctgtagtcccagctacttgggaggctgaggcaggagaatggcgtgaagccggggggtggagcttgcagtgagccgagattgcgccactgcactctggcctgggtgacagagtgagactacttctcaaataaataaataaataaataaataaataaataaatgtaatctataaaataatggttttcatccatgatcctttaaaaaaatatttttaagccctaactcttgagattctgattccccaggcagggccccaatttgtacatttttagtacactctagaggattctatggcgggaccagaacaaggacccaaattttccagctcttggctggagcctccccataccctgcatgatccctagaccatggtcccagctggatgggtctcccacaacccccggggctgcagctgctcacctgtggcagcaggagcttggccctctccagtttcctttttagctcctttacgttgagctggatctcagacttttcagattctacaagttgaagtttttcttgtagtttggcatttttctccttcagctcctcatcagttatgctatggccagaggcagtagagaaaggaatgaatgaagaacataaaagaccactttggtgattgaccccctaccctcgccccacaaccacagaaccgtggcgctggaagggaccccaggaattaaaagtcccaggtggcaggccagagagaagacatgagttgcctgaggctaccccatgagtcagtggcacagccagcactagagcttccgtgtgcacacatgaaaacatgtatgagccactccccacactcacctggaccccccacctcccagcacaccacccatgctaagggcccccagacctcccattccaccttcccccatcctacgtgttcctgtacagttccagactcagggcgtccctctcctttgttaactcctcaatgtactgcaaatagagaaaggttaagtcaggatagagcaggcacagcagtagctggacgaccaggaacaactgctacagtgactactccacagtaacacttcctcactctcaatcacacctgacgtgttctcaaggcatttccaagcccatggtctcatttgtttttctttctttctttctttctttttttttttttttttggcagagtttcattcttgttgccctcactggagtgcaatggcacaatctcagctcaccacaacctacacctcctgggttcaagcaattctcctgcctcagcttcccgagtagttgggattacaggcatgtgccaccacaccgggctaattttgtatttttagtagagacggggtttcttcgtgttggtcagtctagtcttgaactcctgaccgcaggtgatccgcccacctcagcctcccaaagtgctggcattacaggcgtgagcgagagcacctggccctcatttgtttttcaaagaactcagtggatgtggaagggacagggaaagagattgaatttagagctggctaacaggggcccagagcgatcagataatattgttattgttattactgttagtactaccattgttcgaacctttcttgagtgcttcaccaggcactatgctaacaatcccatttaatcctcacaacctccataggagacggttaccattattacctctattgtgtagatgaaaaacatgcggtattaaaggttaagtgctgcctaagatcacttggagctgggatttcaacacccaggtatatctgattctctaagcccattcttccgctggaggtaggggcacagttaagaaggaggaaattaatcctttgttgaatttttgaaaggatgatacgttcgcatagtccaaaactcagaaagtccagaagggaaatatctccccccaacactgtgcctctatcctgagttttttaatgaatccttacaaacgtgttttatgtatgttaccataatacgtacacacacacacatatacacctgccccctctctccacacaaataataacatactcaagatactcttctgtacctttatggtacaagtaccctaaccgccacttaggacttggccaaggccacagccaagtatgggcagggcgggcacttggcctctgagctctatgtccagtgctcgctcctcacagtgctccccaactcacccacaacagccgactcagccccagtctgcctctaacaaccacacacaaaagcagcaagaaatggccatgctgccttctgggcaggacactccatcctacagaagggacctttaggctcactcctccatctgcgaagctgggctcccaagggacggggccgtgtttggactcaccctatccgccttcttcttctgtgtagcgacagcagagagagcctgctctaactctcctgcaaacttccatgaatcatgcaggcggctgatcagatccctggcctctcctggaatgagagacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaattccagccacttaggaggctgaggcatgagaatggcttgaacctgggaggtggaggttgcagtgagctgagatactgctactgtactccaacctgggcaacagagtgagactctgtctcaaaaaaaaaaaaaaaaaaaaaaaaaggaattgtcatcaaagtcctacggctaaacccttttcctttttttttaataactagtattactagtcttttccaagaaccaaagttaaaagttagttctttaaaacaccaggccaggcacagtggctcatacatgtaatcacagcactttgggaggccaaggcaggaggatcacttgaatgcaggtgttctagaccagcccggacaacaaagaaagaccctgcctctacaaaaaaaaatttttttgctgcaaaatgctctcaattaacctgacaaaatgtcacatacagggttactacatcttttttatcatggaattttgaaaacaaaaattgttctattgaggcaccagtatttggatattagaggtaaaaaccacccttagaatccagtcctaaaaacgtcaatgaagactcccatgtttacaaattcttttatttctacatgtcatctatcaactggattatgaacctgaaagcctgagaacagaatttatcaagatactcatgtttatactttttttatctactgatcgtttttattttttttgagacggattctcgctctctcaccaggctgtagtgcagtggcgcgatctcggctcactacaacctccgcctcctgggttcaagcgattctcctgcctcagcctcctgagtagctgggactacaggcacgtgccaccacacccagctaatttttgtatttttagtagagatggggtttcaccatgttggccaggatgacctcgatctcctgacctcagcctcccaaactgctaggattacaggctgagccaccacacccagccatgtagccatctactgatatttctaagcatgaagtgacaatttttttttttgagatggagtcttgctgtgttggccaggctggagtgcaatggcatgatctcggctcactgcaacctccacctcctgggttcaagcacttctcctgcctcaacctcccaagtagctgggattacaagcgcacactaccacgcctgactcttttgtatttttagtagagacagggtttcaccatgggcgccaggctggttttgaactcctgacctcaagtgatccgccctcctcggcctcccaaagtgctgtgattacaggcgtgagccaccgcgcccagccgaagtgacaatatttatatacaataagcttaactctaagagcttacatttatgcgtagtcattcttaattgatgattagaggaagagacaaataaatggtcccagtttagctactgatatactcaacaaaccttgacggacctgagggcattatgctgagtaaagaaaatcatttccgaaggtcacatatcacttggtaatctcacagtaacaaaattatagagatggagaacagattagtggttgtcaggagttagagatggtggcagaagagaggcaggagagacatctttgtagtgatgaaacagttctgcataggaaattgtagtagtagttacatttacagacccttgatagaatggcacagaactacgcacacacattgtaccaacttcaatttctgggtttttatactctattataattacataaaatgtaaccactggggcagtatgcgcaaatacacagtgacctctctagtttctttacaacttcctgagagtctattattatttcaaaataaaaagttttttaaaaaattgcttcatgcctatctaatttcatgtgccacttaaaaaagaacacaaaaatagaaactgtaggaaattcatctgagtgcagcttatgcaagaaggggcaggataactccattctggacttatgctcaaagacatgcgcctttaccttacaacaaaactggcgaacaggcatgtgttttaagaataaaaagcttttaaggtatcatatattgttttttatagttcctttgcttaactgacgttttggtttgctaaaaaactaccaatcacatcagattacaagtactttcactgtaaaaataaaaagtgatgtgactgacacctcttagctctgtaacgtattactctttacgagagcagtgaaggaaaacatggtgattcaatcactccacacaccaagcagaaaagtgttgaacaggccgggcgcggtggctcacgcctataatcccagcacttccggaggccgagacgggtggatcacttgaggtcaggagttcaaaaccaacctggcccacatggtggagccctgtctctactaaaagtacacaaaattagccaggcgtggtggtggacacccgtagtcccagctactcgggaggctgaggcaggagaatggcatgaacccaggaggcttgcagtgagccaagatggcaccactgcactccagcctgggagacagagtcagactccatctcaaaaaaaaaaaagtattgtacaattaaactgtttatatgtaataaccacatatatatgcctggcataaaatgagccctgcattagaggttgctggatgtagggccctaggcctgacgtatccaaataatgtctatgataaagaagtcaataagtgctctctataacacacaagcattataagttttcacactccaaaaactcttcctttctaaagttactaaaacttttaagggcatttcaaacaaaaacagctgtggaaaacagatcggttaaatcctatggctaagaaacatcttcctatcccatgtattattcattacccaggtgtcaattctgtttccaatacaaaagtctcaagcagtgaagcgcttcccactccagctgggagagccatcctcaacaagataagggtaaaacctgtgagcacaaggcttccatctgcaattcctgtctgcagggaagctccccaaagagggaaaccatgtcttattccttacggtaaaacaccaccattcattccttgtgtttaacaaccaatgctggtggaacataaaacaaagcttagcaatcacttttttcatgctacttagacctgtaacacatttttcctctggtgcacactatccaaaacctagtcatttcccttactcctaggaggaatttagatgactttttttttggccaggtgcagtggctcacgcctgtaatcccagcaatttgggaggccgaggcaggcagatcgctttgaggtcaggagaccagccaggccaacacagtgaaaccccatctctactaaaaatacaaaaattagtcgggcatgcatggtggcacacacttgtaatcccagctactcggaaggctgaggcgggagaatcacttgcattcgggaggcggaagttgcagtgagccaagattgcgccactgcacgccagcctgggcgacagagcaagactccgtctcaaaaaaaaaaaaaaaaaaaaaaagactttctaatcatattggaaatgtgtaacaaggaccaagtactgtgtattaaacttaataaatcaaaacaacaggccctctaagatataaatggtgcttcactgtatgtttatctgcccaacccatcataggaactcaattcagcattaaactggttttagatcaagacactagaactcatgtttagcagttattaaattacaattattaagaaaaacactttattacgtaaagtcctttactccaaaaagtttctcaaaatacataaacactaatataaaacaattattaaaactttgcctgaatctcaggatttcagaaatatgaaagtactcatctctcacctctcccatccacttaaaatgacaaaacagatcattatagctaaatcaaaggaaatgtttaaagagaaacaaacccaaagagtaactacaccaattcttgacccaattctctgtactctgtcttatgtaacattacactatgaataacaatcccatcatccacaacagcttttttttttttgaaacagttttgctctcattgtccaggctggagtgcaatggcatgatcttgacccattgcaacctccacctcccgggttcaagcgattctcctgcctcagcctcccgagtggctgggattacaggcatacaccaccacgcctggctaattttgtatttttagtagagacggggtttcaccatgttggtcaggctggtctccaactcctgacctcagggcatccacccgcctcggcctcccaaactgccgggattacaggcgtgagccactgcgcccggccacgcaacacagctctaaacactggactctcatatctaccaacactcaatacctgtttaaaaagaaaaaaaaaattaggaaggggcaataacacttcagtgtaagtatccatgatcaactactgcttaacagcctacacgacttttgatgaacagtcaaggcacattacttaatacttaaaatggttaaccttagggagtaggaaaatacagacacacacaaaatatttcaaacacttctttttgctgctgataaggagttccaaaagtagtttttccaagccatttccaaataaaagtagattgggtgtaaataattgtctatcgaaatattagttattatttatttaataatgtcctgacaagcttgcagttatctcattaaatcaaaaaattaggatctaaggccaacattgtttcctcacattcttgatgtgaaaatctgagcactcctcttaataaggagttacaaagacaaaacaaacagctcaactgaactaactcttgtctctccagaaacacaaacacaagacctcataaaatgagtgagtttctataggccataattactgcaacttacttctccaattttcccctccacagttaactcaacagctcaaaaacgatcagtaacaaacaacagtcaccatgatatggttaggagtgtggcagatttcttaaccagtaataataaataggaaaaaaattttgcctattaatagatctcaagtttcgtgcacttgcaagaaactaattaaaaggcagccgcgcacgatctacaaaaacagccataaagactgttacattttaagttacaggaaataaacctgctcctctaattcagcaagatacaactgacttccccttacataccctaaaaaaaagccttacacgagaaatttaaacatggaagcagaaacacaccaagaaaaagacatgtcaaaccccacctgtatatctgttttcaaccatttggagtcgaggcgagcctgggcagccaaacagaaagattcagagggcatcttttctccagcttcctcccaggtctcaggcctgcaagtaaacacatacgctgaagacctaacgctttttaatagtttacaaagacactcccgaaagccagaaaagaaaaaagagagagagaacagaaaggggggagagaagagctggtggaggggagagaaagggagagagggaaagagggaagagatggagggagagggaggtggggaagggaaagcctccttccaaggtaggcagggtgtgccgagtttctgcaccacgctgacgagaccttgagaatggacggtcacaggaagccaagtcacaatgtcatccccctgccctcaaatccaagaagtacacacacataacagggagcccatcgttttaacgacaaatgacagcagcatgaatctgccgctttaccccacagcagggcgcgtgcgtgaaacaaaaaattactcaaaaggatcgcctgcagaaaaacccacagccaccaccacttaagagatggagagaggcccgaggctgccccgcgggtggtccgcgcaggccccggtgcggccgccgcgcccacgcccgcctcccgggctcggccgcccgccagccccgcgcccgtaccgcccccgccaccggccgcccaggtgccccaggccaggacctgacgcgcagggcccggccgcctcgcctcgccggcgcgcggacgcagcctcccaagagccgctggctcagccggcgcccgcgatcccggcgcctctcgcggcccgaggggcgggccgacgcgggactgccgccccccgcgtacggccaatcgcaacgaggctgctccgtgggcgcagccaatggggaagaggagcccttcgccgctcctcccgactctcccgcttccagcaatcccgcttatcttcctacttggagcgccctggctgcggccaaggccaacagcgggcgccggaaggcgggatttccgccgcacgcacgcactcccgcactcccacgggagactgcttggcccggagcgctcttgatcacgccgcggcgggtggtggcgctcacactaactatagctatccagggcgcgggtcgagtggcgagaccagctcccctgggtatgagaacgcatctttgtgcggtcggctggctggggcctgaagagcttcctcctgtgtgttcaactgaacgcagcaaaagtcttgggcagattccatggagcagctgtggaagcactgtgcagggaatcgaagaaggaaacacctccagcgaccacaaaacaaaattgaagaactataaaacaatataggccgggcgtggtggctcacgtatgtaattctcagcgctttgggaggccgaagcgggaggatccctcgaagccaggagttggaggatcccatgttgccagactgggcaacatagcaagaccccatctctaaaaaataaaaataaaaaaatttaacaattagccaggtgtggtggcacacacctgtgatcccagctgctcgggaggctgagacaggagaatcgcctgagcctgggagatcaatgctacagtgagcttagatcgtgccactgcactccagcctgggcgacagagtgagatcctgcctctaagaaagaaaaataacggccgggcgtggtggctcaggcctgtaatcccagcactttgggaggccagagcaggtggatcatctgaggtcaggagttcaaaaccagcctggccaacatgatgagaccccttctctactgaaaatacaaagattagccaggtgtggtggcacgtgactgtaatcccagctactcgggaggccgaggcaggagaatcgcttgaacccgggaggcggaggttgcagtgagccgacattgcaccactgcactccagcctgggggacagaggctgcaccactgcagccttgacttaccgggttcaggtggttctccacctcagccttgccactagctgggactgcaggcacatggaaccacacctggctaatttttgtagtttttgtagacgggattttgccatgttgcccaggctggtctcgaactcctgggctcaagtgatccgcccgcctcagtctcccaaagtgctaggattacaggtgtgagtcactgcactcggctaatagtaatgaactttgaacagaaggaaagttgttattattttcttggttatgttctatctatattttctaatttttctaaacatgtaaagataaaattctaaaaactcagacctcagaacaaaaaaattagagtataaatatttattttagttaacttgtacaaatttggtttctggaaaaagaatggaatagattttctgagaaaaaaaatccaccactttggccgggcgcagtggtttacgcgtgtaatgcctgcactttgggaggctgaggcggtggatcacctgaggtgaggagttcaagaccagcctgaccgacatgaagaaacccctgtctctactaaaaatacaaaaattagtcaggcctggtggcacgcacctgtaatcccagctactcaggaggctgaggctggagaatcgcttgaacccaggaggcagaggttgcagtgagctgagatcgcaccatagcgctccagcctgggtgacaaaaggaaaactctgtctcaaaaagaaagaaagaaaagcagactggctgaaaggattgaagaacaaaatatgatccaccaatgtgctatctacaagataaacattttaaatacagaaacagattgaaagtaaagggatacaaagatacaattaaaatagtaaccaaaaaagagctgaaggggctgtactaatatcaaatgtaatacactttaaattaaagcagggctgggcatggtagctcaggcctgcaatcccagcactttgggaggtggaggcagagagacacttgagcccagaagttcgagatcagcctgagcaacatggcataatcccatctctacaaaaaatacaaaaattaggcgggcatggtggtacccacctgtggtcccagctatttgggaggctgaggtgggaggatcatgtgagctggggaagttgaggccgcagtgagctaagatcgggcccctgcactccaccctgggcaacagagcgagaccctgtctgaaaataaaaaaaaataaaaaacggggttgagagacaaaaaaggacatccttttttttattattgtattttgagatggagtttcgctcgttgcccaggctggagtgcaatcgtgtgatcttggctcactgcaacctccgcctcccgggttcaagtgattgtcgtgcctcaggctcccgagtagctggcattacatgtgcctgccatcacgcccagctaatttttgtattttggtacagacggggtttcaccatgttggccagggtggtctccaactactgacctcaggtgatccacctgccttggcctcccaaaatgctgggactacagacgtgagccaccgcgccagccgaaaccttcattttaaaaaaggctgggtcaggcatcatgcctcatgcctgtaatcccagcactttgagagggcaacgcaggcggatcacctgacgtcaggagttggagaccacactggccaacatggtgaaaccccgtctgtaccaaaatacaaaaattagctgggcgtgatggcaggcacatgtaatgccagctactcgggagcctgaggcacgacaatcacttgaacccgggaggcggaggttgcagtgagccaagatcacacgattgcactccagcctgggcaacgagcgaaactccatctcaaaatacaataataaaaaaaaggatgtccttttttgtctctcaaccccgttttttatttttttttattttcagacagaattccaccacagtggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggtgaggaacattgaagtttctgagatattccttaaggaccaagctataattcacagctatctatttacatcagatctcagctttttttttttttttttttttttttttttgaggagggtgcaggaggagatgtgcgcagaacatatatatacggcttgccctaaaggatgaaataaaattgtgtatgctatgacctctctaggaagcctctaaacttttcttataaattgtcttctaactaaaatatttcttttggccgtccttggagtactcccaggtgacacacagctcgggctaacatttctacaggactgctaccttgatctctagagagtccaatgatgttccataccaatatgtctcagcgtcactgccgagcttccacccacacccttaacacacagagaaagctgacactttctgttagctataattttccttgagaaaaacgtggcaatatgtagcaaaatacaattattagtttcaatatgtagaacgtattacaagaaaaaaaagatgccaaaaacatcttatgtctactgctattcctattagtctttattatcatgaaaaactggtcgcatcctaaatatccaactttcggtgactgggtgaaggaaaactgtaatttttccatatgatagaatagtatgccagcactaacaaccagatagcagactatttaatgtcatggtaaagtatttgttttgtgtggtcaggtgagcagttcagatcataaaatcaaatgtaccctatgatcttattttttgaagtaaagtactgatgtatttatatgtataattaagtatagagaaaagcctagatggcttctcttataagtcttttcattgttttataaatggtatcaatatttatttttcactttttccatcagatttcctagaataataaaattcaattccctctgatgagcattcattattcttttttttttttttttttttgagacggagtctcactctgtctgctagagctagagtgcagtggcctgatctcagctcactgcagcctccgcctcctgggtcattattcttacagtaagaaaaaatgaatgttactaagtatcttctctgtcctagatcaactaggtatatacaaggtgccaaatacatttaataaaatgttttattcattcatagctttttgcagtacaattttttttgtatgattcccttgtcctatcatctccaccaatagttttggtgtgaatttatactctaaaggaaaggtgacaaccttatacaatctcagggcttaaatactatccacgtgctgatgcttacaaacatacacctccagttgtgtggtctccctgagttctgcacatccctcttgggcatctaacaagcatctcacagttaacaaaaccactgatttctaatcaatcccagggaccctccgccaggcctgctcctctctcagaattccttttctcacttagtgacactatcatcccaccaaacctcgctatcatctttcttccgtctcccaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattcattagattttattcttgtaaaaaaagagataatttaaaggaatctatttttaaatactctgaggagggtgatactaggggtgctggttgtcctgttttaactttgtcttaatttctaatgtaattaaattttgagtaggtaatgtgacctgtgtggtttttattttaaaaaatatattgaggttttatataatctatttttaaaatattcaatggaaacttgaaaacatactgtttcacatattctcgtatatatatattaaaaatctttttttatttattttttatttttatttttttttgagacggagtctcgctctgtcgcccaggctggagtgcagtggcgccatctgggctcactgcaagctccgcctcctgggttcacgccattctcctgcctcagcctcccgagtagctgggactgcaggcacccaccaccacgcccagctaattttttgtatttttagtggagacagagtttcaccgtgttagccaggatggtctcgatttcctgacctcgtgatccgcccgcctcagcctcccaaagtgctgggattacaggcgtgagccacttagcccggcctaattatttgttttttaaaagacggtacataggaagaagtaaatcaggaaaagtggatagtgattggtggcagtagaagtgagtcagtgttacagttactattgctgcttaagaaactaacccaaatggcctgggcgccgtggctcacgcctgtaatcccagcagtttgggaggctgagacgggcggatcatgagttcaggagatcgagaccatcctgcctaatacggtgaaactctgtctctactaaaaatacaaaagttagcctggcctggtggtggtgggcgccttaagtcccagctactcgggaggctgaggcaggagaatggcgtgaacccgggaggcggagcttgctgtgagccgagatcgcgccactgcagtccagcttgggccacagagggagactccgtctcaaaaaaaaaaaatttaaaaaaagaaaaagaaaaaagaaactaccctaaatttaataaggtaaaacaacgaccacttcattatatctcatggatcctataggtgagaaattccagcaggattcatctgagtgattcttcctctctcacatcattaactagggtgactcagtgctagtcggctggcaaacaagtcagtctggaaggtgcaaggtgctttttttctgtcttataaattggtggagttgtctggaaggcaaggctcagatgggaaggactcttagttatagtgcctgcacagggtaaactttttttttttcttttttttttgagacggagtctcactgtcccccaggctggagtggtgtggcccgatctcggctaactgcaagctccgcctcccgggttcacgccattctcctgcctcagcctcccgagtagctgggactacaggcgcccaccaccaggcccggctatttttttgtatttttagtagagacggggtttcaccgtgttagccaggatggtctcgatctcctgacctcgtgatccacccgcctcggcctcccaaagtgctgggattacaggcgtgagccacagctcccggccaagaaggctctcttaaaaggaatcacttcttgttttcttacaagttataacctcactaccctagagtcacatttttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcacagtaaatgagtgaatttagaaattaaattttaatatgaaaggttcatgttgtcaaaactgactatgttagtccatctcaatgctataaaggaatacctgagactgggtaatttataaagaaaagaggagtatttgggctgatggtttgcaggctgtacaaacaggccaccagtatctgctcagcttctgctgaggcccgggaagctgacaatcatggcttaaggcaaagggggagctggcatattacatggggagagagggagcaagggagatgccaggctcttttaaacaacaagatctctcgtgaattcatagagcaagaactcactcattaccaggaggacagcacaaaaccattcatggggatccacccttgggaaacaaacacctattactaggcccacctccaacactggaggtcgcatttcaacatgagatttggaggggacaaaacatccaaaccgtatcactaacggaaaattattgtttaaatttctgtattcagtcccttggcctttttgagaaatgccattcatttcagccatcaagcaaattattatttgagacatttatacctcttcatcctttaaaagtttcagaagcatgaatttaaaaagtattcattgtaaatttgaggctagtcaaattgatgtggcatctaagtagcacggtgatgggatgaggagacaaagtcacgagggaaggtaggaagaagcagagagaaaaagagaaataggaagagagaaaaagaaatgaggagagagtataagaaaaataaagaagaaagaggaaaagaaaaatggtttaaatgagaggcaaatgtcatctgatgttttaccatggggccatagggtatttgaagattcagaaaattcgtaagttattaaaaaatgtgactctagggtagtgaggttataacttgtaagaaaacaagaagtgattccttttaagagagccttcttggccgggagctgtggctcacgcctgtaatcccagcactttgggaggccgaggcgggtggatcacgaggtcaggagatcgagaccatcctggctaacacggtgaaaccccgtctctactaaaaatacaaaaaaatagctgggcctggtggtgggcgcctgtagtcccagctactcgggaggctgaggcaggagaatggcgtgaacccgggaggcggagcttgcagttagccgagatcgggccacaccactccagcctgggggacagtgagactccgtctcaaaaaaaaaagaaaaaaaaaaagtttaccctgtgcaggcactataactaagagtccttcccatctgagccttgccttccagacaactccaccaatttataagacagaaaaaaagcaccttgcaccttccagactgacttgtttgccagccgactagcactgagtcaccctagttaatgatgtgagagaggaagaatcactcagatgaatcctgctggaatttctcacctataggatccatgagatataatgaagtggtcgttgttttaccttattaaatttagggtagtttcttttttctttttctttttttaaattttttttttttgagacggagtctccctctgtggcccaagctggactgcagtggcgcgatctcggctcacagcaagctcccgcctcccgggttcacgccattctcctgcctcagcctcccgagtagctgggactaaaggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttaaatacagaaacagattgaaagtaaagggatacaaagatacaattaaaatagtaaccaaaaaagagctgaaggggctgtactaatatcaaatgtaatacactttaaattaaagcagggctgggcatggtagctcaggcctgcaatcccagcactttgggaggtggaggcagagagacacttgagcccagaagttcgagatcagcctgagcaacatggcataatcccatctctacaaaaaatacaaaaattaggcgggcatggtggtacccacctgtggtcccagctatttgggaggctgaggtgggaggatcatgtgagctggggaagttgaggccgcagtgagctaagatcgggcccctgcactccaccctgggcaacagagcgagaccctgtctgaaaataaaaaaaaataaaaaacggggttgagagacaaaaaaggacatccttttttttattattgtattttgagatggagtttcgctcgttgcccaggctggagtgcaatcgtgtgatcttggctcactgcaacctccgcctcccgggttcaagtgattgtcgtgcctcaggctcccgagtagctggcattacatgtgcctgccatcacgcccagctaatttttgtattttggtacagacggggtttcaccatgttggccagggtggtctccaactactgacctcaggtgatccacctgccttggcctcccaaaatgctgggactacagacgtgagccaccgcgccagccgaaaccttcattttaaaaaaggctgggtcaggcatcatgcctcatgcctgtaatcccagcactttgagagggcaacgcaggcggatcacctgacgtcaggagttcgagaccagactgaccaacatggtgaaaccccgtctctaccaaaaatataaaaattagccgggtgtggtggcacacacctgtaatcccagctactcaggaggctgaggcaggagaattgcttgaatctgggaggtggagtttgcagtgagccgagattgtgctaccacactgcagccagggtgacagagtgagacgccatctcaaaaaataaataaaggctgggtgccagatgtggtgcataggcctagtttgttgactcctgtacttaacatataaaactctaaagaacagtgggaaggagcttccctctagaggcacaggaccggccaagttggtccctgagcagtgactttataataacatgttacactgtgttttttgtttttgttttgttttttgtttgtttgagacggagtttcgctcttgttgcccaggctggagtacaatggcgtgatctcagctcaaaacaacctctacctcccagattcaagcgattctcctgcctcagcctccaaagtagctgggatttcagtcatgcaacaccatgcccggctaattttgtacttttagtagggatggggtttctccatgttggtcaggctggtctcgaactcctgacctcaagggatctgcccgcctcggcctcccaaagtgctgggattacaggcgtgagccaccacacccagcctatattttttttctttttttttagacacagtctgactccgttgcccaggctggagtgcagtagcgcgatcttggttcactgtaacttctgcctcccaggttcaagcgattctcctgcctcagcctcccaagtagctgggattacaggcatgcaccaccacatccgactaatttttgtatttttagtagagatggggtttcaccatgttggccaggctggtctcaaactcctcacctcaagtaatccgcccgcctcggcctcccaaagtgctgggattacaaggcgtgacccaccgggcctggccctgtgtgttgttttatgtatgtttctatatgtgttatatttcacaataaactaaatattaaaacaaagaataactgatagctatgcacaaaggtatttaaatttcaccctcacaaataattttttttttttgagacaggatctcactctgttacccaggctggagtgcagtggcaccaccttggttcactgcagccttgacctcccaggcccaagcgatccttctacctcagcctcctgagtagctgggactacaggcacactccaccacacccacctaatttttgtatttttggtaaagatggggtttcaccatgttggccaggctggtctcgaacttctgggatcaaggaatcctccaaccttggctttccaaagtgctggtattacaggcgtgagccactgtacccggccaagaatagtttcttctccttacctaggtagagacctctgcagaaatgctgggagatctttggagaggggagattttttaaataaaaaatttaatacttggaggggcgtggtggcttacccctgtaatcccagcactttgggaggccaaggcggacagatcaggaagtcaggagattgagaccaccctggctaacacggtgaaaccccatctctactaaaaaaaatacaaaaaattagctgggcatcgtggcgggcgcctgtagtcccagctactcgggaggctgagtcaggagactggcgtgaacctgggaggcggagcttgcagtgagccgacatcgggccactgcactccagcctgggcgacacagcaagacttcgtctcaaaaaaaaaaaaaaaaattaatactttgggatgccaaggcaggtggatcacgaggtcaggagttcaagaactgcctggccaagatggtgaaaccccgtaaaaatacaaaaatttgccgggcttggtggcaggtgcctgtaatcccagctattcaggaggctgaggcaggagaattgcttgaacctgggtggcagaggttgcagtgagccaagatagcaccactgcactccagcctgggcaataagagtcagactctgtctaaaaaaaaaaaaaaaaaaaactgatctagttcaaaacctcactttgaatccacccacattgctctaaaatactttcatctttcctgtggctaaaaccttaaagccttgccagtaactcccattgcacttaaggaaatccaatctcccttgttgtggcccctgaacaggctgctgctggcccaccacggtgcctctagtttgtgtaaaatgcatatgttaatttataatatatgaggcttttttagctctaaaaggctattattcactagttgctgtgtgaatcagtatttctgggtgcagttagaaattattagagttgatgcccaagactcatctccatcagcacgggggaggcatctgctcgttttatggtcagtgactctgggcctcctgctgggctaagtcctgaggtgggtctgactcaggtcagagctgtgcaccccggccctcctcctcaacgtgcatgagtgctctttaggatggagctgaacactggcttctcaaaaccacttggccccatcacaggccctgagaactgattgggtcactctggtgggctccccagccctagccaagaagggtttctctagggagcctggccccccacttatgagacctggagccccaaagatcctgaccaggggcctgcctcctccagggagcggccactcgcccccaccaagctcccttcacagagacccatccaacagagctgaggaaaaccatgcctcataaatgaataaatacataaataagaatgccggggacctgtggattttgtaattcctgaaagaaggcagagtggctggctcacagcaagcgcagtaggagatactgctccccggccaggctgttctctgtctctttggagggagccctagggtacaagaaaagccagaggagaccagctggcccagaaggtgcctctccaccccttccccagagtttctgggaaacaaagcccacccgagggacacatgccttcttgggagttgtaccaggcctccttcctcatccagccatgcagtggttttcagtgcccgaaacagatgaataaaataggccctttacgggatgttcttcaggaacatgcacacttctttggatcttaccatcgttttatctctatttaaagttaaatgctgtgttatacagagtattggtaaagatgtagagctacaagaactgtcaagctggcagtagcataaaattgtataagcacattggaaacctgtttggcagcttctactaaagctatatctatgcctaccttcagaaattccatcctaagcatgtacacaagagaaacgagtgcatatgtccacaaaaagacttatataagaatgttcactgccatttttattcataagagccccaaatgaaaacaacctaaatgtccatcaacaggagagtgaataaatggtgatacagtcacatcatggaatactacacagccaaaaaagaaaaatgaagtggtaggaacactcaacgacatgggtgaatagagggagccaggtatgagagacagtgcacagtaccagcccacctagatgaagcgcaggaaggcagaactgacgatgattgaagtcagaagggtagtttcctttgtgggaaagtgtaggtcaggaaggagccttctggggtactacaaatctgccgtattttggctgggtgcaacagctcacaccagcacttcgggaggcataggcgagagggtcacttgagcccaggagttagagaccagcttgggcaacacagcgagatcccatctctacaaaaaaattaaaaattagcgtggcatgctggtgtgcacctgtagtctcagctactcaggaggctgaggcaggaggattgcttgagcttaagagtttgaggttgcagtgagctcccaaagtgctgggattacaggtgtgagacactataccagcctgatttttaaatactgaccaagccttgtgttactgggataggcatcacttggccacgatttactactctctttctttcttttttttttttttttgagacagaatctcactctgtcacccaggctggagtgcattggtgcaatctcagctctctgcaacctctgcctcctgggttcaagcaattctcctgcctcagcttcctgagtagctgggattagaggtgtgcaccaccacacctggctaattttgtttgtttgttgtttgtttttagtagagatggggtttcaccatgttggccagcctggtctccaactcctgacctcaagtgatccaccctccttggcatcccaatattcctatgattacaggcgtgagccactgcgcccggccctattctgtttctatattgctaaatttgacttgctaacacgtttttgaggatttttctgttgatgctcatcagggatgttggtttgcagttttctttctttgtattatactatctcgtctggctttctgtcaggggaaagctgaccttatacaaagtattggcatgtgttccctccttttccattttctctaagggattgtgtagaattagtgttatttcttctttaaatgtttttgaatccatctgaacctggagatttctttctaaaagattttacgccgggcacggtggctcgtgcctataatcccagcacgttgggaggctgaggcaggtggatcacctgaggtcaggagtttgagaccagcctggctaacatggtgaaaccccgtttctactaaaaatacaaaaaattagtcgagcttggtggcgtgcgcctgtaatcccagctactcaggaggctaaggcaggagaatcacttgaacctaggaggcagagattgcagagagctgagattgcaccaatgcactccagcctgggtgacagagtgagactccggctcaaaaaaaaaaaaaaattttttacaaattcaatttatttaacagatacagaactattcaggtaacctgtttgtttctaggaggattttcctggtttgtggcactcggacattgctttatttcatctaagttgtctgatttttaagtgtcaagttttccttagtgttctcttgctaaccgtctgaagtctgtggggcctgcagtgatgtcccttcattcattcctgatactgataatttgtatcttttctgtttttttctttgtcagttttcctagagtttttcaattttgttgatcttttcaaagaatgatctttaagtttcattaatttttcccttctttttttgctttcaatctcattagtttctgcttttatcttggcatttgttcctttggcttgttttgcgttcactttgctctttttctggtttcttaaggtggaaacttagattgctgatttagacctatcttttttgtaatatataatgatttgatgctataaattttcctctaagcagtgctttaattaaacccacaaattttggtgcattttcatttatgttcaaaatattttctaatttcttttgagaattgttctttgacccatggatgatgatgatgattattattattattatttttcttcaatacggagtttcactgttgttgcccaggctggagtgcaatgacatgatctcggctcactgcaacctctgtctcctgggttcaagcgattctcctgcctcagcctcctgattagctgggactacgggcacccgccaccatgcccggctaattgttttgtattttcagtagagatggggtttctccatgttggccaggctgatcttcaactcctggcctcaggtgatccccccaacttggcctcccacagtgttgggattacacgcgtgagccagtgcgcccggcctgacccatggattattaagtatgttgttttattttgaagtgtttgcagattgttttgttaatgatttctagtttaataccattgtgattggagaacaaactgcatatgatttcatttcttttaaatttgttaagatttatgtgtcaggttatgttctcagtgaacattctgtatgtgcttaaaaagtatatgtatggtctgtatatgtatggtctgtatatacatatatgtatacatatatgtgtaaaaagtatatgtatggtctgtatgtgcttaaaaagtatatgtatggtccagcactttgggaggccaaggcaggcagatcacaaggtcaggagatcgagaccatcctggctaacagggtgaaactccgtctctactaaaaatacaaaaaaaattacccgggcatgatggcgggcgcctgtagtcccagctacttgggaggctgaggcaggagactggcttgagcctgggaagcagagcttgcagtgaactgagatcgtgcgactgcactccagcctgggcgacagagctagactccatctcaaaaaaaataaaatttaaaaaaagtatatgtaaagtgtatgtatggccgggcacggtggctcacgcctgtaatcccagcactttgggaggccaaggcaggtggatcacgaggtcaggagatcaagaccatcctggctgacatggtgaaaccccatctccactaaaaataaaaattaaaaaaataataataattagccaggcgtggtggtgagcacctgtagtcccagctactcaggaggctgaggtaggagaatggcgtgaacccaggaggcagagcttgcagtgggctgagatcccgccactgcactctagcctgggcgacagagcgagactctgtctcaaaaaaaaaaaaaaaaagtatatgtattttgctgttgttgggtgaagtgttctataaattagatccagtttattgaaggtgttctacagttctcctagatttttgccgattacttgttctctcactatgaaaggtattgtgtgtgttatatgtgtctaacaattcattgtctagttagagttgctattataccacttcaagtggatggagagcctcactgccatccattaatgtgcattaatcattttgagagtgaaaagattttttaaaatgtttttacttttttaggtatggccaagtgagatggggctagtgaaatgggtgggagaattggaagctgatagtgtgtgagctagacacccatgaatgcttttccactgggcagttagagggatgataggtaataatataaggcagctccatcacacaagctggtgactcctgtgcgacagaccaagagctgcatttggagattcatttccgattgttgcgtttcctcttagagcattgcttggtcatcgtgttctgagtggtccattggcctccatgtcccttttggggtggatatttgctcagtgacttttgagcagctggatctcctgcttcggcaggtgagtgaggggatggatggctccgcggactggcccccgccccaggagaaagagtgcgtggccgtggcaacgttgaatcttccccgacttcaggtattcgtgatttcccttcctcttgctccttttataagtgtcttagcgatttgtaagaaggtttatgtattctgaaggacataggttttagcctgttgggggaagtattttaaagtaagattgtaatgcactaataatggacgcaaggcttaaaaaacttgatctgtttattttatgtttgtcctggaagtcagcctcggcatgcaggaagagtgtatatggattgtgttatttttgctataatcattagtttgttggtattcttactgttttactgttggtgcgtgtggagaaatgactgggtgagatcacaggtgatggagagagacagagctcagctgagagaccagtgctggcctgtctctcctctgtcctgtgaaaaccctgctccaggagggtccagtcttttggtttccctgggccacactggaagaagaattgtcttgggctacacataaaatacacttatgatagctgatgagcttaaaaaaaaaatcccaaaaatatctcatgatgttttaagaaattttactttgggccacattcaaagctgccctgggccacatgctgccctcgggccgtgggttgaacaagcttgatctactcagtaagctcggctcccaaagcaataccttcctttcctcaccatgaaggctgtggttagggtcacaataaaagctacaaaagccttcctccctagcaaaactaaagctgaagtgtttgatcatcatcttttgtctttgtaataaaaccctctaacttaatgacaagaaccacggttttctcgacatagtaatttttcccttttattacagtggtttcttgtaacaacccgtcatgtccctcttccagcccctcccctttttgccctgcttctagaatgtacagaactgagtgtagtgtttagttgcagtaatgaactgagcagaggtctggagcatgcttctcctctagtcctctgtagcactcatttatcaccatacctgtggcatcctggcgtttgcgtggttgcgccccaggtgtttgctgcccctcctggtttgcggtgatgtgtctgttctggtcagtgctgtggggcgtggccttgcgtatgtcttaggctgtcgaggtgtcccagcgtatggttttgcatttgcctctccggggtcctgagggttctgtaggtttcacagactccaggtgagtttcggtggtcatttcctgacctgtgatatctatacctagatgagtggtgtgcttttgatttcacttctactcacagggcaaggccgggtctctgatttctcatggggcctcttgctacccagagcctgggacgggcagtgtgttgccccctggctgcggttggctggcaggcaggtgatcctgagtggctcccagccttctgcaggaagctcgggttcagtgggtccttgtgtgcattcccgtgtgggaggttgtgctgaagcctggcggcttggctctgctttcagagcccggaacctcttgactcctgctgtgtgtgcccatgtgaattttggttttgcacttgaggagtttccctgtgtactctcagctccgcagtctaatttttagcagctcttttttttttttagacagggtgtcactttgtcacccaggctggaatgcagtggtacagtcttggcctgccaggttccagtgattctcctgcctcagcctcccaagtagctgggactacaggtgtgtaccatcacacccggctgatttttttatagagatggggtttcatcatgttggccaggctgatcttgaactcctgatctcaagtgagctttcccgtcggcctcccaaagtgctgggatgacaggcatgagccaccgcctgtggcagcttttgtggttacattgtagccattatttctgtgtttggtgcagattgttggggcggggtggaggttgctgttgctagttgtttagctcttctgctcatcttgagcttttccatatatatgttcatagcggggttaaaaaaaattcctctagaaaatatttcaactattgtgggtaagagtttttttagtccagtttttaaaaatacgtaaactgagaagttattttgtctatttaaataatacttcaaattgacttttattcagtgtttaataagactttgaaattcactcatttttaggggttctaagtgaaaattgtttttctcctttcagttgcatgctgccattagtcaccaggttgacctggaattccttggtttaggtctgggcagcgtcttcctgaacagcctgaagcagaaggtggtgaccctggcaagcagcgcagacgtgctgagcaccgtgcagtcggcctcccaggccatgctgcagagcggctggtccatgctgttgcccaccgctgagaagcaggcccgggcactctgctctcctgtcctgtggaggtgggctcggggaaggaacaggagagggcatgggtcagggtgctgggaggggatggcgtttcactcaaattggcacagactttctatttcagtttcaggcaatgaagtgaacataagtccaggtcatcgattggtgattgatcttctggtgggcagcttgatggctgatggagggttggagtcagccttacacgcagccattactgcagagatccaggtatggccttggaggcacacgtgacctggtggtgggctgagatcggaaataccacactcacacatgtgaagaataactgaaaacagtaaaacactaaacttatatccaagtatttttttaaattaaaattcttttatgtgctaattttaaaaattattgagatgatttgtgataaaatactgcatgttgtctgtttcagtgaagttaacaggtaacctgttcctcatgtagaccattcccgtcacccggaaagatccctgtgctccttggcacttgcagccaggatactcccctgccctgagattagattcatttttcctgctctgagtgtcgcagcaatataactgtatagtatgcactctttcctgctttgccttggagaatgattttcagattcactcactgttgtgtgtattgcgacttcgtttttattattgggaagttttccattttataggtgtagtactgtttgttagttcattctcctattgaaggacatgtaattgtttttggtttttgttttctttttttttttttttttttgagacagggtcttgctctgtcacccaggctgtatacagtgacctgaggttggctcactgcagccttgtcctcctaggctcaaatgatcctcccacctcagcctcctgtgttgcagggaccacatacatgtcaccatgcccggctagttttttgatttttttgtagagacaaggtttcactgtgttgcaaggctggtcttcaactcctgggctccagtgatccccccaccttggcctcccaaagtgttgggattacaagcgtgagccaccgcgcccaggctttctggtttttggccgtgtagagctgccacaattgtgctgtgaacaagtactttagtgaacatatgttctccctttggataaacacttggagtggaatttgttaggtcctggggtaagtgtgtgttcatagtttcccaaagtggctttgccatttgcatttgaaccaggacttttgtgtgtgagaattctagctccttcttgtccttacagagcagctggatgctgcgtgtgtggagccgatcacattgggttttgtgtgagccattagcagggttaaggattttagggacttcacagaaggaggctggagagcatcagcagaggcagcctggaccttggatctgtaaaaagaagacactgtttgaaactgcacaaatgagttggggtttccaacagggcaggtggggggcctgtgggtggatgggtgtggcagccacagaggctgggatagcttggcactggggtcagggctcagccagcctgtgtgccttcacacctggtaatgagatcacttgtaaacaatttctgtttgtcaattacaggatacaaaaaaagaagcacggaaggaaaaagaaatttatgaacaggaggcaaatgcctcaacatttcatagaaggaggactccattggataaagaccttattaatacggggatctgtgagtcttctggcaaacagtgtttgcctctggttcagctcatacaacagcttcttaggtaaatcatattagctgtattgtattgtgttttatttatttacttttttttttttgagacagagtttcgctcttgttgcccaggccggagtgcagtggtgcgatcttgactcactgcaacctccgcctcccaggttcaagtaattcctctgcctcagcctctcgagcagctgggattacaggcatgcgccaccatgccccactaattttgtagttttattagagacagggtttcttcatgttggtcaggccggtcttgaactcccgacctcaggtggtccatccactttggcctcccaaaatgttgggattacaggcattagccaccacgcctggcctatttatttacttattaatggtgttttttgttttttgttttttttttgagatggagtcttgctctatcgtccaggctggagtgcagtgtcacgatcttggctcactgcaacccccgcctcctgggttcaagctattctcctgcctcagcctcccgagtagctgggactacaggcgtctgcaaccacacctggctgatttgtgtatttttagtagagatggggttttaccatattggtcaggctggtctcaaattcctgacgtcaggtgacccacctgccttggcctctcaaaatgttgggattacaggtgttagccactgttcccggcctgtattgtattttaataggtgattattggttttcatattaagatagtgaaatctagcgcaagggtctcaaaaatttgtttgatgattgaaggaatattctgaaaattacctagtatagatgttaggataaagagcagacccttctcaatataggtgagaggagaagttggagggtgtgatgatactcagaagtttttcacagaagagaaattggggcgtgcagtaaacatgtaaaaagattcttactaataagcaggtaggtgcgaatgaaaatcatcatggaaggttatttttaaaactggttctatcattgcctcactttacatattacagagttgtacctactactttgtaagataacttttcttttcaaaactgaagtcaatgtgatagaatggtgagcattattttggaaggccagactaggaggaggtgggaggaggaagtcagactcagcctgtgaacagacgctaaccttggcagaagccaaaacagtcagacagtgttgtgtaaaaatgatcattcaagaagagcgaaacagcaaggtgatttgtgaaagagatttattagaaaatgaaacacatttatacctctgttcaataaaaatctgcttttcgtcaactgatgctcctggtttttgtttctacacatagagaaagcagagccctggcagcttgggtcaggcagccgagtacagaccagggagccctgggcagtggctgcagctctcagctggcctgttcatggggccatggtgggtctgtggcgtggggtgggcccgtggcgtggggtgggcccgcggcgtggggtgggcccgcggcgtggggtgggcccgcggcatggggtgggcctgctgtccacagccagcaaaactaacttagtgcacacacagtgaaattttgaaacaggaagttttagagctagtttctgtcatagattttagtaaatgctattttgcaaaacctttttctgatgtttgttttgtttttctaatctgataatgcatatttcacacattctggtctttaacaaatggaaataaagagaactaaacaatatagtttgtgtcgatggaaagagcttgggatttgttctcagaaaatttcagttacaacagtttgttcatataggtggacttccaacacagtaactataggagtaagaataaaagctgtgtttactttcacagagttaattaagaatacatgagaaaatggatgttaaaaaccttgtaattaaaatgtacagttacatgcaaagttttaaagtgagcattttccagaggtgcttttctaagttcttgaatgcctctcccttttctgaagtggctgcttcgtggggctgttggtctttggcagggggtgagtgcagggttcctgttgtgggtcctttgttctcacgagggcagtgcccgttttccccgtctcctgcttgcccagactgttcccgtgcgcagagagactggcctgtttgacctgcagctgtgctgtttgagctgcagctgtgtagcctgcgctggcccatctggctacactcaacaccgtttgctgatcagcacttgaagtctgtccgtcatagctgagacactgaatattttatctgtttaatttttattcattaaaatgcaggtttgaaaatttgattctgttattagaaagcacttaagtatgtttagaatcacttggccttgggagtctactttgtcaactgtgtattttatgagtctaaatggagatcagatgttttcaatgcaaatttcacggtccaaattgaaatgtgttacatatgtaagctactcagatggtttttgaggacttaatatgaaataacctatgtaaaatatctcaataatttttcttagattgatttcatgttgaaatggtcatatttttgatctgttggaataactatgatacattattaaaattatttttattttttaagatggaatcttactctgttgaccagaccggagtgcagtggtgcaatcttggctcactgcaacctccgcctcttgggttcaagtgattctcctgcctcagcctcctgagcagctgggactacaggactacagactcccgagcagctgggactaccaccacgcctggctgatttttgtatttttgtagagacagagtttcaccatgttggccaggctggtctcgaactcctgacctcaagtaatctgcccgctttggcttcccagagtgctgggattacaggcatgagccactgcaaccagccattagtacaattaattttatgtgttgttgtttttcttgttggtgtgttttttttttttttttacttttgttaatgtgactaagaacaattttttttccccacccggagatggatcctcactctgttgcctggactggagtgcagtagcacgatctcagctcactgcagcctctgcctcctgggttcaaatgattctcctgcctcaacctcctgagtggctgggactaacagaagcatgccaccatacctggctgatttttgtatttttagtagagatggggtttcaccatgttggccaggacggtcttgaactcccaaactcaggtaatctgcccacctcagcctcccaaagtgttgggattaccggcgtgagccaccgcacctggccatgtttattaatacgactaagaacattctgaattgcacctgtggctccattggtgtcctgggcaggtggctctgtgctgtccacacaggttgtctcctgtgtcttcgtcttcgctgcgtgtgactttttggttcctgtggcacgtggggtcctgtatgggacattggttctacagcagatttatagtaaggatgtacctactaaaaaatacaaaatagaaagaatagacacaaacatagaaataagtatcacctcacaaaaattttggaaagtagaaaaagaaaaatgcattcgcagctttccagtagccgatatccaggctgtcttcataagcatggatcatgtgtccctctcccgcatgggtagacactgttttctcaccttaagtgtttgtgagtgaaggattcttgatgtgttgacttggcagatgcagttgttgaacagtagtttatctaaagatcgtaagagacttttggagacatttcatgtccttttttcccttggaaaacgtgagttggagaaatcgctgcttgccaaaaataagccgtgaaacgtatttcagagtagatcgttatttacttgctggcgaggagccacagaataccatttacatttgaaaatagagcgctgcaaagtttttataagtagtgaatcccatcagaattacacattttgattatggctctaaattttatattaaataaactaaaaatttcattgtattgtattaccgtctcttgctccttcaggtgtagcatacatgctagattctagacctgtttcttgtgttacagtggtgttatccaggcagggtatcatgtagtgaaggtgatgtcgagtggtggtggtgagcccagtgaaggcgcatccttgccgtgtgtgatgagggcctgtgggttgctatgggattccccaaccctggctcctctgtctcctgcttctgtccttactcacactgctggtagttttctggtgtgagacacgggggcaagtgggattgacaagcctgctgtcacattaggaacctgagttaaagtggagctgaaagcatgtcctcgctcttgatgttgtgcagagagccacctgtgctcctggctcaacggggcgggtgtggtgggtctggaaccaggccctggtttggctctcctcccctccatgttcccctgtcctgtctgatttgcttcacactgacataagagttactttccctcggcctcccaaagtgctggtattacaggcattagccaccgcgcccagctagcatcctttcaagtactggggtacacccaagctcccagcttctagctaggagtcattttgtccctctttatcccaaaggacttgccaccatctttggttcccaaagcccaggagggtccaggctcttcagcctccaaccactttgcatttcttgtctgcttttcgttcatggagataattaacttatttttcagcctgggcatgtcttttttatttactttattttttatttttattttttgagatggagtctcactctgtcgcccaggctggaatgcagtggcgggatctcatttcactgcagcctctgcctcccgggttcaagtgattctcctgcctcagcctcctgagtagctgggactacaggtgtgcaccactatgcccagctaatttttacatttttagtagagacagggtgtcgccatattggccaggctggtctcgaactcctggcttcaagtgatcctcctgcctcagcctcccagagtgctgggattacaggcacgaccaccgcacccagcctttatttactttgtatatctcatctattactgctgcagtttgcagaagagaggatgccctcaaacctaacttctccaaaccatcccaaatgggaagtctgctccacgtcaacagcattgttgcttttaaagactatacgtcaacatggcagattatagcaaaaggatgtcgagggagcaataggaaagcaagcctgagagtcctggagagaaggtggcagagctgccttttgaaggtggttccttcctcagaccctgcccttcctgccttgttcctccagttgccagatttgctgttggagctcctccacgggcgaagaggtgaggctggactgagagggagatggagaagctgccagagattcttttggatctagaattgagacagcagttccagccaggtccagaggtgggggctgtcacccagcccccaggggaatggtactgattgcagaatgtggcgagaactccctggctgggagagggaggtgcttgctcccttgaatcacctgagcccaggctggaaggcccaagggggaggacgaggccagctcactccagctccatcccctccctttaaccctaagctagttaaccctcccagactccagtcctttttcctaagtgccctccctgcaaagtctgcaccgagcagcgctccctcgcaccagctcaccctgcactgtcttgtctttcagcaaccccatgggtttgaacttgagacgattcattttcctaaaagcctctttgggctgagggaaggcatgggtggctctgccagttttggagtgggggccgactcttctcagagccgctgcaagggccagggccaccctcccaggcgggtgtctctgggctgggcagcagctttgtaggcagcctgggtcatccccactggcctgggaagctgggggtgcaccggctcctgctcctgatagggccaaggcaccttccttacctaagagctgactttcttgaagagtgggcacagaggagccggcaacctgggctgtgtaggcacccaggagaaaatctgcagctcagtatcagaagtctccaccagcacggctgttgcagagatggggaaactgggctgagagggaagggggcttgcccaaatcaccagccctggaatgttttgagctttgggggtggatctcccaggaaacgtgttttatggcaccaccgcctctggtcacccaccccgaggtgtggcgggcctggacagccagcttgactgagggccaggctggtgaagtcaaaactaccactcaggaagaagacctagcccttctccagacagagttcaaatgtgaggactgccttctttgggcctcaaattccccacgtgaattccaaggacccctctagctcctacactctgggccaaggtttcctctgagccgcagtcagcctagaggacctaggatacatcttccttggacagagacccaccataggggcagcaggaggtaggggtgggggtaggcaagattcctgtggggaggtggagctgtcatcagagatggtgtctgcaggcagtgggtgtatcgtggctctgctactacttgctgggtggccccatgacgtttctttccccactctgacctcagtttccctatctgttctgtggagataagatgcctgcctacatatttgtggactgggatgtgtgtgggccagttgcagtgtttcttggtgtggtcctggggcaggctgcaccaccccatagagatttctgggccccaccctaggctcacaggaccagaatctctgggaatgaagcctgggaatttgcatttccacaggcatctggctgattctgacatgactgaaaagcactaatagtatatagcaagctctttataaaaggtaaattcatagctgccttttactaaacataaatcttaccttcccttcctcagttaaggacacacaccgcagttgaaaatcactgtgcctttccagatgcagagtctgacctttccgataagattctgttaactgctgctttctgcagtttgtattccaaaacaaggggaatatgtttccattttttcaatacaaatgtttaagtcggatatgctttctcaaactggacacacactcacacagcttagggtttcagctatggcttcctctcaaattattagcctctttctgccagggagcagtttttcccagacaagaccctggacagaggttggtggggccctcctcatcagaatcactagattatgactgacccctagaggtggcttttctgcttaagtgtcagcccatgggctgggttgtgacccccaaagctgcggcagaagcttccacccatcctgggtcccccctgccatctatggggaaaggcctgtcccttgtcttctgggcccagccggcctcacaggcattcagcagattggaaagtcgaagcatgtgctgtgcttggctgggctctcctgcgcccctttttggggtgaggtggagtgcatccagcccccggcatccctgccgtttattcccacccctcatccccacccccatacacactcacaagtacaaacacaagcacagtcactggcacacaccactctggacagcaccatttccagcctcagcggggcagtttccttacagggaagttaatgaggcactaacgaaggctcaggggacagggggaacctctatcgagaagaggctcctagacctggttctgcctctgaattgctgggggtccttgagaaagttgctatccctctctggtctcagtttcctcaggtgagaaatggggggccggccaaatggtctaaggttctgggaacctctaaatcagagcccgtagctggtggtcaagatgagggagaggccctcagggtcagccgaatgcctgagaggcaggacaggcccaaaggtgagcaacgtgagcacatcaggtgggctcagagctggcgcatgagccccacagcctgcagagcagccctgtactcgggagcccgctcacacccacccagtgggacttcagagatgtggggtccagcctttcctactattgctgggctgagggctgggagctgcagattctgaccccacagctgccttagacatgccagatggtctggggcaagacacacccctctctatgaaatgagcagccagtccaaataggtacattagagaagggctgtgggatggacccagctgtagcctggggctacagactggcttccggggtactcaagcagctggcctctggggtagcagccccaggtatgagaggcaggactcagaatctaggccaagcctccataggaatcccctctggagagcccgggcactctgcaggaggggcagcaggcagcaggtgcaccaggagcatgtttcacaaggtgcccaatatcgcatctgctcagataggcagcgagttggaaagtggatgcaataggcagggtggcggctgctccccacagccaggagtccggcccagcacccacctgagtccgcctcagtcctgctcaattgggttatccgtgctcttggccctctggtcccacccacagagggaggtctttggggcgaccaggtgagctggcccttgtgggaggatgtaactgactcctgagcctggcgagccaggcagcccctcgccaacatccccacccctacctctccagcccccccgcattccctgatcctcccatccgctcccctgacccagcagttgcctctgctcactctcttttcctgctcccaggctcgcctggtcatgtgtccttcactctcctctgagtctccctctttccaagccgcctccactctacttgacacactctcccttaagacaccagagtacacaagcgcaagtccctgcacctcacctttactcccagacatgggagggagatgacatgaagacccaaacgccacttagcaggagatctggggtatgcagaggggcagaacggaggctgtggaagctccaggggctccctgcaggaggccacatgtaagctggctattgaatgtggctctgagctgagacctctccttgaagctccagaccaggagccagctgctagctggacccctccatttggtgcctcagagaaactttgcactctgtaggtctaactttgaacccagaaaattcccccatgtcggccctgtctcttcacagggaaagcaccacctcagacccagttctgcaccaaacccacatttgagtcacgaggctcctgccctgcactgtgagcactctggataagccagtgctgagggggaaagagctctgaatgccaagccaaaacatgagcttcaactccacctccagctctgagagctgtgggtagggaagggccctcgtccagtttgctgtagaaagatcagtctgccactgtatggcacatggatggcaggggcagagtgcaggtggagagaatagaaggtgggcagggcgggggaggcagggacatggctgtagccgtggagatgggaggacagacaggacttggtggccacttgggtgaaccaagggaggagtcaggaagagacacccagttttgtatcagatgtgtagagcgtgggatgctgttcattgacggagggaggaggaggaggaagagatatggcatggggaggaggtagctgagctctgtcgtgaatgtcatttgaagtccccagggaaagccaggccggccagcaccttcactgcttcagccagctctcagggtgtctgtgctccctggccctctcagctcctgcttcatagctgtcagctgcagtgggagacagctgcacaagggcccagcatgtctgtgtgtttacccaggggactgccgcatggcccatgccgagcagaaactgatggacgaccttctgaacaaaacctgttacaacaacctgatccgcccagccaccagctcctcacagctcatctccatccagacggcgctctccctggcccagtgcatcagcgtggtaggtgcagagggtacctgtggctcaggctcaggtgaagaggaagctcatgcccaagccctaagcagtcaatgtccagaggaatgaaatgactagagttgacttagactcaccggtacacggtggggaggctggaggagggtccatgaggtttataggtgtccagtatttaatgaggtcatggttttgttaacaaagaagaaatgagggtgggagcgagatcaccactggctaggcagccaatgggcctgcatagactctgctcagctgagtctccagcacgaccatgagcttctcctcctcatcctcccagccccaccctactctctcccccagcttgctcaacaggtgaccttataggctccctactctttgcagggaataagaaccagactgggggaactgacgggtacagaggcccaggtgtaggcgcaggaccacaggcagtgaagcgtctactgacccaggcgggtgagggtctggagagtgggcatggctgctgcaggcatggaaagcaggcacagatggcggcactcccagggcccattgtcagggtctccacatgtggacatgtgcagaggtgggggtgctgagggaggaggggcagggaatttctcatcttctctctactgcctctgagttggagatgtcagagggagccatggcccactgtaaagtaacacaatgtccccacccacaggattagaacccctcccctggaagcagctctgaggggaacagtcacatgtagagagtgcagggcactgtgtccagccgggggaaggaggtcaccaagggggttgacccccctctggccaggtggctaccttctgacacaccagcctctgtctctagcacggtggcccccacacacccagcctgtgaaacctacagccctcaagaaggctttggccaaattaatgagcggctccctctcccaggaggaagcacgggtgaaggatgtggagggcagtagagttgtgtgtgctccgccccctttctccacagtcggatggaaagaagggggctttcagccaggctcgcccagcctggggtctgagtgtcactgtccagctattggcttcttgcttaatgggtgagcccagctgctcccgtgcagctgccgccctagtgagggtgaaccggcaggcgagttacatttctgaaagcctgggaatacagtaaatattaggctgtgggctgctgggccaggaagagttgtttatttttcagggtttgtttatctattgacttgatgagggagggttataggtacaaccagtttaaagatggaaattttgagagagcaggcagggatttagtgctgggtaagcctggtcaaagcggctcttttggggcggccagaatccagtaccaatgtcctcagcatgttcatcagctgctgggggagtgcgggacagcatgaaagcacaggagaactttctggatgatagaaatactctgtatcttcaaaggaggtgggttccatagtaatgttaaatgagttaaaactcatcaaaatgtaaaccagacctgtgcatttcactaatagaaattatacctccaattaaaaacatgttttaaaagacagatgggccggatgcagtggctcatacttgtaatcccagcactttgggaggctgaggcaggtagatcacctgagtcaggagctcgagaccagcctggaaaacatggtgaaatcctgcctctattaaaggtataaaaaaaaattagccaggcatggtggcacacgctactcgggaagctgaggcaggagaattgcttgaacccaggaggcagaggttacagtgagcagagatcgtgccattgcactagagcctgggcaacagcgcaagactccatctcaacaacaacaaaaaaaggacagatgaaggttttcaactttcaataaaggcagaggagcttgttacagattcgcctccccacaagagcagttagaaaaactggataaaaatgtgccccgcccccaatcaaaaacaattgttggaaggtaattggagacctcagtcaggacttgagtgaccaggcctaggaggtgatcctgacagtctgtagtgctttcccacatttggtgattggtcaacagtagagggctaagaggctaagaaactgagtatgaagtggtagttaagaggctggagagcctagctgaatgtttggcactctcacagggctgaaatgacctaatgagaatttgggtcccaggagggagatgggaccttggtggggaccctggaagggccacccctgggagtccaaatgaataaaacatagaccagccatcagaaaacctaaaacctgctttgaaccagcttagtcccgaagtagatgaaggcgatctgcccttactccaattgtgtgccataaactcaaagtcaatactctctggaggcagataaaagtttactatgaatgccaaaagacaacacaagactaaatgagaaagaccaagaagaaaactaatagaaacatacatgtaaggaagaaacttttttttttgagacggagtttcgctctgtcacccaggcttgagtgcagtggcacgatctcagctcactgcaacctctgcctcccaggttcaagcgattctcctgcctcagcctcccaagtagctgggattacaggcatgcgccaccatgcccggctaatttttgtattggccaggctggtcttgaactcttgacctcaggtcatccatttacctcggcctcccaaattgctaggattacaggcgtgagctaccatgcctggccagtattttgccacaatttaaaataaataaaatttttttttcaggtttgtgctcagactatattctaaacagtcacatggcggcttactcttctccaggccttgctgccggcttttacatgtttattgtctttgccttcttgtcatgtgctcattagatggcagcttccaggtgctcctaaggggccaggaaagagagtgagaaggcacggaggttgccagatcatcccccttggggccccgccctcatcaactccctcaaccgggtctcctgcaactatcggtgggccatctcggccaccgcttcgccctgagcttcctgctgctgcagctgggcagtgcctccttctcagaggccagctgctgataggcggccacgtactgctgcaggtgacccaggtaatggtctcgctgctgctgcagactcagcctcttggctcttcagctccacctgcaggataggcgtcagggtaggtagtggctggcttccagattctgggcccataaacagggtagtgagggcactgcggggctctgtcgcctacccaggcccctggccctggccccttcctccaggcctaaatgactgcctcccttgcctagaggcccatgcctccctccccagcctcaaatctcacacccttcttcccaccatttaaactgtaggccacagactggtggaaaagcagagggagccaaccaccatctgctaagttgtggtgaggtcgttctgtatgatctccagggtttgcacacacctccgcctgctccccccaagagctcggccttctgccccagcttccccagcctctcctccagctcctgcagcctcacctagtgttcctgcatcttctcctcctgctgccgcagcctcacttcctgctcccgcatcttctcctcctgcctccgcatcttctcctcctgttcttgcatcttctcttcctgctcacacatcttctcctcctgctcccacatcttctcttcctgttcctgcatcatctcctcctgctctcgtatcttctcctcctgctcccgtatcttcttctcctgctcccttatcttctcctcctgcctccgcatcttctcctcctgttcttgcatcttcgcttcctgctcacacatcttcccctcctgctcccccatcttctcttcctgttcctgcatcatctcctcctgctctcgtatcttctcctcctgctcccgtatcttcttctcctgctcccttatcttctcctcctgcctccgcatcttctcctcctgttcttgcatctcctcttcctgctcccacatcttctcctcctgctcccccatcttctcttcctgttcctgcatcatctcctcctgctctcgtatcttctcctcctgctcccatatcttctcctcctgctcccgtatcttctccttctgctcccgtatcttctcctcctgctcccttatcttctcctcctgcctccgcatcttctcctgttcttgcatcttctcttcctgctcccccatcttctcttcctgttcctgcatcatctcctcctgctctcgtatcttctcctcctgctcccgtatcttctcctgctcccgtatcttctcctcctgctcccttatcttctcctcctgcttccacatcttctcctcctgctcctgcctcttttcctcctgctcccgtatcttctcctcctgcctccacaccttctcctcctgctcccgtatcttctcctcctgcctccacatcttatcctcctgctcctgcctcttctcctcctcccatatcttctcctgctcatgcatcttctcttcctccctccacatctcctcctgctcccgtatcttctcctcctgcctccacatcttctcctcctgctcccgtatcttctcctcctgcctccacaccttctcctcctgctcccgtatcttctcctcctggtcgtgcatcttctcctcctgcctccacaccttctcctcctgcttccgtatcttctcctcctgctcgtgcatcttctccttttgcctccatatctcctcctgctcccttatcttctcctcctgcctccacatctcctcctgctcctgcctcttctcctcctcccgtatcttctcctgctcgtgaatcttctcctcctgcctccacatctttttctcctgctcccgtatcttctcttcctgctcccgtatcttctcctcctgcctccacatcttcgcctcctgctcctgcctcttctcctgctcgcgtatcttctcctcctcctgcctcttctcttcctgctcccgtatcttctcctgctcgtgcatcttctcttccagctcccgtatcttctcctccttctcccacatcatctcctcctgcctccgcatcttctcctccttctcccacatcatctcctcctgcctccgcatcttctcctcctgctcccgtatcttctcctcctgctcctgtatcttctcctcccgctcctgtatcttctcctcctgcctccacatcttctcctcctgttgctggttcaggcggttccacaactcgttctcttccacctgggcttggagctttgctgacacactctgcagctccttacccaggtggtcagcctccgcctgcagctgctgctggaatagtgaaagtgtttttttgaacctcagaaggaagcagaatcatgagctagccacataaatgtaatctataggctgggcgcggtggctcacgcctgtaatcccagcactttgggaggccgaggtgggcggatcacgaggtcaggagatcgagaccatcctggttaacacagtgaaaccccgtctctactaaaaatacaaaaaattagctgggtgtggtggtgggcacctgtagtcccagctacttgggaggctgaggcaggagaatggcgtgaagccggggggtggagcttgcagtgagccgagattgcgccactgcactctggcctgggtgacagagtgagactacttctcaaataaataaataaataaataaataaataaataaataaatgtaatctgtaaaataatggttttcatccatgatcctttaaaaaaatatttttaagccctaactcttgagattctgattccccaggcagggccccaatttgtacatttttagtacactctagaggattctatggcggggccagaacaaggacccaaattttccagctcttggctggagcctccccataccctgcatgatccctagaccatggtcccagctggatgggtctcccacaacccccggggctgcagctgctcacctgtggcagcaggagcttggccctctccagtttcctttttagctcctttacgttgagctggatctcagacttttcagattctacaagttgaagtttttcttgtagtttggcatttttctccttcagctcctcatcagttatgctatggccagaggcagtagagaaaggaatgaatgaagaacataaaagaccactttggtgattgaccccctaccctcgccccacaaccacagaaccgtggcgctggaagggaccccaggaattaaaagtcccaggtggcaggccagagagaagacatgagttgcctgaggctaccccatgagtcagtggcacagccagcactagagcttccgtgtgcacacatgaaaacatgtatgagcctctccccacactcacctggaccccccacctcccagcacaccacccatgctaagggcccccagacctcccattccaccttcccccatcctacgtgttcctgtacagttccagactcagggcgtccctctcctttgttaactcctcaatgtactgcaaatagagaaaggttaagtcaggatagagcaggcacagcagtagctggacgaccaggaacaactgctacagtgactactccacagtaacacttcctcactctcaatcacacctgacgtgttctcaaggcatttccaagcccatggtctcatttgtttttctttctttctttctttcttttttttttttttttggcagagtttcattcttgttgccctcactggagtgcaatggcacaatctcagctcaccacaacctacacctccggggttcaagcaattctcctgcctcagcttcccgagtagttgggattacaggcatgtgccaccacaccgggctaattttgtatttttagtagagacggggtttcttcgtgttggtcagtctagtcttgaactcctgaccgcgggtgatccgcccacctcagcctcccaaagtgctggcattacaggcgtgagcgagagcacctggccctcatttgtttttcaaagaactcagtggatgtggaagggacagggaaagagattgaatttagggctggctaacaggggcccagagcgatcagataatattgttattgttattactgttattactaccactgttggagcctttattgggtgcttcaccaggcactatgctaacaatcccatttaatcctcacaacctccataggagacggttaccattattacctctattgtgtagatgaaaaacatgcggtattaaaggttaagtgctgcctaagatcacttggagctggcatttcaacacccaggtatatctgattctctaagcccattcttccgctggaggtaggggcacagttaagaaggaggaaattaatcctttgttgaatttttgaaaggatgatacgttcgcatagtccaaaactcagaaagtccagaagggaaatatctccccccaacactgtgcctctatcctgagttttttaatgaatccttacaaacgtgttttatgtatgttaccataatacgtacacacacacacatatacacctgccccctctctccacacaaataataacatactcaagatactcttctgtacctttatggtacaagtaccctaaccgccacttaggacttggccaaggccacagccaagtatgggcagggcgggcacttggcctctgagatctatgtccagtgctcgctcctcacagtgctccccaactcacccacaacagccgactcagccccagtctgcctctaacaaccacacacaaaagcagcaagaaatggccatgctgccttctgggcaggacactccatcctacagaagggacctttaggctcactcctccatctgcgaagctgggctcccaagggacggggccgtgtttggactcaccctatccgccttcttcttctgtgtagcgacagcagagagagcctgctctaactctcctgcaaacttccatgaatcatgcaggcggctgatcagatccctggcctctcctggaatgagagacattcagatgtggcccaaaggactccccctaaaggcctgtcaaagtgccaggttgaaggatgatggggtgccagattcccaccttccaactgcttgacagcatgctggctgtagtaaagtgccatctgaagctcagttttctgacatgtaaggattcgtatggtttgaacctgggcctttgggagaaaagacaagcaaatgctgaaagagaagcaaagaaacattctccagagggcaggagggaacttcacaccctccactcacctctagctccctccttagggcttcctgatgttggtggcttgccttctgttcctatagaaagaggaaaacagagctcttgctagggggaggcagagatggcacagcaagagacatgcccccagaatggcaccactgccccagaacaggcccacccatgggaccagtttatcagggaccctgtggggatggggtggaatcttgggggtgagccttcttccccaggctgggagtgggtgagatgagcctggggcctctacatctgagtgcccccaaacccagcggtcatgtcgtgagcaaagaaatcacacgacttcttccagctgagctcggttctattgtttctgtggggagagtcaaaggaaggtgactgagggtggcccccttgactctattccccaggccaggaagcgataggcaggggccaggaatggatttaaaaggcacagttctcagacccaatgggaacatgaactggtcaactctcctcaactcccaaagaagaaggatttgggtctttttggtttttgcccacagccacagaactcaaagtctgaaactagattctcttgaaaagacagtaacagaaaccttcagaggtggagtgcgagaaaagcccacccttccgccagcttgtgatttagaaaggtgcattcactcagcaaacgttgagcacatacgggccagggacggttcttcacagcgggaatagaggtcagaaaaggcagacaggagcccttggccccgaggtttccattctagtgggcctttaactctcgggctctcagagctaacagaaacctctgatactctctaactctacctcaggaaacgcaagcccaagaaggagagtttacagcaggtcctggacgagggattaacataaaaacacaatgacaaatctcatttaaacttcacaaatgtaaggaaaacaataccactcgtattttacggatgtgaaaagagaggcccaaagagctcaagcaatttgcgctaaatcatatccctagcagatggaggggtaggattcaaacccagaattcttagccagtacctggcagttcttccacaatcttaacaattaccctccaccaccccttgggccctctgtccccaggagcccggccagccaagactcacatcctcaggcgagtggcaaccaccagaagtggttgtctcagggttagtgccattatttattttcttctttttggtgtcgcttgctgctgtaccaacactagggttggtctggggatgatggtctgtcaactgtggaaaggaagagcagtgatactcatgagaactacaagctcctacagtcacatcctgctttacagtttatactaaatactcttatagaccatctgatttaatgccaccaactgtaggaaatgttgtcacaatcacttagtgactgagagagattgataccatggctgaaaaaaaaggcagtaatggaacttaaactcagtcttctgactctgagctctgggattttgccctaaatcagcagctgccagggaccaaaaccagaggcagaggtagaaaagcaaatattaagtaggcaggaactgtgcactatgtggtttagggttattcaccctcacacgtctgttagtgttaaaaagtacaccagtacctctcaaacctttacatcaatgtctcctcatggcagaaggcagcctttctgctaaatctgggaatttaacagaaagaggacaacccaagcctcatttcagagagaagtcttgtatacgcttataaatctatgtgactttcatccctaagtacattaatgttttgtctctcaatagaatcaagggaaactgatgcttcagaaagatgccccatatttatcctgtggcactcaaagtaccccaggttgagatgagatgaggaagactcaagctaagttcagtttcccaagatctgttccacagaagataagcagatctcactccagaaccagtgactgaggggcactctggtcccagaacaatggagaattcaaatctgaggtgcagaactgagaaaaaatgttaaaatctctctggagagtagaagcctgggagaaaaccaaaccaaacccgttctcccattgccacccagagacactgtcaacgtgttgagctcctgggggaggtgtaggcttttcacactgtcaaggtctgtggtaaggaagtcaggcagcctgaaacctctctcttctaggtcccacagtccccattccccttccagctggaaacctgtgctgcaaccagaggaaacagaagtgggcaagaacacttaggggactgggtcctaagaccaaaggccggtcttgtggtagtaatgacagtttgtagcgggactgtgacatcactacattctactcctcggtggagtggttgggggggacacatgagtgcaatgcccaagttgccgctttgagactggggagggggtcacaaaattgggagccaggtccttggagacgtgaccccaaagagccccgggaggtcaggcttggggcggcaggaggtgagggccaattaaggagcaaggagctccaggagtcacatccccaaagtcaccctgtggcaactggtgagggcaggttctggggcacccaggtccttggagctgtgagctcaaggagcccagggaggtcgggtttggggtagcaggaggtaagggcggagtatggagttggaagccccaggagtcacctgctcaaagtcaccctggtgtgccgggcagagcaggggcaggacttatgagggggttgggctggctgacaagattttggtgtggggagcccagaggcactggggtggggggcccagcctggtgtccctcaggagtggcacagactctggcagcagttcggctgtcagagggggcctcgggttgggttggggtgttggtgcgtttacctgttccttggcctcggccaatttgctctgtctggtttctttggacatcataggatgggtagggaggtggggatgggtagggaggtggggatgggtagggaggtggggatgggtagggaggtggggttggggccacatcagcatgatccaggtgaggacaagtatatacctccagtcacctctacgtcgctgtgtgactgagccagaggaggcgtaaccagggctgcactagaatgcagaataggggtgtggccttcatgcttgaagcccattggtcaatgagaaagatgaaaggaaaaggaggtgtggccagacagcagcgtgtcatcaaggacctgtgttgtcacaaggaaagctgcctatgcaaccgctgtccccgcccactccaggagaggggcggggctggctttcactttaaaaactttaaaactttattacctcaattgaggtacaagtcctattaaaatggaaattttatagtgtgcttgatgattgataaagcagactttattatccaacattccaataagataatcacaatgttttctcttttttggaaaaactttctcttattctcctacattagcgtttagttttttttaaaaaaacaaacaaacaagaaacatgtctaatatctttaaaaatacaaagctttgagccaggcatgatggctcatgcctgtaatcccagcactttgggaggctggggcgggtggatcacccgaattcaggagttcaagaccagcctggccaacatgatgaaatcctgtctctactaaaaatacaaaagtagctgggcatggtggcaggtgcctgtaatcctagctacttgggaggctgaggcaggagaatcccttgaacctgtgaggcagaggttgcagtgagccaaaatcatgccactgcacttcagcctgggctgctacagaatgtgactctgtctctaaatacacacacacacacacacacgcacagacacacacacacacacacacacacaaggctttccatttaataagcactcaaagttctttacaaggttaaagcaaatacaggacccttctaaagtaaggctaaatgctaagtgatgggggagagaaaaaggacataaataactcctactctcatgagttaatcactaaatccgatttttctagaatcacctggcctctaagccctgaaaatgaaactgaatttctcactcgatacttggctatgacttgcaatcataaaaaccaagaattgtgttatgtcactgtgtattgcttgttacctgggatcaagggttgactttttcatgatttgctccattacctgtgtgcttcttctcccagtccaaactacgcttttttctagagatctacaatttacagttagtatgtaagggtggctctcaaacatgtagtctccggaccaggagcacctgggaacttcttataaatgtaaattctcaggccccaccctagacatgaatgaatcagaaactctgcagtagggcccagcaatccgtgctgcaataatccctccaggtgctcaggaacctctgccatacagcaggtagaaaaatgtgtttccttctgtagggccacagccagggatactatacgttctgtctcaatatgaaacaatgacatgcaattaaaagacataaatctccttcctacttccaccctccagccagtgtgttttatttttatgagttcaataagaaaacgtgtggcaatcagagatttcatctaaaaaatatatctacaggtatcagttctcatccagcctgatctcatccaatatcatttctatcctcttacatctaaagttttagaaaaggattttcacaacgtaagactcaggcgcactaggagttctatgataaaagaccaagtagatctgaatgtccaaacttactagagaagaaaagtggactcattggctatattttcaaattgcattcaacaggaaattaaaggtttgaattttttccaccttcatccttccaagttaatagaattaaaccagaatactccattcttccaaagcctgtagccaggcaaacttttactgtattacttcttgcttttcaatggatataaagcagagtcctggtaggcacattttgtatacctgcaaagatgcaaaactaaacagttccctcggttcaatattaaaacaaaagtcctgtaaacctcagatggtgagtgtaatacttcagcactagcacgaaagcctcaaatataaaaagataccaagaaccttgctagcaaaccaaagtaagctcttggccgggagcagtagttcacgcccgtactcccagcatattggcaagctaaggtggggtaagtcaggagttaaagaccagcctgggcagcatagcgaattcatatctctacaaagaaaatttaaaaattagctgggcttggcggcacacacctgtagtcctagagctacttgggaggctgaggtgggaaaatcacttgagcccagaagtttgaggctgcagtagctatgatcatgccactgcactccagttggggtgacagagcgagatctaattattacattctctcctgctcctgtttccactaaaatcactaacttaaaatgtgttcattcagcaggataaaaattaagtgaaatttgactttggtgctttgctagcaaaaaataaataaagtgaaatgacaaattacttactgggagaagatctttgtaacctcaatgacagattaaaggtttgtatccttagcctataaagaaatctttaaaattactcagaaaaaaaaatgaatgatttgcagcagaaaatgggcaatggagaaaccagcacttcccacaagaataaaaatggccaatgagcaaatgaaaaagattcaaaagcactagaaatcaaagaaaggtaatgaaaacaatgagattttctgcttaaagaccagcgaagacgacaaatggaagggggaacctggagctctgtccctgttggtgggagcataaactcaaccaattttcctataggatgatttgaacatttcttttaaaaatcctaaaacggttttatattattttcttctagaaattctacttctatgaattcagtgcaaaaatcctcactcgagtccattaaaatatatatagaaggaaatccacctctggggtggcaatgattcacttaacatacatccagctgttgaaagtgatgatgccagggtatatttctccatagaaacatgcttaaaatatagtaagtgacaaaagaccatgtattgtgattctactttttaaaatgtttacagcataaaaagtgtgaaaagcaacaaaccggaatgttttgagtggcaaaattaaagatttttctttacattttgtcatccaaattattacaaaaacaatgtgatttcctttataatcatggaaaagtgttattttcatttatttatatttacatttcttttctttttcttcttttttctcctgtatgtatcccacataggctacagagcttaaatccctgcctcttgagagaaatcagcccattttcaggacatgcaatacacaaagctgccccatcttccctttatttttatttttatcttatttatttatttatttatttatgttgagatggagtctcactctgttgcccaggctggagtgcggtggtgcatctcagctcactgcaacctccatatcccgagatcaagcgattcccctgcctcagcttcccgagtacctgggactataggcatgcaccaccatgcccagctaatttttgtatttttagtagagaggaagttttaccatcttggacaggctggtctcgaactcctgacctcaagtgatccgtctgccttggcctcccaaagtgctgggattacaggcatgagccactgtgcctggcctgtcatattatttctaacatttgagggacatttcaattaagtgaaatttaattcttactgacctgatctcttatcctctgtttaatgataccttccagttgaaaggtgtttcctctgtaatcacgggtgccaaaggaaatacaacatgtattcattaggtggatatccactaaaccacggattcatgcattgtagtccttagaccctcagcatcagaaacacgtgggaacttgttagacatgcaaattcctgggccagccccacacctcctgaatcagaaagtggggaaggacagctatctgtgctttaataagccttgagatgctccctgaagtttgaaaactacagaactagaatacatatggtagtaagtgctcatactttatccaaggtactagggactcttcccctcttttccattctcttttctgttgaaataaaatgagagctccttttgacttaatgggtataagaaagaaggcaatgagatgaccagggtttcaagttagagttcaaaatttaatcagtggacagtgacaggatgcaagccttctaaacagattgctgcaaggaagctgattataatctatacagtaggtatcattagtgtattgatgttaaattttgggggtggattaatggtattgtgattatataggagaagtcctggttcctagaagatatctgcgaaagtacttaacagtgaaatgctctgatactgccaacttactttgaaatgattcagagggaaaaagggcacatatacaatcttccatacgcagaagacagaaaacaagtgtgacaaaacattaactagtgaatccagttgaatagcatacagatgttcactgtatgattttatcaacttttctgtgtttgcaagttttcaaaataaaagttgagggaaagaaacatcaccccaaatctttctatgaaatgggaccatagaaaaagcagagaagtgaacactttgcagaaaagagcactgcacccatccggacagcatggtcaaagtgcaggctctcctccaggaggctcttctctggtctcttctgtgctgtcacttcccccacatgcagccaaggcttttttctaacaactctttttctaaagatgtaatttttgtcattcatctaagaaagagaagaaaagaattagtatacatttagaaaataaaattacacttacatttgtgaaaaagcaaaaaatactttgaaaagtggggaagcaagaaatgtactgttctacaattctgttctgttcttaccatctttttattctgccaatgacttcctattcctgctgtgtatggtggggtgagctgcaaatgatttcttttcctcattgatttaaaatctcatgtttataatgtgccaaactcccccagaagcatttgggtttatttctgggctctattctattcaagtaatctatctgttcacaagccactatcagttttgattattggagcatcctaaagttaagtaattgttgtttttgtttttgagatgcagtctctcactctgccgcccagctggactgcagtggcgtgatctaggctcactgcaagctccacctcccgggttcatggcattctcctgcctcagcctcccgagtagctgggactacaggcacctgccaccacgcctggctaattttttgtatgtttagtagagatggggtttcaccttgttagccaggatggtctcgatctcctgacctcgtgatccgcctgcctcggcctcccaaagtgctgggattacaggcgtgagccaccgcgcctggccctgaatttgcttgagtttttagctctctcacccatttcaggattgtcaccacccatatctgacacgtcctcctcctcctctaaatcttctaggtcctcctggccatcagcctctgtttctgaaccagcctcttcatgctcctgttcttcactctctgggagaagactgatatcttcatctttctttcactaaccgcattctggaagcacggtaaaattgcttcattttgcaattccagttgttgcaaagtctgctcatcatcaaaactttctatcacaagtttttgtaaagagctgccatggattctaccattctctactgttttattaaagtcataaagcacttttgttaaagaagtgaactttggttccaatccatcttgaaacctattgggaggaattaaatgagatttagaattatagataataatttcacagccctcttaattaaaagaaaaataaaaacctcaactcttctgtaaaatcaaatttgaataaagtgtaagtatagattctggccccaacaatatataagctgatgagccacaatgatatataaaacctgtcaaccaagtatttgtgaatcagctgtatagattgttggcaggaaaagcattacaaatctatttgcttggagatatatagtgaattagccttaaattatctactctgctacattatataccactccattcattcattcccttattcactcaatgatcaacatttgctttggctacagtggtcaaggaaaacctctcctagatgtgacatctgagatgaaacttacagacaagtatagtcttataaagattgggaaacatgtattccaggcggaagaaacagcaagaacaaattctctaagatgcaattgagcttggtaagcctgaggaataaaaaagtgagcatggctatagcgtgaaggaggcagaaggtgaagttggagagactgatgggagccaaattctgcagggctcaagggtaagagtttgccgttttaagtgtaataagaaaatgtgagaagattttaagcagaaggatgaaatgatgatttatacgaaggaagaagaaagggaggaaggaggaggaggaaagtagagtgattagaaggttgatgcagcattccaggcaaaagatgatggtgatttaagctggagttagagcagtgaatatgctgagtacagtttggaggtagaactgacaggattgctaaggaattagatacagaatagagaaaagtgaagtcatcaaaatagcagcctagttttatgtgcgagcaactggagagacagaactgccatttactgtgataggcaaggcttgagtggtggagcaaggggaaaggacttcagcggatggcagagtgtaggtgggtagaaacaacattctactgtattttggacacagtgaatttgtgatgctgagaggaccaaaatttaaaaaattgttaaaagccgtacggtgcagatatcccagttgtgcgctactgaattccaactaagctcagtctggagttgcttgtgagcaaggaactcaagggagaggttggagtttgaaacataaatgagtcataattttataggtcatatttgaagttcttcaacaaaatacacataaaacgtttgtgttgggaagagacatgaaagttctaattctcaagaagcttagtggggtagacagacaagtgacaagtttgtgctttcaataaagtatgatggcaggtaaacactgagtgctttaggagcacaggcggaaggagaaaccaacacagttgtgtgtagggggatgggggccgtaataagcctcaaggggagcttataggcgtgaataactgaggttaggttgatttcaataacattcaactgagagatccatactgtaaaagttttaacaatttttaaaattttgatagcctaggtcctctgaaatgtggggaaaagtgatttacatttccccttaccttcccccagctccacaatttgccaggggtctgcaacccgtgtccacgtgcgaccgcagtcgcacccgagcccgggatctgtgcacttacgtgaggatgcactcgggccagccagtggctttgcccacctccctcagacaccgctccggggtccgtcagcgccaggcccatgggccatggctgtctgcaactcccgacacaagctgcaaggcaagagagccgctgggaaaccgcaccgcaaggatgctggcattggaacaggaattaaaagaaatgaaaaaatgtgtaagcaaaaactcagctgtatgtaaaaaaaacccaattccccctgagaatgagaaagagccttagtcctttaaaaaaactacctgttttcctatggctagtgagccttatcgctcccttcccaggcattatcaaaaccctaattccctaactgtgcaactgcaaggtcactaaacaaacaaatgcaagtcacaaaacatatttttcctaaaaacgtaaaaaaaaaaaaaacataatgcgtgcttcaattaaataaccctctgtttctcgcttctgtaatatgcttccccctgcacagatctacccgggctccacaaaatgctaaaagataactctttattcagctcaacgctttgatctgcctggcgtggtggctcactcttgtgatcccaggactttggacggccaagtagggtggatcgcttgtgccttggagttccagacaggcctgggcaacatggtgaaacctggtctttttgttttgtgttgttttgagacggagtttcgctcttgttgcccaggctggaatgcagtggctgggtctctgcttgccgcgacttccgcctcccgggtttcggtcgttgtcctgcatcagcctccagagtggctgggattgcaggcataagccaccaagcccggctaattttgtatttttttttttatttttattttggtacagatggggtttctccctgttggtcaggctggtctgaaactcccgacctcaggtgatccacctgcctaggcctcctgaggtgctaggattgcaggcttgagccaccgctcccggcccaatttgttaatcagaaaggaatagatcgtcctggtgtggtggctcacgcttgtgatcccagtactttggatggcccagcgcggggtatcccttgagcctaggagttccagacctgcctgggcaacatggtgaaacccggtctctctctctctctctctctttttttttatgaggtggagtttcgctcttgttgcccagggtggagtgcagtggctgggtctccgctcacagcgacttctgcctccagggttttagtagttctcctgcctcagtctccggagtggctgggattgcaggcctgaccaacattgctctgctaatttttttttatttgtttttggtagagacggggtttctccatgctgggcaagctgatctcaaactccagacctcaggttatccgcccacctcggcctccggggatgctggaattgcaggcgtgagccagcgcacacacccaatttatttttatttcattttttatttttatatatatatacttttgagacggagtctcactttgtcacccaggctggagtgcagtggtgcgctgtctcggctcactgcaacctctgcctcccaggttcaagcgattctcctgcctcagccgcctgagtagctgagattacaggcgcccgctagcacacccatctaattttttttttttttttttgtatttttagtagagatgggttttcatcatgttggccaggctggtctcgaactccggacctcaggtaaacccacctcggcctcccaaagtgctgggatgacaggaaggatcggcctggcgtggtggctcacgcttttgatcccaggagtttggacgggccgagcgtggcggatcccttgatcctaggagttctagaccagcctgggcaacatggtgaaaaccggtctctctctctctctttttttttttgaggcgtagtttccctcttgttgcagggctggagtgcagtggtgcggtgtcggctccccgcggcctctgcctctgggtttgggtggttctcctgcctcagcctccgagtgactgggattgcaggcgggagccaccatgcccggctcttttttttttttttttttttttttttttctggtagagacaggtctctccatgttggtcaggctggtctcaaactcccgacctcaggtgatccgcccaccacggcctcccggggtgctgggactgcaggcgtgagccaccgctcctggcccaatttattaatcagaaagaaatagatcggcctggcgtggtggctcacgcttttgatcccaggactttggacaaccgagcgtggggaattgcttgagcctaagagttccagacctgcctgggcaacatggtgaaaatctgtctcttattattattattatttttttttgaggcggagtttccctcttgttgcccaggctggagtgcagtggctgggtctccgctcgcggcgaattctgcatcccgggttttggtggttctcctgcctcagcctcctgagtagctgggattacaggcacctgccgccacacccggctaattttttttttttgtatttttagtagagacgggttttcatcatgttggccaggctggtctcaaattcctgacctccggtgatccacccacctccgcctccccaagtgctgggatgacaggcgtgatcggcctggcgtggtggctcacgcttttgattccaggactttggactggccaagcgtgggggattgcttgagcctaggagttccagaccggcctgggcaacatggttaaacccagtctttttttaaattcctttattattattattattattattttttttgagacggagtctctctgttgcccaggctggagtgcagtggcgctatctcggctcactgcagcctctgcctcccagggtcaagggattctcctgcctcagcctcctgagtagctgggattacaggcgcccaccaccacacctggctaatttttttttattttttagtagatcgtggtaactgccttaaaatgatgattgttcagaaagtcagtttaatttagatactaaggatattgaggttatgtaacatttgagcaagttctaaaaaaaaagagaaatagtatatttaattgctaataaagtattgtcaactcacaaatatattcacatagcatacatttcaagagcagaataaccatgaatataaaaggaattagcaaaaacgagacaaaaaagacatgaagaaataaaaacagatggaacaaatagcacaaaatacgatgaaagttataaaagaaactatgccaacaatcacaataaatgtaaatagactgaataattaagagaaaatgactataaaacagaattagggcacgcgtggtggctcatgcctgtaatcccagcactttgggaggatgaggcaggcggagggatcacaaggtcaggagttcgagagcagcctgaccaacatggtgaaaccccatctctgctaatacaaaaattagccggcgtggtggtgaacatctgtaatcccagttactcaggaggctgaggcaggagaatcgcttgaatccaggaggcagaggttgcagtgccgagatcacaccattacactccagcctgggcaacagagcaagactccgtatcaaaaaaaaaaaacacacaaaaaaaacacaaaaaacagaaaataaacagtatgaaaagacatctaaaacataaagtcacagaaagactgagagagattgaaaaaagatacacatgtcatatgtacctaacccaaagaagggttggaagctatattattatcagataaaataggctttgggcaaaaagcaatatgggagattttttaaggtcacaatatgatgataaaaattctaataaaccaagggagaaggtaatctaaaatgttaatgtatctaataactagcactcaaaatacatgaaagcaaaatatgacaaaattgcaaccctcagagggcaatttaaatacatatctcagtatctgataaaagagacaaaaaacaatcagcatagacatagaagatttacatctctctagaaaattaacaagcttgacctaatgtagagaaaaaacatatctctccaaagtgacagcattcaccccccccaagtacatatgtactgagccataaggaaaatctcaacaaattccaaagaagcggaatcatgcatccatctttctctctaaccataatctcattaaactaaaaacaataataaaaagataaagtaaaaagccagaaaggcagatgctaaatgagaaagtgacagaaaagttacagattttgttaagcatacaaagcttctatagggtaaagcagtcaaagggatatgcaaatttacacagaaatccaaccgatataaatccttgaaagatactacatacagatatttcatcagttctcacatgccaaacccagcaaagccaaactttggagcctcccctgcgagcagacctgccacaggaggagaggcagcacaaacctccctttgcagtgaaaatgccacattgtgtgtgcttcttaccccatcacctctttggaagtggccccactcagtgctagctgagaatcgcttccctcataccactctcagtagttcaccccaagacacactggacaactctgtacctggtaagtcattgtgaatccaattaataatggcattcagaaagttaggaatctttgaattattagattcatagtgatattcaaaagaaagaaaacgacatcatttctgttccacgcatgttgcccacattcactgcgtaaaaggcaaagggaactgtgagtacccacaaagaacctgatattgacggcacatacatttcttcattaggaagaataaatttagactgtaacaatttaaaaaaccagaaaatacaactgtacattttagctcttattaaaatccaagaggtttaacttatttgctccttgtttaggtaattagtgtctaaaacatttcaaagataacatatatagtggctacgatttctagtactttttaaaaattcaagcccagtctcttctaattaaatgtataaatgatttatctctgtctttcttaaaaagaaccaagagccccaattaaaaagtaaaacttaaatttcctcttaaaaaattgttacgtcaaaattatcgaataaaccatagttcagaaaataatttctgaattaagaaaatatgaataataaaaccaacagttcatgtgctgaatttcaaatttttattttttattatttttaaaattttgttttaagttctagggtacatgtgcaggagtgttacgtagggaaacgtgtgccatggtggtttggtccacctatcaactcatcacctcagtgttaagcccagcacgcattagctatttttcctgatgctcctcccccacccgccctgacaggccccagtatgtgttgtttcccttcctgtgtccatgtgttctcactgaacctcacatttttaaatacagcatatgccaggtgtcatttcagtacccatgattatacatagtataattatacatagtatatgtatatgtgtaaatatatgtatatgtgtacatatatgtatgtaatatgtgtatgtaaatattatgtaaatatgtatgtatgtaagtatatatgtaaatatgtatgtgaatgtatgtaaatatatacacatgtaaatatgtatggaaaaatatgtatgtaaatatatgtatgtaaatatatgtatatatataaatgtaaaatatgtaaatatttgtaaatgtaaaatatgtaaatgtaaaataaatgtagaatgtcaaatgtaaatgtaaaatgtaaaataaatgtaaaatgtaaaataaatgtaaaatgtaaaataaatgtaaaatgtaaatgtaaaatatgtaaatatatgtatatgtgtaaatatatgtgtgtaaatatatatgtatatgtgtaatatatatgtatatgtgtaaatatatatgtatatataacacagcatacagcatatgccaggtgtcatttcagtacccataattatacatagtataattagactactatgttagctaaaaaatgttgattagatacaaatgtataaatttatcttctctaaaagtggaaattctctagaggctatttccagcttctgtgtggattgtagagcaggctgctacctgtaccccaaaaatgaacaccttaaaaaaaagacaagtttctcagcctccctattgcacacacatatgaaaaatatgttaaattcaacgccaaatattcctgagatcaacacagcagtgatcccaaagagaaaatttctctttgctaatgggcacaaacttgaagggcaaagcagtggaagggtaagtctgcagactcgggtggggctcaagtcagaatcacgtggaagatcattgccacatgtttttgtttttttaaatagcaaacaccaccaagtggagcccgccgggtttagtagatattaaacctctaaggagtggcacatccgagactgaaattcccatcttttgattcccagctcaaggtctctgaaatgccagcaccagctgtgaaattgttcttctgcattttcatggagaccttttcttctatactgccatactcttttttttggaacagttatacctgatcttcctatttttgtgtgtgttccaccgaaagtttttcactctaaatacttccctctttccaactgagcatttacatctgtaacaaggacaaaaacatctaacatctctctcacccttggtttgtgttttgttttgtttgtttttgagacagggtcttgctctgtcacccaggctggagtgcagtggcgtgatcaccgttcactgcagcctcgagctcctgagctgaagcaattttcccacctcaacctctgagtagctgagactataggtgtgtgccaccacgcctggctaatatttgtattttttgtagagatgagtttttgccatgttgcccaggctggtattgaactcctggcttaagtgatcctcctgcctaggcttcccaaagtgctggaaggaattacaggtatgagccaccgtgcctggcctcaccattgttaaaattatggaaatcgtgtttgcaaagcagcttggcctgtttggaaaagggtgtcataatttctcaggtaactccaaaaagagaaagctacgaaaattactttaatacattcattacagtcccagtataagattatagcttcctctcccaaagtgtaaccacaacctgacgcaggatgagttggtttgaaaataccgcatacaatatcctcttgagtagaatcataatttagaactctaaaattgaccagaaacaaaactgtccaagtttgtttaacgtaatgtgtttcaacttatttgactagaaaacccttcattcgtgcaacacttataaatatcccatggcaaatctagttttctatgaataatgaacaaaacatttataatttaaaactaaaattgtcttctaagcagagatctacgtatcaataaaatgaagaaataaaatttccatactgttttcttcccaatacaaggattagaaggaaagggaaaagagtaacagcgagaatcaatagcccatgtctggccaggctccatggctcaatcacacctgtaatcccagcaatttcagaagctgaggcgggaggatcactggcctttagtgatccttgaatgaaactccatctctaaaaaattaaaaatattagcttagagaatcatttgggcccaggagtttgaggctgtattgaactatgactatgctactgcattgcagcctgggcaacaggctgcttaaacctggaggggcggagcttgaagtgagccgagatcgcgccactgcactccagcctgagcaaaggagccagactccgtggcaaaaaaaaaaaaaaaaaagagattctattcacaatagcaacaaaaccctgagaatatatctagcaaagtatacacaaggcctttcatgaagagtattgccatagcctgaatgtgtctcccaaaattcatgtattaaaacttaattcccaagatgatagtactaagaagtggggcctttaagaagtgattaagacatagggtgagccctcatgcatgagattagtgccttccttataaaagggcttgtgggtggtggtaaatctgtcccttctgcctcatgagaacatagcatttgcctgctccagaggaagcagcattcaacgtaccatcttggaagcagagaccaggccctcactagacactgtgtctgctggagtcttgatcttgttcttcccaacctccagaactgagaaaataaacttctgctctgtgtaaattacccagtctcaggtgttttgttatagcactatgaagggactaagacaaatataaaaattacccagggacttaaaggaagaactgactaaactgaaatacatgccatatatattatgaatcgtaggactcaatgctataaacatactacttctcaacaaattaatctataaattcaagaaattcctacacaaatcccaatagaatttttttgtggaactcgagaggctgatcctaaaattcatacagtcacttgaggggccaagaatagtgtaacagggctggcggggctggtggctcacacctgtagtcccagtacttgggaagtcaagactggaggatggtttgaacccaggagttcaagaccagcctaggcaacatagcaagatgttgtctcaaaatattaaaaataaataaataaataaaaagaaggttaagtatgcacattttgttgtgaatttcaattttatagtgatttttttttttttttgagacagggtcttgctctgtcacccaggctggagtgcagtggtgccatcttggttcactgcaacctctgcgtgggctcaagcaatcctcccgcctcactctctggagtagctgggaccacagttatgtgccaccacacctgactaatttttatattttttttttgtagagacggggtttttccatgttgcccaggttgttctcaaactcatccacctgccttggcctccgtaagtgagatcacagacatgggccactgtgcccggtctagtgcgctttttttttttttttttttttttaaccaaacaaacgatgaagtctcaggagtaaaagttgatacacaagtaaattttattggtaatgtttttgtgtggtctttaagcagagggaaaattagtctgcattatggtgtatccagactaaataactgatattaaaatgaaattatccttaggatttgcaatcttagagaaaactttttcattttttttgagttacaaattatcttcacttacatttgagaacagtgagtcacagagggattaagtatcttactcaagatcttgcaagtgtttggtttgaacccaatcttttcactctgcagaactcagagtcactcttatttggaaactttttaactgatgtggatcctctaatatgggcttcctattattcattccgtattagtcagaagttttgcaagcaggcagaattcattttgccaattacgggattttccctcagttgcagtcaaggttcataaaactataactatttatctttaattataaattttgtttttgagacaaagtcttgctctgttgctcagactgggatccagtggcacagtaacagcccattgcagctttgaactcctgggctcaagggatcctccgcctcagcctcccaagtatctgggactacaagtgcatgccatcatccctggctaattttgttaaaaaaaaaaaattgtagagatagggtcttgcttcgttgcccaggctggtctcaaactcctggcctcaagcaagccttcagccttggtctcccaaagggctgagattacaggtgtcagccattgcacctggccaaaactgtaactatatatacacacacacataactacatatatatgtgtgtgtgtgtgtgtgtatgtatgtgtgtgtgtatatatatttttatatataaatagatatatctgaaaggcatcaaaagaaaaaagctgtaacttttagtcttgatcttgatagtgacttgattaggctatctgtttaacatcaaagatgcaaattaatgctttctttgggtgagcatattaaaaatgcagaaaatattggagtagttttttatgttaaataaattgtattctgtgtatttaaggtatacaacatgattttatgggatgcatatagatggttaaaaaaaattactacagtgaagcaaattaacgtatccttcaactcagatagttacccgttttctttttgtttggtggcaagaggagcttaaaatctcatttagcgtgaatcccaaatacagcacaattttattacctatatttctcgcgttgtacattatatttctaggcttgttcatcctacatatctgctactgtgtaacctctgagctatgtccacccattttctctcttgccccccaagtaatttcctaaagtgtctcatataaaaaggcagtagctttcagcttaaactttttctctgtatatatttaagtcaatttctttgaggtatgtttttctctccagaatagttagatgtaggcataccactttaatgttgacactagttcacctagaacttatcttctgcaaatctgtctctatgtccatctctgtctccatctttgtctctgtctttatctctgtctatctatctatccatccatccatccatccatctatctctctatccatctatctgtctatctaactaaagcaaattcatgcccttctcctatttatggaatcgagaccataaacagaggtgagggaaagaatttggcaggaattgcgatgtgtattacctgtggcataaggaaactttacagaactagggtcaaaagtatactttctagttctttcccatggcttttcactttgatgtagtccttatcaggcaactgaggttttatataagtcccctgattcttagaacatgaaggtgtagtattcaagtttggtcccttgaaaccacaatttttgttaaaaaaaattaagaaaattgtataatttcctcagcaaatacatattgatcatctgttatacagccatgagaagtggttctgttgaacacgtttattttatcagatcccaattctaaaccaggcatagaatggaaaccatgaaggtaggatgaaataacttctgaatgtttgaaaatagtgtacttaaaaataaatatcaggtgtttttgttttgttttttgttttttgtttttgagacagggtctcactctgtcacccaggctggagtgtggtggtgccatctcacctcattgcagccttgacctcccaggctcgggtgatctcccacctcagcctcccaagtagctgggactacaggcacatgccaccatgcccagctaattttttgtattttttgtagagacagggtttcaccatgttgcccaagctggtctagaactcctgggcttaagcgatcttcccacctcagcctcccaaagtgccaggattacaggcatgagccaccatgcctggctgaaaataccaggtttttaagtatcagcactgcctcttcaatcttttctattactatgttgtgctcagtggtattttttattgaattagagcagtgctgttcaatggaaccttctttgaggatggaaatcttttatgtctctgctgtgtgggtatggtattagctgggtatggggcacctgcctatagtcccagctactcaagaggctgaggtgggaggatcacttgagcccaggaggccgagtctgcaggttcgtaccactgcaattcagcctgtgtgacagaatgagactcagtctcagaataaaatgaaataaggaaataaaaatgtaattgttgaaataagaaactagtggatggattagacacgagaagaaagaattaattgtttaggcgattctctccaaaaagtaagtcagcatgtcacacagagagacatgaggatggatgatagggcagaagttggtgggcttggaggggagaggaagatcagaatgaggtccaaaatgtgtcttagtgaaatcccaggaggagatattaaaattatattagaaagtgaaagaaatagaagttttatttatttatttatttatttattttgagaaggagtctcgctctgtagcccaggctcgagtgcagtggcacgatctgagctcactgcaagctccacctcctgggttcacgccattctcctgcctcagcttcccaagtagctgggactacaggcacccaccaccacgcctggctaattttttgtatttttagtagagatgtggtttcacctttttagtcaggatggtctcaatctcctgacctcatgatccgccagcctcaggctcctaaagtgctggaattatacgcataagccactgcacccggcccaaaagctttgtgtttttacaaatattacacatgtttcttgtttaagaaaaaaagtcttcacaataacgtaggagaataagagaaacatttttccaaaaaagagaagtcattgtgattattttatcttattggaatgttggataatatagtctgcttcagtaatcatcaagcatgctatggattttccattttcataggatctgtatctcggttaaggtaatactggtaatttttgtactctatgaaaaatataggccaaaatcatagaccttgcatagaagctggatcatgaagacagctctggaggaacacacaggtacacacacacagacacacatatatataaagtatacacatatatatatttttaaaagcttttaaagcaaaagccggccctgcccctctcccagagttggcggcctctcccctctcttagggtgggtggggacagtggttgcctgggcagctttccttgtgagccaaaggtccctctggacacatgatgcctggccacgccccctttccctttcatctttctcattaaccaatgggcttggagcattaaggccacgcccctattctgccttctactgcatccctggttacgcctcctctggctcagtcgcacagctacctggtaggtgactggaggtgttgatcagtgcttggtgggattttgctgatgtggccccaagcccgcctccctccccaccctgcgatggcagaagaaactcgacaaagtaaattggcagcagccaagagaaaggtaaaaacacaccaggtcacggacccccaacccagccatagatcctctccaacgacaagactgctgccagagtccataccactcccgaggttcaccggactgggacccccacaccggtgcctctgggctacccccaccaaagttttgtcagtcagccccaccccttcagcaagcagcccagtctctgccctcaccaatcaccccagggtgactttgggcaggtgaatcctggggctccccgctcctttactgggcccccatctcctgccaccccaagcttgacctcccagggctttttgggctcacatctccaaggacctgggtcccacagccccagaccccaccctcaccagtcatccctgggtgactttaggctggtgaatcctggggctccctgctgctgactcttcccttccctcctgctgcctcaaggtggacctccctaggctgtgtgcactggtgtctccaaggacctgggtcccagctctgtttttccctcccctatcatggagcggtgactcggacatcatgctgatgtggtccctccccctcaccaggaagagtggaatgtagtgatgtcacggtccatccagtaactgtcattactgcaagactggcctttgatcttatgacccagtcccctaagcattgccaccccatttctggttcctcttgtcacagcacaaatttccagctggaaggggaatggagattgggacctaggagcaagaggtttcaggctgcctcactcccttaacataaacattgacagcgggaaaagcctacacttcccctgtgagctcaaaacattgacagtacctctggatggcaactggagaatgggtttgacttggtttggttttctcccaggcttctactttccagagagattttaacaaattttttgtgagttctccacctcacattctaattctccatggttctgggaccagactgcccttcagccagtggtctgtgaagtgagatttgctcatcttctgtggaatagatcttgggaaactgaacttgacagcttgaatcttcctcatattatgtaaacctggggtactttgagtgccacaggatacatatgggacatctttctgaagcatcagtttccattgattctcttgagatcaagagaaaaaacattaatgtacttagggatgacagtcacataggtttctaagagtataccagacttctctctgaaatgaggcttgggttgtcctctttctgataaattcccagatttaacagaaaggctgccttctgccatgaggacacattgatataagagtttgagaggtactggtgcacttcttcacactaacagacgtgtgaggatgtatgactaaaccacatggcatacagttcctgcctacttaatgtttacttttctacctctgcctctggttttggtccctggcagctgctgattcttggtaaaaccccagagtttggagtcagaagactgagtttcaaagttcgtctgtcgcctttttcttttcttctttttttttctagccatgatatcaatctctttgagtcactaaatgattgtgacaacaccttgtacagttgttggtatcattaaatcagatggtgtataagagtattttataaaaactgtaaaggaggatgtggctgcaggggctgatagttctcatgagtattactgctcttgtttctgacagttaaaagaatattggcagagaaacagccctggtgttccagcaggagccaagaggaacaggaaaacaaatggcagcatccatgagacagccacttctggtggttgccactcacctggagatgtgagtcttggctgactaggttcctggggacaggggacccaaggggcactagagggtaattgttaagattgtggatggactgttgggtacctgtgaagaattctgggtttgaatcctgcctctttgtctgctagggatatgaattagggcaagttgctagacctcatcgggcctctcttttcacatctgtataatagaggtggtattgtttcacttccatttgtgaagtttaaatgagatttgttattgttgtttttatgttaatccctagtacatggcctgctgtaaacacccagaacacccaggatatggtcattgctgttcgattttcctcatccccagtctcaaggggaagccaggacaatgagaacagtcacttggcacaggagtcactgaaagggccacagggtgctgtggtggggagataagaaccatgagagaagttggcacaaaggagttatgggacaaagggtccaagataggcagaaaagaaaattgtgccagttgatggggaagaaaagaagtcagagggcttagatactgagtgggacagaacatcttcatgtgcactctcatctcttgtagtcagcaacaggtatccacggggagagccctacatcatctgctaccctgaaggatctggaggtaagaggctctgggcagaggtgcagtgaccctgcaggccagccctccaacctcctcctccaggtgggacggggtgcccctctgccagctgagacagtccacacacaccccagccctaatgattgctctctctacctctccccccactcctcctccacctcctcctctctgcatgcgcctcagagcccgtgccaagaactagcagtagtcccagactcgaggtccgtaaaagtcagtcaactgaagaacaccatcaaatctttggtaagagtccactggggtcccctgattccacgctgccaatcctgggctctagtttccccttggggccctgaagaaaggggacggcggcccctggtgccaagggcgaatagggagctggggcgcccaggcctcacctggagggaccccggagcatgcagcatggctctttttttgctgccctgtttgctgactctcccctctccagacgcccctgctcgagtccttgctacacacgccctgggattgttgcctcttggggaagtgctagcctgactggttgtcaggggccccgtatttctgccatgactcagtccctaatttgctctttgattctggacaagccacctctcctttttgggctcatgtttccagaggaagtagtgagtatcaaaggtctctgttagctctcgagtctgagatttaaaggcctcctagaatggaaacctcagggccaaaggctcctgtctgtccttttccgccctaaatcttctgtgaagaaccgtacttggcccgtacgtgctcagtaaatgtttattgaatgaatgcacttttctaaatcacaagctggcagaagggggggcctttctcaaactccatctctagaggtttatgttactgtcctgtcaagagattccagattcagaccttgagttctgtggctgtggacaaaagccaacaaagacccaaatcctctgtccttgggagcttgaggagagtttaccagttcgagttcccactgggtctgagaactttgcctttaaaatccattcctggcccctgcctaccacttcctgctctggggaatagagttgagggggccaccctccatcaccttaatgtgactctccccacagaaacaacagaataaacaagtggaacatcagctggaagaagtaacatgatttctttgtttgctcgcgacatgactgctcggtttgggggacactcagatgtagaggccccgagtctcgtctcacccactcccagcctggggaagaaggctcaccccccagagtccaccccatcccccacagggtccctgataacccggtcccatgggtgggcctgtcccggggcaggggcagtggtggcattctggggacatgtctcttgcagtaccatctctgcctctgcctggttagatctctgtcttcctcttcctacaggaaaagaaagcaaacaacgagaaacagaaagccgaaagggagctagaggtgagtggacggtgtgcagttttctcctgtcctccggagaatgtttctttccttctctttcagcacttgcttggcttttctcccaaaggttcaaatccagagattgaacatacagaaagggaaactaaatacggacctgtaccacacgaaacgttctctcagatactttgaaggtgggaatctgggtaccctgtcatccttcaacctggcactttgacaggtcttcagggggagtcctttgggccccatctcaactctctcattacagaagagtccaaggatctggccgtccgtctgcaacattcattgcagcgtaaaggagagttagagcgggctctctctgctgtcaccgccacacagaagaagaaggcggagagggtgagtccaaccacctgccccgtcccctgggagcctggcttcgcagacagaggagtgagcctaaaggtcccttctgcaggatggagtgtcctgcccagaaggcagcatggccatttctcactgcttttttgtatggttgttagcggcagcttgggactgagtcagctgctgtgggtgagttggggggcactctggggagagagcacaggacgtagagcttggaggccaagtgcctgccatgcctttacctggctgtggtcttggccaagtcctcagtgggtattgggtacttgtactgtgaaggtacagaagagtacctttagtatgttaccatttctgtagagagaggaaacgtgtgtgtgtgtgtacatattatgataatatacataaaatatgtttgcaagtgttcataaaaactcaggagagagcaacagggtggctgggagatacttcccttctgtaccttctgagtttgggactatgtgaatgtattatcctttcaaaaagtgaacaaaagattaattttccccttcctagctgtgcccccacccccagcaagaaaaatgggcttagagaattggatagatctgggtgtttaaatcccagctctgcctaagtgatcttaggcaagcacttaacctcaaatactccatgttttttcatctacacaatagaggtcatcatagtaactgtctcccatggtagttgcgaggattaaatgggattgctagcatggtatctggtgaagcactccataaaagttcaaacagtggtaataataacagtaataacaatagcaatattatctgatctctctgggcctctgttagccagctataaattcgatctctttccctgtcccttccaactttactgagttctttaaaaaccaaaccacgggcttggaaatgccttgatctttactgaccgagttgtatattgggcctagccctggcccttttaaggggcactgtgtggaatggcccggcctcaccagattgaaacttctcactcttcagcagttctccagccgcagtaaagcacgtatggagtggaagttagagcagtccatgcgggagcaggcactgctgaaagcgcagctgacacaggtgaggtgttcagagggagggatgtggaaggaagatgaccccaggtaaccaggagcaggtgaggaccagtgacagcccttcctaatttctgtgcccattcttgcagttgaaggagtcacttaaagaagtccagctagagagggatgaatatgctgaacatctaaaaggagagagggcccggtggcagcagaggatgagaaaaatgtcgcaggaggtgagatctgacccttcagcccccccacattagataggtcactggatctttctgggcacctgtaaaatgggaatagtagagccagaggtggtcctgggactgggctttgtggaggtgggggcagagagggagatggtagcatgtccagcctccagcccctctctccagggccctttccccctgtgctttgggcaggtttgctcgttgaagaaggagaagaagcatgataaatatcgggtagagaagctggagaggagcttgtccaaactcaaacaccagatgggtaagatggggctggcgtgacctggcagcaggactggcatcagagggctgtgagggtggcttggagtgccccagcgaggtgggtggatggaagggctttgaggcagagggaaagaggtctgtgccaggagacggcaagtcttgtcatctcaatgagcctcagtgtccccatcagcaaagagggcccgttgtcagccacccgcagtgctctttctctgaaagtgctttggaagactggctaccatctgggtgcgaggaatcattagcagtgaggctaagtttgaggagccggagaggagctgtgcgccaagaggagggttttttcttttcttttcttttttttttttttttttggaatccagaggctcttattgtctgcttcctttctcagctgaacctctgcccccggagcccccagcagtgccctctgaggtggagctgcagcacctgaggaaggaactagagagagtggcaggagagctccaggcccaggtggagtacaatcagcgcataagtctcctgaatgaggggcaaaaggagaggcttcgggagcaggaggagaggcttcaggagcagcaggagaggcttccagagcaggaggagaggcttcagcagctggccgagccacagaacagcttcaaggagctggtgcgttgccccagctggggagcctgccctcctccctagccctccaggcctttgtttccccacctataaaatggggcagtgtagccctcaagtgaaatgttactcctaaaggcacctgtgagccagagccctgctctggtggctgtgggagacaggggatgatttttctaacctgcctccacccttcccggtgccatgggaggcagtcaccaagttctggggtctccagctgcagtgggtggctgctgattgcttctctctgtccagaacaatgagaacaagagcgtactacagttggagcagcaagtaaaggagctgcaggagaagctaggcaaggtgaaggagacggtaacctccaccccatccaagaaggtctgggaggtgggtgggcaccagcctctggggaggggaggtgccaggccagcggtagctccagcccgggggcaggtgaccccagcaccctccagggcagtcctgtggctgtttcttgcttcctgccctctgattttagaggtgggtagccctgggctcctcccaggtctggacatcatcattccagctagagacatggagcccccccaatcacaggggaagagacagagtggtataacagtcttcttatgccagatgcggtggcttacgcctatagtgccaacactttgggaggctgaggcaggagaatcacttgaggtttggagtttgagatcagcctggccaacatggtaaaacctcatctctactaaaattacaaaaacaaaaaacaaaaaaagaaagaaaaattagtggggcatggtggtggcgcatgcctgtaatcccacctactcaggaggctgaggcacgagaattgcttgagcccaggaggtggaggttgcagtgagctgagattgcaccactgcactcctgcctgggccacagagtgacactctgtctcaaaacaaaacaaaaagactccttagattaaaactggattccagcctcagttccactggtcaccattcaagtacttcgcatctctaggtctctgtttctttaacttcaaaaggaagttagcattttccttacagaggtgctgaggattaaatgagataatacatgggaagcattaggcctgtagcacatttagcagatggtggttggctcccatacttttctaccattctgtggcctacagttgaaatggtgggaagaggacatgagatttgaggctggggaaggaggcatggggttctaggaaagcaaggcagtcacttaggcctgaagtaaggggccaggggcctgggcaggcgacagagccccacagtgccctcgctaccctattaatgggcccagaatctgcaaaccagccaccacgtgccctcacacccagggtcttcctgcaggtggagctgaagagccaagaggctcagagtctgcagcagcagccagaccattacctgggtcacctgcagcagtacgtggccacctatcagcagcaggtggccgcctatcagcagctgacctgtgagaaggaggcgctgtacaggcagtgactgcagcagacccagctaatgaaccagttgcagcagcaggaagcttggggcaaagcggtggccgagatggcctgccaaaagttgcaggagacccaggggagggagctgccgaggatggggctgtgagggggacgacctggcaaactctgtgccttctcactctttcctggccccttaggagcgtctggaagctgccagccagcagaaccagcagctaacggcccagttgagcctcatggctctccctggggaaggtacgggagaccgctcagaggaagaggagagagccccaggaggaaggggggactgctagcagcatagtattcaggagttggaagagacctttagaacagctggtcattatactaaccgggtgcctgcactaagttcagcatcaatatggtgacctcctgtgagcggggggccaccaagttgcctaaggatggctgaactggccgaggtcagaaagggagcaggtcagaactcccgcaccgaccagtagtgggaatgtgcctgggcagtatagcaagatcttggttcttcaaagtaaaaataaataacagcagctcattcctctctggggagggcctggctcagggttacacaatgagggtggaggcagaggtgggcccacaatacttcccttgttgagttgtctgaggacccctctggccaccacccccacccccaggagatggaggaggacatctggacagtgagggggaggaggcacctcggcccattcctagcatcccacaggacctggagagcagggaggccatggtgagcctgactccacctgaacccattttgcctccttcctctgtggtccctccaagacccctttatgctcttcgtttccctgccttctgatttctctggaccctcaccccttctgggagccagtggtcagacaccatttcacctgtgaccaacatgtgcagtctctggggccccaagggaaggggctgcgctccacctctctgccccatttgttctgtgtatgcccctgcaagaatgctcacatcttgccctcaggtggcatttttcaagtccgctggagctagtgcccaggagaagcaggcacagttacaagagcaggtgaaagagcagagggtgtgctgccagcgcctggctcacccggtggcctcggcccagaaggagccagaggcagccagaggccctggagccccagggcctgggggcgagtctgtgagtggggagacccaccgggccctgcaggaagtcacggagaagctggcccatgccggaactcacctccgccttctccatgacttgaaaatgccacctgagggcaggtcgctggcgagatgtgaccccattattttggctccagagcggctttatggaccacctggaggagaaggcagacctgagtgagctggtggagaaagaagaacttggattcttccagtactacagagagagatgccatcagtgagtgggaggccagggcatggcagggggagctgcagggctgttggaggggccccagcgtctgagccctgtcctcccgcaggaaagtttatcaccctataacaaagccagggggcagtgccaaagatgcagcaccgggaggaggacaccatcaggctggccctggacagggaggagatgaaggtagagtgtgcaacatctctgcgggggtgggggtggctgtgacggtgagcgctggcagcagcgtgacagctgagcacccctccctccaggtgaagctgctggagctgcaggagatggtgttgcagctggtggcgactacaagggacacagcaaattcttggtgactgcccagaaccctgctcatgagcccagtccaggagccccagccccccaggagcttggggctgcccacaagcatggtggtgagtagagccctcaggcggggtgggcaggcaggagcaggggggctctcactgagctcagatccccgcctccctctctccaaagatctttgtgaggtgagcctcactgacagcgtggagcctgtgcaaggagaggccagggagggttctccccacgacaaccctactgcacagccgatcgtgcaggaccaccaggagcacccaggcttgggcagcaactgctgtgtgccattcttttgctgggcttggctgccaagaagaaggagataaacatcaccatcgtcaaagagctgctgaagaaatttttaaaaaagaaacaaagttatggggttaatctcctacacaattcatttacttcgtttgaatgttatagccacttatgattatttgtgtttctaatttatagtttaagtttatttgtaaatagttaaaagagagtgggtctctgtggctttcactgatgttcactctggcatactttcgcaattttctttttcaatttcataattgtaggtcattagcatgcatattgagtttgcccttacgtggtgggagttcaaacacacaaagacccactatttgcacaaaactattcttgctggtttggaataggctgccatgtgtttttaatgttattgcagcatgtatattcattacagaattcagataaaatgtgcctatgttctgctgttgtttgatctaatcttaatcacagtgagctcttcattagcacaatatgtggtttgccccaagtgtgcactatttaatactttgtaatatgccaccaagagtactgacatttagagttgtttaaaggccgagaactggaaacagcctttccctcattttctgtgtattggtgatgggagtaataacattttgggggagctttttaaatttcacagaagaggaaagttgcctgctctggcaggtatgtgcaagatagagtgtgtttcatttgttctgttgccaagaattagtgctgtactattgtagttcctttaggatttgtatgtgctctgggctcatgaagatattgcatcatgagcttcagcagttgtactcttttttgatgacctaaaaagggcttatttctgaggaatgaaaggttcccatcattgactacggatgtggaaaacctttcctagcttagagcatttgtatctatattttaaagtcagagttcatgttacctgttttaatcacatgactgcatgtcccagtacacaaaagggcactggttggcattcttcttaatgtatttagtaaagatcagaagaaatcctttaagagttcaaatgtccctggaacaggcatacaggctctagtcaagaatgaattagagtgaaggaaagctgtgtgacacctggcattcctctgttcatggagcttctttgaggcttgaagattgattttaccatctagaccactctgcctattcttcaaccaccttggttactttgacataggaattgacttcttttccttgaatggaaaacactttgaaataataataaacattgttataaactaatatatgtgagagtgcttagttgaaacaaaaaggagttttagtagacagtattatactatctttgaaaatcaaggagaagtttatgcaacttaaaatgtgtacaaactgcagtgcaatctactgttggtgaatgtcagtgtattatcaggaaacatgtctatacaatcacagagttatatttcctcacaaacttctttgtgaagagtgaaatgtgtttctgtacctctgggtttcacttacgggcatattttgtgcagtatttatgtgattgtgcctatgcatgatgaatgaatgaatttcagttgtacattgcctaaatcataacttgatgatgcttgggaaagactcaacagttaaaacttcatgaagttctaatgtctgtgttccaaaacacatcacattattaggatgtagggagatatgtatgtgtgctccctggggtggggatttctagttactagaccatctccatttttagcatttggcatcctcatgatacttttataaatacgacattaacaggagagcagcagtacgattttgccgatggaataacagatttgccggcaatcactgaaagagtgcaaacatcgggtccttgtgacttcaacggactcttccaaattgtatgaatgtatcaatgtattagataaacccagtttcagaatgataaagaaaaaatgttagaccaaataatgcggctagttaacagtggtacgatttctcgcccgtggctttaaaatgcacttaaagtcctgtccttgccttttattttctgaacttgatgtttttgcattctttgagttcagtttaaagacaactacgagcatctgtaaccaatctgacaataatgtgttcatcaggtgcctgtggattaaatcacatactggcatatttaagctgaatgtcaatctggaaaataaattgactgtattaacggaaataccactctttgtgtagatatttgtcgtatattgaagaaaaagctaaaaagaatggaaatcgcatgactataacttaagtctttcttcaaagtgcatgcagtcttttgcgatacctcattcagccaagtattggtattcttcctcattcggtataaggcagctttcaatttgcttagagggcaacattggaaggttagagttcatcagaaacagaattctaaaatgtgagttcaattcaataaatttgaatttctgtaggaagaatcaaatcaccgatttaaagattgcaatatataataatcatttttaaagtattggattaaatctgataggttttccagaaatgaacaaaaatcagctctaaaaccaaagctgatttttagaaaatttgaaaatgtaaatcagccctatccatactatagtttctctaaaactttatctgaaagagtcattttaaaataactattaaacaatgtaactgctatcttaatgttctgaaataagttaaaacattttaaaatatgaatactgtaaaggaaataaacggtgggaaggaaaagtagagaaagaaatgccaattccagtccaaagctttatttgccaagttttcttagaatgaattttaccaatttatgaattcttgtaagcggaatgtaaaacggaaatactgaaagacttttgcctaaagtggcattattgactgctggtgtgatgctactgtaatgtaataaattattaagttgttgcaaagtgctgtttttgccttaaaattttattctgtgtgtcttcaaaaatatagtattaaaggtattgatactgtgcaaatgctgggcatgcttggcatgagataatgtttcatttttacaaaattgtaatataactatgcaagggtttattaaaagaacacaaaataaaaaagttatgggattaacaaaagttatggggtgaaaaagttatgggataaaaaatgtaaaaaagttgtggcaaaaaaatcttgtgaccaaaaagtagaagaaagttttatgaaaagttaccaaaaaaagttatgaaaaagaagttatgggatttaaaaaaaaaggcatgggataaaaataaaaattaaaattaaaagcaggcccctgtcagcaaagcctggagaagtggggccggggtctccaccaccacactgtccctatctccccttcccagtcacccctttacaattagggtagcaggacaagacctctgtctaacgaggaaagacaaacagaccctttgccaccttgaccagagctgagtccttaaatttctggatgatattgttatttaagagccagaggctggtggagttggtttgtttggaggaggcctcatggcctccttactctcaccatagcaacttttccctcagtgggggctccaatcttcttattcagagaggtagctgaggcaggacagtggggctaactgtggaccaggcgaaggcacgggctgctggggtggccccccttccccggtgtatatattgtgtctgtgtaaggttttgtatattccagagggtagggccacccctgtatcatacctagcggtggttggaggtggcacatggggaggaggttctaataattatttgtggctgggaaacttacttattgctagcataggacagaggaagaaggcagggatggggtcatggcttcccagtggtgtgatcacagttcactgcaacctccaactctcatgctcaagtgatcctcccacctcagcctcccaggtagctgggagtataagcatgcactactatgcctggctaatttttaaattttttgtagagaaaaggtcttgctatgttgcccatgctggtcttgaactcctgggctcaagcgattctcccatcttggcctcccaaagcactggggttacaggcatgagacattgctcctgtccataagattttctctttattactgttttgttgttggtggtggtgttttgttttgtttttattttttgacagagtctcggtctgttgcctaagctggagtgcagtggtgcaatctctgctcactgcaacctccgcctcctggttcaagcaattcttatgcctcagcctcccgagtacctggggttataggcataagccactgcgcctggctaatttttggatttttagtagagacagagttttgccatgttggccagattggtcttcaactcctggccttaagcaatccgccctcctcagcctcccaaagtgctgggattacaggtgtgagccactgctcctggctaagatcccatctctatttaaataaaaaaagaaaattcagaatctatggaacacagaacaccaaaggccagttatttacctctctgaggtaatctgtgtaaacaatttgatatatatcctttcaagttcatacttgctatgcatacatatatatatacacacatacattgacatattcccccttccctgctgtcatgctattagtcttcttttttttgtagaaattggaccaactctatgttctttgctggcccgtatttctcctattcagtgatgtgttatgaatatctgtttaagtcaatgtatgcaactctttaatatcattttaaaaggttacgacatacgatcatatgaaggcattagaatttattccaacagttcccttttgcacatttaataatttccattgatttgccaggaagaacattctcgtgtcatggctaaatccttttgtatggacatccttaattattcccttaagataaacttttaaataaagttgctagattagtctcgtttcttaagttcttttttggtagtttatatgtaacactgtagttttatatgtacttacaaatacctatagtgccagtagaaaatgggataaaattaaactctttcacatatgccaaatatattttgatttagcgctttattaagtgcatgattacagtctctgtatcttttgatttacctttctatctttacaattttcagccgagatacttagaggtcacatgataaattaaggttttctttttttaataatctccatctttctaaatatggtgagtcacagtcagctatttttggattgttgaaagctgtgactgttctaaatcggagcccagaaatcacgccacttaccaaatatgctttgtcttccaacatcagagtgtctggtagaaggtgactgttcttggaatttaaaaaatctgaacaggacaagacaagaatctggacactttttctgtttctgataatatgattgagtaggtagacacgctggataatccttgcaaagacatacttgaacttcccaaaaaaaaaaaaataaaatccagaatctctaagaatgaagatggagtgaaaatcagaagggctgctgagagaataatggggaagcagccccagttatcaagggacatgtccatgtgttcaatagaaagtttcagatgtaaaaaaaagttgagaaaaataatatatatattatatataataaatgatataattgccctacatatacacatcatcaacaatttttcattcatggtatggacagtttttttttttggttgctttttgtttgtttgtttgtttttaaaggtgggattttgctgtggttgcccaggctggagtgcagtggcatgatcttggctcactgcaacttccacctcccaggttcaagcgattctcctgcctcagcttcccgagtagctgggattacaggcacccggcaccacatccggctaattgttgtatttttagtagagatggcgtttcaccacgttggccaggctggtcttgaactcctgacctcaggtgatccacctgcctcggtctcccaaagtgctgagactacaggcgtgagccaccacacctggccacagccagttttgtttcatttatattcccacttcatttatatacattccttcttcctctgaattattttgaagtaaaacctatacatcctatcatttttaattaccttatatgtatctgtagaagacaaggaattcttaaaaataaatatattcacaatgccattaaatatcaaaaaattaatattctgaaaatagccacaaatccagagttgacattttgttgactttctcataggtgattttttttctagtttatctatttcaatcagataactgtttgctcatatttacattccttactgaacaatgtctaaacttaaactgacataaaatggagatgatcttctaaccagatgcttagtgtaagaaaaaacttcaaactgcaagaggagtccctccaaatacagaaaggaccagtattttaagaggtatgttaactaaaatgtggcaatgtaaggagcaaagcaggaagaacctttaagtcctaaacttacaagtcaatttcatagtcagtttccctggtccttccacaacaacctcccccatctgttttctctacaatggaggtaacaatagtagctattccagagcaggaaaaggcttagagcagtgctagaagagggtcgtggctatataaagtttagctatttgtatattgtaacaaactaactttttttggtcaataatagatttctgttggaaaagtagcagcctcctgtctggggacacctgcagttccactaagtgaacattggtgtctgctaacctttgcctctatttctctcaatatactgtgaagctgttcctggatttagcaattttatatacttctttttattattctttttttcctttcccttttcctgagacacagtcctgctctgtcacccagtctggactgcagcagcgccatcatggctcactgccacctccaccccgggctcaagcaatcctcctgcatcagccttcagagtagctgggactacccaggggggcccaccaggtctggctaatctttgtggtttttgttttgtttttccgttaagggactgggtttccggccaggcacagtgactcacgcctgcaatcgcaccacccctggaggccgaggccggcggatctccccaggtaaggagcaggagaccagcccgaccaacatggagaaaccccatctcaacctaaataaataaataaataaataaataaataaataaataaataaaagtagccaggcttggtggctcacgcccttgatcccagccactcaggaggctgaagcaggagaatcacccaaacccgggaggcggaggcccggcgagccgagaccgcgccactgcactccagcctgggcaacaagagggaaactccgtctcaaaaaaaaaaaacaggtttcaccatgttgcccaagcgggtctggatctcctaggctcaagcgatttgccacactcagccgtccaaaatcctaggatcacaagcgtgagccatgacgccaggccgatctattcctgtctgattaaaaattgggccggttgcggtggttcacgcctgcgatcccagcaccccgggaggctgaggcgggcggataacctgaggtcagattgaggccagcctgagtaacatggagaaaccccatctctaccaaaaaaaaaaaaaaaaaattagcagggcatggtggctcacgcttgcaatcccagccactcgggaggctgagccaggagaaccacccaaacccgggaggctgaggctgcggggagctgagaccctgccactgcactccagcctgggcaacaagagtgaaactccctctcaaaaaaaaaaaaagagagagagagagagactgagtttcaccatgttgcccaggccggcgtgtaactcctaggctcaagggatccgccgcgctcggccatcggaagtcctgggatcacaagcatgagccgccacgccaggcccatctgttcctttctgattaataaattgcgcccggcgcggtggctccctcctgcaaccccaccaccctgggaggccgaggcgggcggatcacctgaggtcgggagtttgagaccagcctgaccaacatggagaaacccgtctctaccaaaaaagaaaaaaaaataagctgggcatggtggctcacgcctgcaatcccaccaccccgggaggccgaagcagacgggtaatctgaggtcaggagtttgagactaccctgacgaagggagaaaccccgtctataccaaaaaaaaaaaaaaaatacaaaaagagccaggcatgttggctcatgcctgcaatctcagccacttggtaagctgaggcaggagaaccacccaaatccgggaagcggaggcagcggggagctgagaccgcgccactgcactccaaccgggcaacaagagtgaaactgccgcaaaaaaaaaaaaaaaaaaaaaaaaaaaaaaagagagagcgggtttcaccgtgttgccccggcctgtctggaattcctaggctcaagggatccccggccctattcctttctgatttatagattaggccttgcgcgctggctcacgcttgcaatcccagcacctccggacgccgaggcgggcggataacctgaggtgggaagtttgagaccagccttatgaacatggagaaaccccatctccaacaataaaaacaaaaacaaacaaaaaacaaaatgagctgggcatggtggctcacgcgtgcaatcccagccactcgggaggctgtggcaggagaaccacccaaaccctggaggcggaggcccgttgagccaagacctcaccactgcactccagcctgggcaacaagagcgaatctccgcctcaaaacaaacaaaaagtgaccaggtttcaccatgttacccaggcaggtctggaactcctaggctcaagcgatccgccgcgcttgccgtccaaattcctgggatcacaagcgtgagccaccatgccaggccgatctagtcctttatgattaataaactggaccgggcgcgctggctcacgcctgcaatcccagcatccccagaggccgaggaggcgggcagataacctgaggtcgggagtttgagaccagcctgatgaatatggagaaaccctgcctgtaccccccccgccaaaaaaaagagagaccgggtttcaccatgttgcccaagccggtgtggaactcctaggctcaagtgatccccagcgctcggccgtccgacgtcctgggatcacaagcgtgaaccaccacgccaggctgatctattcttttctgattaatcaattgggccttgcgcgctggctcacgcctgcaatcccagcatccccggaagccaaggcaggcggataacctgaggtcctgagtttgagaccagcctgaccaacagggagaaaccctgtgtgtaccaaaaaaaaaaaaaaagaaaattagccgggcatggtggctcacacctgcaatctcagccactagggaggctgaggcaggagaaccacccaaacccaagaggtggaggtggcagggagccgagactgcaccactgcactccagcctgggcaacaagagcaaaactctgcctccaaaaaaacaaaaaaaagagagagaccgagttccaccatgttgcccaggccagtctggatctcctaggctcaagtgatccccagtgctccatcatccaaagtccctggatcacaagcgtgagccaccacgccaggccgatctattcctctctgattaataaattaggcggggtgcagtggctcacacctgcagtcctgtagagggatttttaaggaattagatagactcatggggtttaggaggacatttattaattatttaggtgcaccggcccagtcggattaacatttaaaggattgagcactgaaccaagagttacctttcaagcattatgtggggcgaagggggagatctgtgcagggagaagcatattatagaagcgagaaacaaagattgttatttaattgaaacatgcattatattattttttactatttaaggaaaaatatgttttgtgacttgagtttatttgtttagtgaccttgtagttgcacagttaaggaattagtcgggcatggtggctcacaccgcaatcccagccactcgggaggctttggcaggagaaccacccaaaccccggagacggaggtctggcaagctgagacctcgccactgcactccagcctggacagcaagagcaaatttccccctaaaaaaaaatatatatatatgactgggtttcaccatgttgtccaggccggtctggaactcctaggctcaagcaatctggctctggatgtctttaacttgtgattgaaagcgtattaagatgttgggtgtatcaacagtccggaggacaagaaggaaaatcctggcatgtgaaatattctgcaacaagaaaagcaatcggagaggtgactacattcactgcagctgttttgccctcttcttccccacccgccccccccgtctctttcctggaagttccctagtaagaagtaaaagagataatggctttcgagtgcatgtttttcctggaattggaaggaattttaacaaaggagcccttcacaatgaaacccccccacacccctgcttttcacctgaagtaggacaagatcgtcgcccccaccatcattctccacgtgaccccaggtggggatgggtagtggacactactgataagctcttagcaatttccctatttgtggactctgaagctccttagcttgacaactgatgcataagttttcttttgtgggataagaataggagaataggtgaccttttccccctgaattcccatcctggggccagggaagagagcccaggatcccttctcttggccttcacactgtgggaaagagtacctagagttaaaagcctgataaatgccctcgaacagctttgaaaatcacaaggtcaggagatcgaggccatcctgcctaacacggtcaaacccgtctctactaaaaaaaaaaaaaaaaaatacaaaaaattagccgggcatggtggtgggcgcctgtagtcccagctaccggggaggctgaggcaggagaatggtgtgaacccgggagggggaccttgcagtgagctgagatcgaaccactgcactccagcctgggcgacagagcgagactcagtcttaaaaacaaacaaacaaaaaaaaaaaaaaagaaaagaaaagaaaaaagaaaatcactcggcgtgagcgcttgccccctgaacaaatgtccaagtgtatcactatgggaatgcctcttgggtcacagacacagaggtaattctctttgtaaatagattcatgtcatttgtctcgtttctgaacagtttcaaaagaattatttggtgaagtcagtttcctaggagaatccatcacatttccccagaggtatttccacccttgcaaaccattagataaagaacaggtcacgcacagtggctcacacctgtaatcccagcactttgagaggccaggcgggtggatcatgaggttagcggatcgagaccatcctggctaacagtgtgaaaccccgtctctactaaaaatacaaacaattagccaggtgtggtggcaggtgcctgtagtcctagttactcaggaggctgaggcaggagaatggcatgaacctcggagacggagcttgcagtgagccaagattgcgctactgcactccagcctgggcgacagagtgagactttgtctaaaaaaataaaaaaacaaaaacacgtaaagaacaaattagtcctcgtggtaggccacccccaccccatctccagttcaccacttcaatcatacgactttctcagtggacttgaagccaagctttcacatcagagccctccaaccaagagcctgactgtataactcctaagaacaatcaagtaagaatgtttttctttccattcctcacatctggtatctgttgccttgtgaatagggtgcccatcagcaggaagggttagaactagggtaagtgtgtagggagcaaggcttgaaaagaaacagatgaggaaagagtagcaaaatcaagactgtcccaggaagtgagtgtcagtcaaaggttttgaaatccctcaaatagttacttctgctgtcttggttttgtccacctcccttcttttttcacatacctgccaccctaaaaagtaatacctatgcctaacatagagctaaccagttaaagaactgctagtaactttagaaaagagtccctttcccatcagaatcagaacaaaatctttttaaaaaaattatttttggccaggcatggttgttcacacctgtaatcccggcactttggggggctgaggtgggcggatcacttgaggtcaggagttcaagaccagcctaaccaacatggtgaaaccatgtctctgctaaaaatacaaaaatcagccgggtgtagtggcatatgcctgtaatcccagctactcgggaggctgaggcatgagaatcacttgaacctggaggcagagggtgcagtgagccaatatcgtgccactgcactccagcctgggtgacacagcgagactctgtctcaaaaaaaaaacaaaaacatatatatatatatatatatataaatatatatatatataaatatatatacatataattttttcaggcaggggcaatggcttatgcctgcaattttaacactttgggaggcagaggtgggaggatcattttacctaggagtttgagaccagcctgggcaacatagtgagatcttgtctctacaaaaacagttttagtcaggcgtggtggtgcatacctgtagccccagctacttaggaggctggggcaggagaatcctgctgctgcattttgtgctacttttaaaaatatttggtaaaattcaggagtaaagccgtcgggtcttgggcttttctttcccgggaaacttttttttattttttgagagggcgtctcgctctgtcgcccaggctggagtgcagtggcctgatctcgactcacttgcaggctccgcccctcaggttcacgccattctcctacctcagcctcctgagtagctgggactagaggcacccgccaccatgcccagctaattttttttttttttgtattttttttagtagagacggggtttgaccgtgttagccaggatggtctccatctcctgacctcgtgatccgcccgcctcggcttcccaaagtgctgggattacacgcgtgagccactgcacccggcttttcctgggaaaattgtttccgtctcactacttattggtcttttcaggttttggatttctttgtggttcattcttgctaggttgtatgtatctaggaaagtatccatttattctagattttctaatttattggtctatagttgctcatactagcctctaatgatccttagaatttctacagtatcaatgaaaatgtccccattttcatcttgattttatttatttagggttttttgtttttttttagtgtggctaaaggttactggtttggtttatcttttttaaaaaacgaacttttcgttttgttcatattttgtattttttcatttcaatttcattaatttttgctcttatctttattctttcctttcttctatacttattttgggtctggtttattcttgcttttctagttcttttaagatgtatcggcgccacgggccccgcagagccagggcggctcccgccggtagcctgtgtgtgggccccggccagccgcgcccccagtccatatcgcccttcactgccccgaggctggcgcggctatggggcgcggggccggcgctgctctggggcgttggagccgcgcgccgctggaggagctgctgccggggcgggggtctgggcggctcggggggccacgcgggcctcggacggctcccggggctgtgggcttgggcccggcagctgcaggtgcggggctcttgccggccgggcgctcctcggctcccgcgcgccgggttcccgggcggtcccaccgccactgcctgggcaggggaggaggcctggcggcgcgggcgggcggcgccttcccgggacgaccagcggctacgacccatggcgcccggactctcggaggccgggaagctcctggggctggagtaccctgagcgccagaggctggcagctgcggttggatttctccgatgtccggtgttatctccatgtctgcccctttcttcctggggaagatcatcgatgccatctataccaaccccactgtggactacagcgacaacctgacccgcctctgccttggcctcagtggcgtgtttctgtgtggtgctgccgccaatgccattcgtgtctacctcatgcaaacttcaggtcagcgcgttgtgaagaggctgagaacttcgttattctccattctgaagcaggaggttgctttctttgacaaggctggcacaggggaattgattaaccgcctctcatcggacactgcactcctggggcgctcagtgactgaaaacctctcagatgggctcagggccggggcccgggcttctataggcatcaggatgatgttttgtgtctcacctaatcgggccacctttgttgtgagcgtggtgcctctagtgtcaatcattgatgtaatttatggacgatatctacggaaactgaccaaagtcacccaggattcgctggcacaagccactcaggaggaacgtattggaaatgttaagaactgttcgagcttttgggaaagaaatgactgaaatagaaaaataggccagcaaagtggaccatgtgatgtagtcagcaaggaaagaggcattcgctcaggctggcttctttggagaactaggctgtccggaaacctgattgtgctttctgaacctgtacaaaggggggctgctgatgggcagtgcccacatgaccatgggtgaactctctcccttcctatgtatgctttcggggttggaataagcattggaggtctgagctctttctactcggagctgatgaaaggactgggtgccggggggcgcctctgggagctcctggagagagagcccaatctgccttttaaggagggggaagggttatcttaaatgagaaaagcttccagggtgctttggagtttaagaacgtgcattttgccgatcccgcttgcccagaggcgcccatatttcaggatttcagcctttccattccgtcaggatctgtcacggcactggttggcccaggtggttctggcaaatcaacagtgctttcgctcctgctgaggttgttcgaccctgcttctggaactatcagtcttgatggccatgacatccgtcagctaaacccagtgtggctgagatccaagattgggacagtgagacaggaacccattttgttttcttgctctatcactgagaacattgcttatggtgctgatggccttcctctgtgaccgctgagcaagtccagagagtggctgaagtggccaatgcagtggtcttgatccggaatttcccccaagggttcaacactgtggttggagaaaagggtgttctcctctcaggtgggcagaaacagcggattgcaattgcccgtgctctgctgaagaatcccaaagttcttctcctagtgaagcaaccagtgcgctggatgctgaaaatgagtaccttgttcaagaagctctagatccactgatggatggaagaacagcgttagttattgcccatcatctctccaccattaagaatgctaatatggttgctgttcttgaccaaggaaaaattactgaatatggaaaacatgaagagctgctttcaaaaccaaatgggatatacagaaaactaatgaacaagcaaagttttatttcagcctaaggaaacaattactggtaaacaacatgagagactttaatgcaaaacagtattgtagaaaaaaaaaacacctcagagactgcatgaaatatgtaaaccatatatcaagttatttgaaaaatagctattttttccaaagcgtgtaaaatattgctttgaaatgtacctgttctcaagatctttttattcagagttttaaccattgtaactttttaaatgtctgtagcactgaagttattttcaggttttgtattttctttcattgtggaatattttaattaatatagcatggcacctcattttcttttgcctgctgttaaagatggaagctgttgtcaaatgacaactttaaaaagggaagtataaataaaaagcctgattattttaggccagtttgccaatcactgtgtaattcctctggtagtattctacctactttaagtctaattttactagatagagtaatggaaaatgaaaatctaaccctttattccgataatctcatgaagcaaacctaactatttaacatcagctggaaagaagggaacatttatattgcccgtctcctgtgtcttcaaaggtgtgagagttgaggaatatgtgttcctacgggaactatgtttgaatatgtgcagttttcaacattttggcaaatgaaagcctgacaagtttttaaaagggcagaagctttattttttgaacagaaaaatctattttttaaattcacatgtttgtatgagtacttctgggaagcaagggatgaactgctaggtattattaagaacgaatgatttttgcatttaagttgtttgaaggcatgtattttgaaaaatatctgttacaaatttataatttcaagacatactaaatcttataatacttttggaatttcattaataaggctaaaatctgaggaatgtaactaattttcagccttaagacacttaagtttggaagtccttgctattcaacagaataacaagaaaccttcagaatgtatcactctcccaaaaagaagatattaataagcccttttcttttattcatggttatagtttttttatagtctcaaaattcctaaagcaatgctgacagccattgaatttgccatattttgtattcagtgctgttaatgtgctgttgcctcaagaaaaagtgctttttctccattgatgaggctagaccctaagaggtaattaagtcaatgtaaatcaaatggaagttttgccatgaactaagcatttattagttccctgattagactggaagaagaaaccgctatttcatgacaagcatggaatattatattttcttcttcataattaatgaataaaattgatatgagcgaatgaatgtagtattttttgaattagtaaacagtacatctgtgacaatcattttaacaagctctacttgtgttctttataaagtgtgattttcagaaagcaaacaaaacacaattaaaaggttgaatctgaggaaaataatgcttgtaccatagaagtatttacaaaattgcatttcattgttatgttttattttctgatacctgatgttcaattatatctgtaggtaatattttatatcatagattaaaatttatagtgaccttaaaaaaagatgtatcatcaggttatttatttgaggtttttcacttttttgatcttggaaattataggtatacatttccctcttactactgctttttgctgtatcccataggttttggtatgttgtgttgccgtttttatctgcttcaataaatttttcaatttcttctgaatttctttgttgaaattgtaaggatcattagaggctactgtgagcaaccataggccagaaattagaaaacctagactatatggatacatatagatacagaaaaattcacattatgaatttgttctcaaataagctttggtaatttgtctctttaaagaactttaagctgccaaattcttgagtatggaattgttcataatagttattatcatttaaatatagaggttctgtaatgatatttcttcttttatcagtccttttttcttagtcttactagtatgtaacaactttactgattttttcaaaggaacttttcactttgtgaatttatttactttcaatttcatttatttctttcattacctgttattttattttttcaaattacgttttatttgtttattttttcattgacttttaaacctacgtatttttctaatacaagaatttcaaataataaattaccctctcaatttaactctacaccacaaatatgaagcttttattatcataattttgttttattttatttttttaattggcacataataattgtgcatatttatgggtacatagtgatgtttcaatactcatagtgtatatatttaattaccctgatgaggtgatggtaattagcatatccatcattgcaaacatttatcatttctttgttttgggaacattcaatatcctttgctaactatttgaagctatatgttattgttaactattgtcataccataatggtatagagcattagaacttattcctcctatctagctttaattttgaatcttttaacaaatctctccctatccctcccttcctcttatactttccagcctctagcatcctctgttttaacttctataagatcaaaatattttagcttccacatatgagtgagaagctgtaatgtttaactttctcttcttggctcatttcactcacataatacactccatttctatgcacgttgcttttatggccgaatagtacttcattgtgtatctattccttttcccctcctgtcccctcccttcccctcctctcccctcccctctccttcctttcccttcttgagatggagtcttgctctggagtgcaatggtgtgatcttggctcactgtaacctctgcctctcggattcaagtgatcttccacctcagcctcccgagtagctggggacgtgccaccatgcccagctaatttttatatttgtagtagagatggggtttcaccatgttggccaggctagtctcgaactcctgacctccagtgatccacccatcttggccttccaaagtgctgggattgcaggcgtgagccaccgtgcccggcctatataccacattttctttaaccatcatctgttgctggacccttaggttgattccatatcttgcctattgtgaatagtgctgcaataaacatctaggtgcagatgtttatttaatacactgttttccttatttcatattttttctaaattatcttttgatttcttttatgaactatgagttaaatagtgtttcatgttatttacaactatttgggggtttcctaggaatctcttatgtcatcaatttcaaattaaattttattgtgatcagagaatatattctataaaatctaaagcttaaattcatttaaacttactttttgattcagcatttggcctatgttggtggtgctttcaatacacaagaaaacaatgtatattcagcatttgaaatgtagtttttataaatgtcaataagatcaaggtgatttataatgaagttgaaatgttctatagccatacgaatggtttgtcttactgttcaatcagtgatgaacagagggatgttaaaatctttaattattattgtcatttatccatttctcccttcaattctgctttttccttcatgaattatgaggctttgttattaagttggtgtccctttcataattatgaaatgggggcatttcataattatggacatctatgtcatattaggacaataatgtaataaccaattcatcagaggacaataatataagcaatattattgtcctctgatgaattggttatttcataattatgaaatgcccccattttctcttataatgcaccctcttttccagtctacattgcattttgctaatatagccacacaagcttcctaatgcttgctgtgtatatggtttatcttttcttgtaggtttacttttcatctatctgtgtctttatgtttaatatatgcttctggtagacaacattagttgggtctcattcttttgtctaatatgacagtctctaccttgtaattgaataatttagttcataaatatgttaaatgaaatgtgttgccacttttaaaaactgtacaatctcttgtttctcttctcgtatttttgtttaattgtattttaagtattcattttaaattgcatagatgagttagttgcaacgcttttttgtattgagttatttgtattacaataatcatcaatttatacttaactaatctaaattttacttagaggtaatttttgacaacttcatatataatgtaaaaaactgatgacatctgttctatttttacattctctccagtgattgatagtgttgcctactttgtcaaatcaaaacaaggcaacattttcctaaaaagtgatctgtgctccacctatcctattcatatgcacagaagactttcagggcagaaaactattctgcatgatactacactggtatatgaatttgcctaaactcatagaatgtatgacagcaagcgtggaccctaatataactatggaccttggtgataaggatgtgccagtgcaggttcatcagcggtaagtaatgtgccactccagaggagaatgacagcaaggggtcaggctgtgcctgtgtggacacaatgatgtatgagaaatctttgtatctttctttcaattttgctgtgaacttacaactgccctaaaaataaagtctattaaaaaaacccaaaacaacaacaacaaaaactgatgatggtaacatttcctttactccccctctgtcttttgtgattttttttagtataagtttttctatccacatcataaagcccacaataaaatgatatctttttaaatttaaatagtcagtttcccttcaacaaaatcgacagattaaaaaaaagtatttcctgttactcatatacttaccatttctatgcttttcatttcctctaatctggagtttagattcgatgttatttcccttcaggccagaaaacttctgctagcatgttttgtagtacagatttgctggtgacaaattggcccatttaatttttccgaaaatgtcttaattttaccttcaactttgaaagatactttaataatatatagaaacgaacctgatgctctgtcatctccaaatactttagtagactgattctcaaccagggggagttttgccctccaggaaacatctgataatatctcaagatatttttagttgttagcctgggcaaaggtgtgaggaggatgctactgtcatttagttattaaaggcaaaccaagtcgctaaacatcctgcaattcacaggaaatgcccccaacaaagaattatgtggcccaaatgtcagaagcgatagtgccaaagttgaaaaaccttgctttcatatatattttctacaaacacaattgtgtctatatatgtatatacatatatataattctatatgttacaaatctattacagtaatatatgtgcccccccaaatgcaatacacgcacagtacaacgaacaaaaccagaaaattaatattaatatattgctacatctaattatcaagtccgcattaaaatttcaccaatagtcagccgggcacggtggctcacgcctgtaatcccagcactttgggaggccgaggcggatgggtcacgaggtcaggcgatcaagaccatcctggctaacagggtgaaaccccgtctctactaaaaatacaaaaaaaaaaaggaaaaaattagccgggtgtggtggtgggtgcctgtagtcccagctactcgggaggctgaggcaggagaatggcgtgaacctaggaggcgaggcttgcagtgagcccagactgcgccactgcactccaggctgggcgacagaccgagaccccgtctcaaaaaaaaaaaaaaatttttcaccaatagtcccaataatgtttcatagcaaaaggatcaagttcagaatcatgcattgcctttcattgtcatgtctttttaatgtccttgtatcaagaatagatctttagacctaacttaaccaagatttctggcccatattttcttctttttttcctttgctttgcttctccttccttttctcctttcctttctccttcgctttccccttcctttttctcttccctctccccttcccttccccctccccttccttctccttttctctttcccttactttttccttttcccttccttcttttttgaatggctccctttaggttttctgaggtttccttgtgactagagtcaggcaatgcattttggcaagaatatcacagaattgatgctgcgtttttttcattgcatcctatcaggtggtacatgattccagtttgtctcactactgacaatgtttattttgacaggttgataatggtggtatatagtaggcttctatcttgttattctctatttctagattctgttactttattttatgttgtttttcctaaagggtaataggaattctctctgtttctttgtttttgtttatttccctatttttattccttactatacttttagtacatagtacctagtgcaaaatactaatatatgttgaacaccaacagttgttgaacaaatgtctgaaactgactctgtcctgctaccacaaaaacatatatatatatatttttttcctatagggataccatcaactctacatagttgtctaagccaagacctcctgctaggactgattaaagcccgtgcatcctcattatccagagcctgtgttgctcctctagagctatagccaggctaaccattccttctggttaatatctgaaaggaagaatcatgcagcaagaagagaactgtgagggaataaaaatggcacaaacccagcctggatttctctctccccttttaatgatgaatgaatgaaaaaaattcatcattagctgtagttagtttctattacataaaaaggaagctgatgaaacatataactgagttatatacccacatccaattggttctgtttctctggagaactctattaaagaagttattgagtattgtttacatgtacactgacaaatatgtctaaaggttatgtctgaacacctataaatttatatcaatgattctatatagttcattcttattacacttgattctaattcttatgaagttgatgtttggtagaatgaatgataaaaggagattctgtcccctattgaagtgtttgtgtagttacacgccagagttttggagattgaggaaaaggttgagcttaaataattttatgggcaaactcaatgcttgaatgtaagatagtactttgaaagatttggaggatttcataatgacttttacttttgctaattattgatacagtcacttgtaaataagtttacttaggtaagctcaaggaaatcatgctttttctcaggcttattttaaatctgaatatttttactgtctttgcttttacaagaaaatattcatcattgtattttttgtcttaattttcaaagtcaaatgttaattgtttttgtgggattactttggcaaatatgggagatccccaaacaaattttaaaaagttttttcggccgggcgctgtggctcacgcctgcaatcccagcactttgggaggctgaggcgggcggatcacgaggtcaggaggtcaagaccatcctggctaacacagtgaaaccacgtctctactaaaaatacaaaaaaattagccggacgtggtggcgggcgcctgtagtcccagctactctggaggctgaggcaggagaacggcgtgaacccgggaggcagagcttgcagtgagctgagatcgtgccactgcactccagcctgggcgacagagcgagattctgtctcaaaaaaaaaaaaaaaaaaaaaaaagttgtttctgttctcctttgttttctactttctcttaaatagaaatatatttcttgtacaaataaatgccatgaattaaaaaaataataaattatgattttccttcgtgaggatcagttctcctagacattggtttagctaatgccagctatttggtataaaaatctgtatcagtggagaggtaaaaaagagctaaaggaagcataagaaagacaaccgcatctttaggaagttcctctttttcttttcttttttttttttttttttgagacggagtcttgctttgttccccattgttccccaggctggagtgcagcggcgcgatttctgctcagtgcaaactccgcctcccgggttcacgccattctcctgcctcagcctcccgtgcagctgggactacaagtgcccgctgcggcgcccagctaattttttgtatctttagtagagacggggtttcactgtgttaaccaggatggtctcgatctcctgacctcgtgatccacccgcctcggcctcccaaagtgctgggattacaggcgtgagccacagcacccggccaagaaggttctcttaaaaggaatcacttcttgttttcttacaagttataacctcactaccctagagtcacattttttaataacttatgaattttctgaaacttcaaataccctatggccccatggtaaaacatcagatgacatttgcctctcatttaaaccatttttcttttcctctttcttctttatttttcttatactctctcctcatttctttttctctcttcctatttctctttttctctctgcttcttcctacctcccctcgtgactttgtctcctcatcccatcaccgtgctacttagatgccacatcaatttgactagcctcaaatttacaatgaatactttttaaattcatgcttctgaaacttttaaaggatgaagaggtataaatgtctcacataataatttgtttgatggctgaaatgaatggcatttctcaaaaaggccaagggactgaatacagaaatttaaacaataactttccgttagtgatacggtttggatgttttgtcccctccaaatctcatgttgaaatgcgacctccagtgttggaggtgggcctagtaataggtgtttgtttcccaagggtggatccccatgaatggttttgtgctgtcctcctggtaatgagtgagttcttgctctatgaattcacgagagatcttgttgtttaaaagagcctggcatctcccttgctccctctctccccatgtaatatgccagctccccctttgccttaagccatgattgtcagcttcccgggcctcagcagaagctgagcagatactggtggcctgtttgtacagcctgcagaccatcagccaaatactcctcttttctttataaattacccagtctcaggtattcctttatagcattgagatggactaacatagtcagttttgacaacatgaacctttcatattaaaatttaatttctaaattcactcatttactgtgattggtttatagcttttctgtaataatgaatcttacgtgtgactttcaatgtgctttaaaacttgattcactttttagctctatttttggaaactaccagcttccactgttgaggcaaaagtgtcatcattgaggctctcctgctgaggtagctgttgtctgatttcccttcagttctactgctgtcccagtggaaaaagggaatcttcaccacttacatgacatgtttgcctgaactctaatcttccacacttgctgtagaaaagagtaaagtggcagttcagggcagtttaccaatttagaaatggtgtccgctcagtattttcctctgtgtcacttactaaaacatataaaagaaaccatggacattaaaagaaagagagaggtttaatgtgatattttaattctaacaaggatttatgggcacatgaatgctcaaaatcacatacccccttagtgtttttcatctcacacatatcacatcagatacatatcacacatttcaggcacatatcacacagaacttaccgtaattaaattatcagtttttgaaaaatattatcatttgctctctttttttctatataaataaatttttttaaaatatgattttcagttctgggatacatgcacggaacatgcaggtttgttatataggtatacatgtgccatataggtggtttcttatttgtgttttcatcttatggctttggctagaactagataataaaagtatgcatcaatttaagagttatttttaatcatggtaaggacatatctataactactttgttaaatttcatcagtcatgcatgttaaatatcattaaataaatatcaaaaatgggctgctgtaccagaataccatagacttggtggcttataaacaacagaaaggaatttctcacagttctggggtctgggaaatctaagaccaaggtactagccaatctggtgtctgggaaaaacttttgttctagttcaaagaaggctgccctttctctataacctcagttggggaaggagcaagggagttcagggggctgctttagaagggtgctaaacccattaatgagggctgctctctcatgacttaattagttcccaaaagccccaccttcaaaaaccctcacattggcggttagcatttcaacatatgaatttgagagggatgtaaacatttagtctgtagcagtaaatgtacaatataaagtaaatagctttattgttgtgttgcattatattaatatatattttctagtattaaatctttgtatgccaaatcactggggtgggtgatttcttagtaagtgtagaattcagttcctttttctttcagttaagaatattttaactatgtttataagggatactgtttagtaattttattctttttgtattcacttcatcaagagttagtaatagttatatttgctttgtaaaatgaactgaaaggaagccactttttataactttatccatatttcctagtttggggtccattttacaagatgttttaaacagatgcttattaaaaacactggttatagggactttaataaaaatttttaaaataatgttttacatttcttgcaaaaattgatgcctgcaacctatttactgtttttaaaattaaattaagattcatttaagcagtacatgtttattttagtgaaacacgtatttaattttctaagatagtattttttgtctttaaaacaatttctgcatgttttgtttttttttcactttaaattttatgttttctcagtttttgttttatcacatttgctatatttttctgtatcatgggttatttgttaaagaatgaacttgtgtatgtttataaattgttactgtttttgtttataatttattgccttctaacttaatatgtaattagcattccttttaattttgcttgtatgctttgctgtaccattttgaaattcttgagttaaatgcttaactagtttttatcaagtttaaatattaaattaaatatgtcccatcagtttagtcattttaatattctcactcatcagacattttttgggaacaccatatgccttttcatgcagtcagtttcaagaaaatgaaaattactttttatatgtttatactcaaagcttggctagagataagtctccccttccttaagttggggagaaagtgatttcttccaggctatagtcaaaagagatacaattatagtaactttttgtgtttgtttgggttgtttctgtttgtttgtttgtttgtttgtttgagacggaggttggatcttgttgcccaggctggagtgtagtggcataatctcagctcactgcaacctccgcctcctgggttcaagcaattctaaacatattttagcacaaaactgtttaagatttcaatttatatctttttattatgttccatatactcttttgatacattacccattatgttgattattaacgtacactcaagtcaagatcttttattatgtgaggtcatcagtcaatgataacagatattgatgaattagtctcctcatcagaaattgagcaacattttcattcaagacgacacatgggcctttaaagcatattcaataatactgagtctcagtcttctcctgctattttctgaatgtgcatttagacctttatacatctatctatctactgacccatttattaaattttcagcatttactttgtactccaaggaccagaaccatgtttgtcttgttcactgctgtactcctattgcaaggacctagaacatagtaggagctcattaaaccctgaggattcaaaataagtgaatagaggttgtagcaggaagaagtctaagatagcccctatgaccttcattacctcatgttaccctgttgatacctcacacggcaaaggagtcttgcacatgtcactaaggctaataatccgtcagtcttaagacggggggagtatctgggtaaacctaacctaatcacaccaaaacttcacaatcagggagttttctacaactgagagtagaatgggaagtcagagagtttcagagtccaagaagcatttatagcacccttattgactttgaagatgctttgcttcttcttttgagttcagtttgagattatctttctaataattgattagattttattcttgtaaaaaaagagataatttaaaggaatctatttttaaatactctgaggagggtgatactaggggtgctggttgtcctgttttaactttgtcttaatttctaatgtaattaaattttgagtaggtaatgtgacctgtgtggtttttattttaaaaaatatattgaggttttatataatctatttttaaaattttcaatggaaacttgaaaaaatactgtttcacatattctcgtatatatatattaaaaatctttttttatttattttttatttttatttttttttgagacggagtctcgctctgtcgcccaggctggagtgcagtggcgccatctgggctcactgcaagctccgcctcctgggttcacgccattctcctgcctcagcctcccgagtagctgggactgcaggcacccaccaccacgcccagctacttttttgtatttttagtggagacagagtttcaccgtgttagccaggatggtctcgatttcctgacctcgtgatccgcccgcctcagcctcccaaagtgctgggattacaggcgtgagccacttagcccggcctaattatttgttttttaaaagacggtacataggaagaagtaaatcaggaaaagtggatagtgattggtggcagtagaagtgagtcagtgttacagttactattgctgcttaagaaacttccccaaatggcctgggcgccgtggctcacgcctgtaatcccagcagtttgggaggctgagacgggcggatcatgagttcaggagatcgagaccatcctgcctaatacggtgaaactctgtctctactaaaaatacaaaagttagcctggcctggtggtggtgggcgccttaagtcccagctactcgggaggctgaggcaggagaatggcgtgaacccgggaggcggagcttgctgtgagccgagatcgcgccactgcagtccagcctgggcgacagagggagactccgtctcaaaaaaaaaaaaatttaaaaaaagaaaaagaaaaaagaaactaccctaaatttaataaggtaaaacaacgaccacttcattatatctcatggatcctataggtgagaaattccagcaggattcatctgagtgattcttcctctctcacatcattaactagggtgactcagtgctagtcggctggcaaacaagtcagtctggaaggtgcaaggtgctttttttctgtcttataaattgatggagttgtctggaaggcaaggctcagatgggaaggactcttagttatagtgcctgcacagggtaaacttttttttttttcttttttttttgagacggagtctcactgtcccccaggctggagtggtgtgacccgatctcggctaactgcaaactccgcctcccgggttcacgccattctcctgcctcagcctcccgagtagctgggactacaggcgcccaccaccaggcccggctaattttttgtatttttagtagagacggggtttcaccgtgttagccaggatggtctcgatctcctgacctcgtgatccacccgccttggcctcccaaagtgctgggattacaggcctgagccaccgcgcccggcctgcacagggtaaacttcttatatggctgctggctttccgcagatcaaacactccaagggaaccaggtggaaaatgcctggtctctttttatctcactttaaaggtcaggtagaattatttgtcatactctattgattgtagcagtcacaagcacgtccagatttagggaagggagacatagacctattttttgatgagaagaatatcaacctgtttttggactatgtttaaaactgccacacatgacaattacacaccaggtagaaggcatttggggacagacttgaaggaaatgaggaggaatcgtgctctgctgaaacaagagcattccaaagagagaccacagcttgggcaaaagccctgagtcggaatcatgtggacttattcttagaacagcatcgaggaagccattatagctggagtagaatgagaagggggaagagtattagtagatggtggcagagaaataaacatgagaagacggatgatggaacgagcaccttgtacgtcattttaaggactttggctgttcctcaaactgacatgggaccattgaaagatttttttattttttattttttaaatttaacttttaagttcagtggtacacgtgcaggtttgttatgtaggtaaacttgtgtcatgggggtttgttgtacggattattctgttacccacatggtaaacctgctacccactagttgtttttcctgatcctctccctcctcccagctttcaccctccttttcaaaataagacatacgtgcagccaacaaacgtagaaaaaaagctcagcatcactgatcattaaagaaatgcacatcagaagtacaatgagatactatctcacaccattcagaatggttattattaaaaagctaaaaaataacatgctggcaatattgtggagaaaaggcaacatttctacactgttggtgggagtgtaaattagttcagccattgtggaagacagtgtggtgattcctcaaacacctaaaagaactaccattcgacccggcaatcctattactgggtatacacccaaaggaatataaattgttctgtcataaagacacatgcatgcatatgtttattgcagcgctattcacagtagcaaaggcatggaatcaacataaatgcccatcaatggtagactggataaagaaaatgtggtatatatacaccatggcatattatgccaccataaaagatgagatcacaccctttgtaggaacatggatggagctggaagccattatccttagccaactaatgcaggaacagaaaaccaaatgttcccacttagaagcgagagtcaaaggggagaatacatgaacacgtagaggggaacaacattgaaagatataagcaaagaagtgatatcatctgaattgcatttctgagatttctctggcacttgtgtaaaaaatagctgaaaggaatcaacggcagaagctgggagaccagttagggagcttttgcaataaccataagaggaaatatgtgtggcttagactaggaatcgtcaggttgggagtgctcatattcaaatgtggtcagaatccggacattttgagtgagcctacagaaagctttaatactgtctcaaactaaaggatatagaaggttttccctttctcttgccctgaaaccttctgtatcctttattttgagatagtattagaattcttactatcttactgacaattctcactatcttgttttataacttggaacatgattataattatagtattgttaaatattttatttttattttataattatactttaaaaatattattttggtaaataatcataaaatatgaaaaataaatctttccattaactgaatcaattgtccccttgcaggattttggcttcacaacttcctaatccttgaaatattaattttgattatttttctaatatgtacccatatgtctttgagtaaatttttattggaaggacaaatcagtgctggatatacagatgccattgcttcgtactcaggtaaagacaacctgatatttatgatcctcttgatcatatttttattctcttaaaatctttatgtcttctaataatgttaacagagaagaaaaaaagtcttatctaagcctgactttttatttttaaggaagtttttttctttatttgtaaaattcaggagtttggctagttgttatttaaatatggagaactcttccttgtttcttccccctccctgcctagaaactggttggtgcttttattattcgtacttcagtgatagctttgattattgtttcagatctccttgcccttgtgtctttccccagtacacaaactattctcgaggtggaacctgtggtctctggcatacccatccgccttcttctctgtcattagttcatctcttcctttgccctccagagctctgattcaattgctgcttgaacttttcagtgtgtcagtttctttctccacggatttccctgtggatggaaaatctgcccttgcactttagttttcatagaagcctcatctcagctatctcccattttgtgatatgagcctcttttgttattgtagccttcatctcctatttcctaaattccatgtgtttctacatactgttcatagacaaatagtttaaagcaatgttctatagtttcttgtggtttgaaagtcatatatttttaaatacgttttctccccctgagaattcagcatacagtttcatttttcttgtacgcaggatgatttttaggattttttttctgttatattttttccattctggttacctagaaggtagtgattattaccccaaaccagggtttgatactgtgttagtccactttcatactgctatgaagaaatacctgagactgggtaatttataaagaaaaaaaggtttaatggactcagttccacgtggctggggaagcctcacaatcatggcagaaggcaaaggaggagcaaagacatgtcttacatggtggcaggcaagagagagagcatgtgcaggggaactcccctttataaaaccatcagatcttgtgagacttattcggtttcacaagaacaacacagggagaaacccatccccatgattcaattacctcccactgggtccctttcatgacatatggggattatgggagctataattcaagatgagatttgggtagggacatagccaaaccatatcattcttcccctggcgcctcctgaatctcatgttctcacatttcaaaatcaatcatgccttcccaacagtcccccaaagttttaactcgtttcaacattaactgaaaagtccacagtccaaggtctcatctgagacaagtcccttccacctatgagcctgtaaaactaaaagcaagttagttacttcctacatacaatgggggtacaggcattgggtaccccccaatgtatttacacctgttccaaatgggagacattggtcaaaacaaaggggctacaggctccatgcaagtctgaaatccaatagggcagtcattaaacgttaaagttccaaaatgatctcctttgactccgtgtctcacatgcaggtcacactgacgcaagtggtggtctcccatggccttgggcagctctgcctctgtggctttgcagggtacagcctccctcctggctgctttcactggctggcattgtctgtggcttttccaggtacacagtgtaaactgtttgtggatctaccaattgggggtttggagggcagcggccctcttctcatagctccactaggcattgccccagtagggactctgtatgggagacagagcccacatttcaattctctactaccctggaagaggttcttcatgagcccctgctcctgcccccgcaccccaccagagcaaacttctgcctgaacatccaagtgtttccatacattctctgaaatctaggtggagggtcccaaacctcaattcttgacttctgtgcgcctgcaggctcaacatcttgtggaagctgccaaggcttggggctgcaacctccgaagacgtggcctgagctgtagcctggtgtctcccaccccagccatggctggagtggctggaatgccgggcaccaagtctctaggctgcacacagcagggggacctggacctgctccaggaaatcatttttccatactaggcttttgagcctgtgatggaaagagctgccgtgaaggtgttaaggtctttaatgttctggagacattttccccattgtcttggtgattacatttggctccttgttacttatgcaaatttctgcaggaggctttaatgaaagtcggtttttcttttcttttctttttttttttttttttggattgggagtctcactctcttgcccaggctggagtgcagtgccgcaatctgggctcactgcaagctccgcctcccaggttcacgccattcctcagcctcccaagtagctgggactacaggtgcccgccaccacgcctggctaatttttttgtatttttttagtagagacacggtttcaccgtgttagccaggatggtctggatttgctgacctcgtgatccgcccgcctcagcctctcaacatgctgggactacaggcgtgagcccccgcgcccggccaaaaaatcttatacattataatgctcaaattttatcctttaataagtcataacggagaaacatgctaatgatttcacaattaaatgtgacgttcatttagtgttttgctttgtaatattaaatattttattgttttccatgtgataccttttcctttaaaattctacttaatctacttaaatctacttaaatcgatgatgttataaatagtctttgatttttactttattaatctttgtacattttaatatcgttaaacttacaggaacagtttgtacacttcatggaaatagagtagagtaatagagtttgattatttgttttgttttcagctgagggttttttttttttggtaatttcagtcttagagtctttcttttcagcagttagtggtataattcatatttgtttctcatagctgattttttgttttaacttttgtgaacttgcttatagtttctttacaactattaggctggtgcaaaagttattgaagttttcactaattattattattattattattttgaggcggactctccctctgtcgcccaggctggagtgcagtggcgcgatctcagctcactgcaagctccgcctcccgggttcacgccattttcttgcctcagcctcccgagtagctgggactgcaggccccggtcaccacgcctggctaattttttgtatttttagcggagatggggtttcaccatattagctaggatggtctcgatctcctgacctcgtgatccgcccacctcagcctcccaaagtgctgggattacaggcgtgagccactgcacccggcctaattatttgttttttaaaagatggtacatacgaggaagtaaatcaggaaaggaggatagtgattggtggcagtagaagtgagtcagtgttacagttactattgctgcttaagaaactaccccaaatggcccgggcgccgtggctcacgcctgtaatcccagcagtttgggaggctgagacgggcggatcacgagttcaggagatcgagaccatcctgcctaacacggtgaaaccccgtctccgctaaaaatacaaaagttagcnnggtgtaaataccgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntagatttgcatttctctaatgcaggtctatgagtttcttattcatggtcactaaaagatgtttatcatgaattgaaatctccagataagagtaaagcaatgcctaattcatagttacgcacttatcaatttatttattcatattattcattatcattatgaatattcaacacattaataaaagagtcacatgtgcaatctacttggggtattgggagagtaaagaataacatagtggtgctacaggtaatttaagagatggtttctctctctctctctctctctatgtgtgtgtgtatatatatatatatatatatatatatatatgacacaggtataattattttccttctactatttgttattgatgtatactgccaaatccctaacggatactggaatacttaactctaagctccccccacgcctacaaaagaagtgggtacaaggttagtttttaaatcaaaagatttattaatagtatttttatcatgtccaattgatattatcattatcaaaaagtttaatcacttattattacttgaaggacctcgttaggaaatattcgatccactctccagcgatttgggaggtttaggagacagagtctcattatgtcacctaggctagagtgcagtgagccgagattgcgccactgcattccagcctgggcgacagagccagactccgtctcaaaaaaataaataaataaacataaataaataaataaataaataaataaataaataaatgtcttacttcaatagcttttggagcacaagtggtttaggtaacatggataatttgtatagtggtgaagtctgagattttattgcacctgtcacctgagtagtgtacattgtaccaaacatgtagcttttttattccacacccacctgccaacttcccccttatgaatttccagagcccattatatcactcagtggagagtcttcaacattcagggtggaatcttcagggtgtggccctctatccattgctttccaacgtttgtactctctgctttgtgaatagaggcctgttctccctgtctgccttgttcacgtacctttgccgttttccttgctgggatgacatcctttgccctgaagttctcattaaccataccatagatgtcctcttcttacctcaatacatccaaggctacctcaagttataacttctcctttagtttttccctagtgtctgagttcaaatgggcttctctatatccagaatatctaccacctgtcttatctttcctcacacgtggcacgtgcagttccttccatctactttcataatgttgtattttaacggttcagttgtgtttatattacactcttctgtcaggcaaacaagggtatttatatggctgaaatctacggtattttttaaatgtagtaaaatgtaatgaataagcatacaaatgaatgagttaattaatctgttatattcttggttaagtaatgagcattatgaggacaaaaattgagtcttacaccttcttataatcctaaagacctagtacaggacttggaatatagcattcacttaagacatctttgtgactaatgaatttaaatatttttattaattctaagttgacgtatgattgtaatttggggaaggtagtgaaatttcaaatggctttcaccacctgtgaaatgaccctttttacctaccacatgatttaccagatctttgtttaggtgaacctaggcgaaagcagattgtttcctctacttaggaaatacttcgcacattttcgttgcttataaatttgatgattttaatttgtacagttataatttatgatattgacttgtacagttatatatattttacatataatatatattatatattatatatagttatactatatataattttattttctaaagtaaagaatatcattacacattaacaaaatagatataactgttttctttctactatttgttactggtgtatactgcaaatccctaatggatactgaaattcttatctctaagcccctctatgactatgaaaagaaatgggttcaagtttattttaaaaatcaaagagtgtattaataatattattgttatcatgtccaattgatactatcattattaaaaagtttaatcacttatttcttgaaggacctaattaggaaatatatatgtgtgtgtatatctatattctatctatatatatcctatatctatattccatatatattctgtatctatattctatatctgtattctacatatattctatatatagtctatctatattctatctatatcctatatatagactatctatatcctatatatagtctatatatattctatctatatcctatatatagtctatatatattctatctatatcctatatatagtctatatatattctatcgatatcctgtatatagtctatatattttctatctatatcctatatatagtctatatactctatatatcttatatagtctatatatattctatatatatcctatatagtctatgtatattctatatatatcctatatagtctatgtatattctatatatatcctatatagtctatgtatattctatatatatcctatatagtctatgtatattctatatatatcctatatagtctatgtatattctatatatatcctatatagtctatgtatattctatatatatcctatatagtctatgtatattctatatatatcctatatagtctatgtatattctatatatatcctatatagtctatgtatattctatatatatcctatatagtctatgtatattctatatatatcctatatagtctatgtatattctatatatatcctatatagtctatgtatattctatatatatcctatatagtctatgtatattctatatatatcctatatagtctatgtatattctatatatatcctatatagtctatgtatattctatatatatcctatatagtctatgtatattctatatatatcctatatagtctatgtatattctatatatatcctatatagtctatgtatattctatatatatcctatatagtctatgtatattctatatatatcctatatagtctatattctatatatatcctatatagtctatgtatattctatatatatcctatatagtctatgtatattctatatatatcctatatagtctatgtatattctatatatatcctatatagtctatgtatattctatatatatcctatatagtctatgtatattctatatatatcctatatagtctatatgtatattctatatagtctatatatattctatatgtgtatcctatatatattctctatacatattctatatatatatacacacacacacacacacatatatagtagcctgatatttaaaaaataagattgggactgcgtaaaataagctcacccagacaataggggtacagacatatgtataattcagcaagaactggtaacaaagtgagatatgtcaactctttgtagcatattgttaagtagtattaaaaaacaagtaatttttggttgggtccattgagagaataacattatttttagaatgatctaatggcacaataagcattttagcattttacctgcaaaagcattatagctgtgccagtttctgttccaagaaaaaaatacattggtgtattctctaaaggaggaaattctgacctcaactatgttcagatagctgtggcagataatactctgatcaggtactaagtcatatatctttcacatttccctttgctagttatactcagcatgtggttggaaatggaatcaaagcccagtctggaaatcctgaagtcaaagtcaaaggaactgatcctgtgataaatcagattattgataaactgaagcatgttattcaggtaagtcctgatcctatattttttggtatagccaataataaataataagtggtcactttctgttatacttgataaatttgttaaccctatcaggtaatcctgcctaaaatattgtaacacattatttgtatcaggacttttgggaatatttagtttaatgatttttgtatgcagtcaatatgcagtggtattttaatgttggacaatctgtatatgtgaaaagcaagcctcagcctcagcatttcaataatgagaatctcaggacatgcattgtcttcagtgaataagtttgaacgtgggaatcactgtgaccattaaagaaaacacatagaagaccatagaagatgccagagttttctttcaggtaattctctgaatgttgctatgaaggtttttgcagcatttcaatacaaattaggtcatagatgaataatatgtacttctaatatttatttcctatatcaccttttatatgttatcttataatctacctaatggttgtttatgaaatacttctgttttatcttcaataatatttttcatcaagtgagtgtgtattgctgtttttaatacatgacaaatgaagcatgaacatatttatcaaaataatatttcattgaaatagtctattaattagaaccaaacatgatgttgcatgttgtaaatattactctgcattctgcatctattgatgtttggggaaagaaaggctatttttttttttagttaatagtcattttataaaaatttatatttgaatatactttcatttttcctaagcagaactttgcatggctagttgatgcttatttctagtatcgtgcatcagaaacaatacctaaatagtacagagtttttattgcatacaacatattccagagtcagtagtaggcttctcataattgttctgcaaagacaaagcttaagtttatgcagagccaattcctgggtttccatttttcacgagtccctatctctcaaggagaggatatgtaagaaggacttgggggttggtgtccaataccatagacttctcccttctgtgaggcaacaatgcttattctaccattgatacctatagaaaacagctctcaccctggctggcaaaaccaaaaataaattctactggaaaagtctaagagaaaagtggtatcatgactactgatgagttaaaccttccagcctctgctgagctggtccagttggtacctcacagtatcgtccactgtagtataatatgtacagctagattatttgaaaattcgaccgcataattgataataaaaccaaaagagctttaatattaatgttctctcattgaggagtgagtacaatctcactgtgaggacacagtgaaatcttaggggtttcttaagtggggtaagcattccacagaggatggaggaagaaaaactagaacttaaatatatatttattccatctcattcttttatatttctttggttgtagtaaggtatataaaatatgtaatgtattagtgcaatagcatatacatataatttataaatacataaatatacatattaactggacatttgttcagattgtttttctaagatatatacatgatgaaagcagaacagaaaccctgttacagataataaggatagagctgttccatgagaagtgcagttataagaaaacacattcacagaggaacacatagatacccaagatagaaaggattataaaaacccttaggaggagggctcatatatttattacccattcagcaacccccctccccatttcttgtttcgtaggtttcaaagccttttcaaggtggcagagggaagtcatcctgcctttcttttttagcttctgtgtgaacttgagtcccattctttattctttataggagtgtgcagatctccaattattcatgcttaagtttcattctggggttgcaagagaatatcaaatgcagtgctacctttgaggtctatcattttaagatctgctagatttatatgatagaaatgtagatttttatagaggacagcagaaagtcatatcttgcacaggtgtcactgaaaatttacctttaatatctaagaatatgctctttcatgaactgctctcctggagatgaagagaagtgttttactttgccaattttttttttttttttttttttttttttttttttttttgagacagagtttccctcttgttgcccaggctggagtgcaatggcgcgatctcggctcgctgcaacctccgcctcccggattcaagagattctcctgcctcagcctccagagcagctgggattacaggcacgtgccaccacagcccggctaattttttttgtatttttagtagagacagggtttctccatgttgctcaggctggtctcgaactcccgacctcaggtgatccacctgcctcggcctcccaaagtgccgattacaggcgtgagccacggcgcccggcctactttgccaaacttttgactactgatggtgtacgcgtgccctggcagggatggccattgtgctgtcagtatcaagggatggctaacagcacccaccacaatgtcagctatgaaaggattcagaaaatagccttctgtaagtcagaatttattaattaaggagtagggccatggaagatgtcaacataggaataggtttcagattctaaactgtagatttagatgatcacttcttagtgtttgtataaaatttactttattttttattataacatgaagttcgctttccacctttatactatgaaaaatgccgtgtctcacaatagggacatacctgtgttaaagtatatggaagtaaatcagccacaatagcaaacattgcctgcatggactcacccaaaaatgcctttctcggcctgccattgatctgaacctcatttctaccttgcattgtctgcaattagagtcactaaggaagtagataaagatttttacttggaaaatgtcactttttaatgttttaataattaattcgttcaagatactcaacaaatgctcactgagtttctagtacggtcctggttctgtacaggcactgaggttaaagttgtgaataaagcagacacaaccctgctctcatgggctttccattgtaagaaaaaagtaaataaacaaaccaatgaaaccagtattgtagctgacacatgttatgcacaaaaccaaacaaggtgaggtaaggaaagatatttaagaagagtgtgctggtgaaggccactcaggggcagatgtttgggttgatgctgaataaggagaagaaaggagtcatgggaaaacctgtgagaactgtgtctggggcagaaggcaaagtaggtgtaaaggccctgtggcaggaataagtttattttattcagagaacagaaggccaggtggctaaaacagagtgagttaaagggaggagataaacatacatcatgttttggggagtccagtaggctctggtaaagagtttatattttctcctaaatagactaagaagtcattttaaaactgtaagcagaaactagctgcgcgcagtggctcatgcctgtaatctcagcactttgggaggctgaggtgggtggatcaccttaagtcaggagtttgagaccagcctggccaacatggtgaaaccccatctcttctaaaaatacaaaaattagctgagcacggtggagcgtgcctgtaatgccagctactgaggaggctgaggaaggagaatcgcttgaacccaggagtcggagcctgcagtgagccaagatcgcgccactgcactccagcctggatgacagagcaagactccttctcaaaataaataaataaataaaaatacatcacaaatttaataaataaataaataactgtaagcagaagctgatacaatttaatacatgttttatgaggacttcactatgaaaactggaccctgcgtacaagaatggaaaaaagaaagtaacacagacagaaggccacataattggagctagaataataagagtggataagctgagaagtgcatagatttagacaaatattggaagcggggtttttgggatttgttaatggattggaaatttgggagacggaagaaagatgatagcgaggtttggtgggatgatagtgtcactaagtgagaaaaggaattctgagagaggagcaggcctggcggagggtccctgggattgattagaaatcagtggttttgttaactgtgagatgcttgttagatgcccaagagggatgtgcagaactcagggagaccacacaactggaggtgtatgtttgtaagcatcagcacgtggatagtatttaagccctgagattgtataaggttgtcacctttcctttagagtataaattcacaccaaaactattggtggagatgataggacaagggaatcatacaaaaaaaattgtactgcaaaaagctatgaatgaataaaacattttattaaatgtatttggcaccttgtatatacctagttgatctaggacagagaagatacttagtaacattcattttttcttactgtaagaataatgacccaggaggcggaggctgcagtgagctgagcaggccactgcactctagctctagcagacagagtgagactccgtctcaaaaaaaaaaaaaaaaaaaagaataatgaatgctcatcagagggaattgaattttattattctaggaaatctgatggaaaaagtgaaaaataaatattgataccatttataaaacaatgaaaagacttataagagaagccatctaggcttttctctatacttaattatacatataaatacatcagtactttacttcaaaaaataagatcatagggtacatttgattttatgatctgaactgctcacctgaccacacaaaacaaatactttaccatgacattaaatagtctgctctctggttgttagtgctggcatactattctatcatatggaaaaattacagttttccttcacccagtcaccgaaagtggatatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatttatcaagtataacagaaagtgaccacttattatttattattggctataccaaaaaatataggatcaggacttacctgaataacatgcttcagtttatcaataatctgatttatcacaggatcagttcctttgactttgacttcaggatttccagactgggctttgattccatttccaaccacatgctgagtataactagcaaagggaaatgtgaaagatatatgacttagtacctgatcagagtattatctgccacagctatctgaacatagttgaggtcagaatttcctcctttagagaatacaccaatgtatttttttcttggaacagaaactggcacagctataatgcttttgcaggtaaaatgctaaaatgcttattgtgccattagatcattctaaaaataatgttattctctcaatggacccaaccaaaaattacttgttttttaatactacttaacaatatgctacaaagagttgacatatctcactttgttaccagttcttgctgaattatacatatgtctgtacccctattgtctgggtgagcttattttacgcagtcccaatcttattttttaaatatcaggctactatatatgtgtgtgtgtgtgtgtgtatatatatatagaatatgtatagagaatatatataggatacacatatagaatatatatagactatatagaatatacatatagactatataggatatatatagaatatacatagactatataggatatatatagaatatacatagactatataggatatatatagaatatacatagactatataggatatatatagaatatacatagactatataggatatatatagaatatacatagactatataggatatatatagaatatacatagactatataggatatatatagaatatacatagactatataggatatatatagaatatacatagactatataggatatatatagaatatatatagactatataagatatatagagtatatagactatatataggatatagatagaatatatatagactatatacaggatatcgatagaatatatatagactatatataggatatagatagaatatatatagactatatataggatatagatagactatatataggatatagatagaatatagatagactatatatagaatatatgtagaatatagatatagaatatagatatagaatatatatggaatatagatataggatatatatagatagaatatagatatacacacacatatatatttcctaattaggtccttcaagaaataagtgattaaactttttaataatgatagtatcaattggacatgataacaataatattattaataaactctttgatttttaaaataaacttgaacccatttcttttcatagtcatagaggggcttagagataagaatttcagtatccattagggatttgcagtatacaccagtaacaaatagtagaaagaaaacagttatatctattttgttaatgtgtaatgatattctttactttagaaaataaaattatatatagtataactatatataatatataatatatattatatgtaaaatatatataactgtacaagtcaatatcataaattataactgtacaaattaaaatcatcaaatttataagcaacgaaaatgtgcgaagtatttcctaagtagaggaaacaatctgctttcgcctaggttcacctaaacaaagatctggtaaatcatgtggtaggtaaaaagggtcatttcacaggtggtgaaagccatttgaaatttcactaccttccccaaattacaatcatacgtcaacttagaattaataaaaatatttaaattcattagtcacaaagatgtcttaagtgaatgctatattccaagtcctgtactaggtctttaggattataagaaggtgtaagactcaatttttgtcctcataatgctcattacttaaccaagaatataacagattaattaactcattcatttgtatgcttattcattacattttactacatttaaaaaataccgtagatttcagccatataaatacccttgtttgcctgacagaagagtgtaatataaacacaactgaaccgttaaaatacaacattatgaaagtagatggaaggaactgcacgtgccacgtgtgaggaaagataagacaggtggtagatattctggatatagagaagcccatttgaactcagacactagggaaaaactaaaggagaagttataacttgaggtagccttggatgtattgaggtaagaagaggacatctatggtatggttaatgagaacttcagggcaaaggatgtcatcccagcaaggaaaacggcaaaggtacgtgaacaaggcagacagggagaacaggcctctattcacaaagcagagagtacaaacgttggaaagcaatggatagagggccacaccctgaagattccaccctgaatgttgaagactctccactgagtgatataatgggctctggagattcataagggggaagttggcaggtgggtgtggaataaaaaagctacatgtttggtacaatgtacactactcaggtgacaggtgcaataaaatctcagacttcaccactatacaaattatccatgttacctaaaccacttgtgctccaaaagctattgaagtaagacatttatttatttatttatttatttatgtttatttatttatttttttgagacggagtctggctctgtcgcccaggctggagtgcagtggcgcaatctcggctcactgcaagctccgcctcccgggttcacgccattctcctgccttagcctcccgagtagctgggactacaggctcccgccagtacgcccggctaatttttgtatttttagtagagacggggtttcactgtgttagccaggatggtctcgatctcctgacctcatgatccgcccgccttggcctcccaaagtgctgggattacacgcttgagccaccgcgcccggccaaggcatttaaaaaatgaaaacaaaacactatcacctgagtcatttgtttgcttacattaaatatcataatacttttcagcaaaaaatattatcattttaatgtaactttcgttccctgtatttgagcggagtactgcactatccataaacaccctctgaattttctacagtaatggaaaaaaatctttgaaaaaaataaaagaaggttctatgtttgagaatatggctatatgaaaggggtttcaagaaatatccagttcttcccaagacgatgtacttccagtgaccagttttaagaagtggaacaggccaggcgcggtggctcacgcccgtaatcccagcactttgggagtccgaggcgggcagatcacgaggtcaggagatcgagaccatcctggctaacacggtgaaaccccgtctctactaaaaatacaaaaaattagccgggcgtggtggcgggcgcctgtagtcccagctactcgggaggctgaggcaggagaatggcgtgaacctgggaggcagagcttgcagtgagccgagatcacctcactgcactccagcctaggtgacagaatgagactctgtctcaaaaaaaaaaaaaaacaaaaaaagtggatcgaatatttcctaacgaggtccttcaagtaataataagtgattaaactttttgataatgataatatcaattggacatgataaaaatactattaataaatcttttgatttaaaaactaaccttgtacccacttcttttgtaggcgtggggggagcttagagttaagtattccagtatccgttagggatttggcagtatacatcaacaacaaatagtagaaggaaaataattatacctttgtctcatatatatatatatatatatatatatatatatatatatatacacacacacacacatagagagagagagagagagagagaaaccatctcttaaattacctgtagcaccactatgttattctttactctcccaataccccaagtagattgcacatgtgactcttttattaatgtgttgaatattcataatgataatgaataatatgaataaataaattgataagtgcgtaactatgaattaggcattgctttactcttatctggagatttcaattcatgataaacatcttttagtgaccatgaataagaaactcatagacctgcattagagaaatgcaaatctaaaccacaatgagataccatctcactccagttagaatggcagtccttaaaaagtcaggaaacaacagatgctggagaggttgtggaaaaataggaatgcttttacactattggtgggagtgtaatttacttcaaccattgtggaagacagtgtgtgaattcctcaaggatctagaactagaaataccatttgacccagcaatcccattactgggcatatactcaaaagattataaatcattctacgataaagacacatgcacacgtatgtttattgtggcactattcacaatagcaaagacttggaaccaacccaaatgtccatcagtgatagactggattatgaaaatgtggcacatatacaccatggaatactatgcagccataaaaaaggacatgagttcatgtcctttgcagggacatgcatgaagctggaagccatcattctcagcaaactatcacaagatcagagaaccaaacgccgcatgttctcactcataagcaggagttgaacaatgagaacacatggacacagggaggggatcatcacacactggggcctgtggggtgtgggggtgtaggggagggataacattaggagaaatacctaatgtaggtgacgggttgatgggtgcagcaaaccaccatggcatgtgtatacctatgaaacaaaactgcaagttccgcacatgtaacccagagcttaaagtataatttaaataaataaataataaataaataaataaactcatagacctcaaagtatgggaagcctaactgcctacggccacttgctgcttcactctaaaatctgtttctgcatctgcccctcagtcaatgactgaggcccacagggtggctaatgcagatccctctttaggagacacagggcttctctgaggaccagtcttggctcaggattccctgaagccttttctcacccttccttagactgtacattacgctccaatgcttccactcaaccttcctttcctctttccttcattctaggtcagacttgcctcatagctgagacctcttccaggcttactcagcttcctctccattttctctcacagggatttcccttaataaaatcctcttgtgtttaactcgttttcaacatctacctcttggaggacctggactaacccaccacataatgtttgtattataattacttccattctacaggttgagaatctgggatctggagaagttaagcaacttaagttactcaagtaaggccacacaacgtatataaagtgtgctgcaaggagttaaacccagggaacgcacactccaaaacagaaccatcaacaagtaccaatcctgaaaccaactaataaaaggtaaagatacaattagcttggtgcaaaatgttatttttctctctaattacattttctaaggtttcactgtttgtgattaagaagggatgaatgattttcatcaaaactctgctcaacaagccgggtgtcgtggcatgcacctgtagtcccagctactgaggaagcagaggcagggggatcacgtgagcccaggaggttaaggctgcagtgagctgtgattacatctcgttgaccatgtgaccctgagtgtaactcatagacctcaagcctgggcaacagagcaagactctgccttaaaaagtaaaactaagcaaaacaaaacaatcctgaacaaatggttgcacataaccagctaaacagtaatataacagttgttggcagggtgagaagaaactagcagactgtaggtttgtcatactgtttttttgtttctccagaaacacagatataatataggcaatgaaagctgagactcatctcttaatttcagttaagctattaattgatttacatcatttacttacaggtcagaaaagtttctttcaaaaggcaggaatgttgtttcatgttaatctaaggacttgcttaccttttgtttctgttcttaatgatcacagttactaatacagttaaataatatttagataaaatacattacaattatagctgatcaaaaatctcattccaagctgttatattgttgactatctcatgatcactcttcttatgaatcatgtaaatagggaaaaatactgcaaagtagacccacgttacttcaaatgaaatatgatttaataaaatcagttattctttgccaattttgtaatgttcaaaataaccacaattgaaatagtgatacatacacatcagaacagttcaaatgaaagagagaaatgataccaagtgttggcaaagatgcggagcaactagaactctctcccattgtggatggaaatgtaaactgatggacaccaccattttccatgtatgctaaatctgaccatattctatgaccctgagcatatacccagcaatatttaccaaaagacaaatacatgaatgctcagagaggcaccattcaaaataaccacaaattgaacttatatttgtataatgatatagtatatagcaatgagaacctaacaaattacaactatatgcaaaaagattaacaaatcttataaactaaatattgaatgaaagaagcaagatacagaacatattctacgatctaattcactaaaaattgtaaaactcatcagttatgttccaaatcaccataagagctatcctatgaaatagtgtctagaagaagtaataatataaaatttcctgatttgagtactggatacacagaagggctaagtttgtttaaaaacaaaagaagtattgagctgtacagttaagatttgggtattttactgtttgtatgtattttcagcgttagaaaattatgttaaaaagtctttatgctctttttcttaatatatttacaatagacaaattttcattaagccacagtataaataaaaaagacccacacaggtatttttaacatggatgaagtggttctgccatcattaaatgagtactttaggatgcaagtctgatataaaaacttacttccctgaagactttaattttgcatgcaaaatacacggtttctaaattaaatttttttgtaacaaagcgtttttgagttcccctcatgaaattttaataaatcattaatttcttctttttctctttcatgcacaagcagtggataaacatttcaaagatccctacagaagtttcttcccttgaaatactgttcacatgacaatgagaaggatggaataaaacacaaaaaaggtaagcaatttttttttttttttgaggcggagtcttgctctgtcgcccaggctggagtgcagtggcgcgatctctgctcactgcaagctccgcctcccgggttcccgtcattctcctgcctcagccttcgaagtagctgggactacaggcgtccgccaccgtgcccagctaattttttgtatttttagtggagacggggtttcaccgtgttagccaggatggtctccatctcctgaccttgtgatctgcccgcctccgtctcccaaagtgctgggattacaggcttgagccactgcgcccggccaacaggcaaatttttcgttggggaagtagtagaccaaccatctgtgcttatttcttctaaacagagctgggaatgagtgacagcagttgaacaggaacacttgctccccaagcactacttgtttttcatgaagaaggaaaaaaggcaaaagccctgctacatttacattcgcaaaattgttttcaaatgaggattaacaagatgttagttccctctctgttgaacacataaaatattaaaaggcagtgctaatacatctatatacagcacatcaggaggaaggaggaagtcatttctcctgactttaccaacttgtcttatttgaaactgataccgtgccctattggctgataggagtttcactttatttagaatacaatagaatttggctcagattcacaccaaaagtatagtattttgatgtgcacttacacgatttcaggggaaaacaatatctggaatgtgaccctggaattcattacaagtcagctaaagggatctctcttagaattttttcataattggactgggacaggatgtaagaataaatcattaacagtagatgaggaaaacacttgacgagagctttctcgtcttaccattactgctctttctatcagaggttaaagacagaatggggaccatgttgtggttgttattcttgttgtttgattggtttgtttattatgttcttgcaggacttggttatgtggctggatatgaaaattctttccatttccagagtcatacatctcctaatttctaggagattaaatactggttttatctttggctccagtaaaaatgttgctatcttggattaaaagaaggttgggaaatacgttgtgtctattcaccagtgaatgggaaccccttctacaacaacaaattttccattcaaaccatttctaggcctcccttcctggttctgatagcaaatgtgaaagcaagtactagagatttgggttttgtaagtttcctcaaatacttgggaaatactggattccgttgccaagtgttgccttttgtacattcagcttctacacagcacgttttctctatgttgaaagtcctaatccttgaaatctcagaatggaaaagagttatatgactaattttatgtgccaggattatgggaataaactttcatggaagataggaagcttacagggcatctagagaaaggagacatctgtagaatcaattcagaatgattaagccccttgtgatctcactatctcacttcaattgttaagccacaaaactctttttaagttaatctctaacatttatttggctttataattacatataaataatgtctaaatttgacacctatgtttccaaacttaataatgaagtcaaaataaacagaattaaggagagcttattacgatctttattgttatttatatataacaaatttcctattaagaatataatattttatgatatcttatggatgtcattaacattgctttaataaaggtattatcatgctttgtacagcaaccaacacgaaaatgttactataccactgcaataaatagaataaaaacatgttcagaaagacttagaaactcattaaagaatggatgttaatcacttttcaccctaactcctcatttggcaaggcatgaatctatgcattccagtttagacaggtggcaagtaagtagtcccattgcatttcataaaataagcagctgcgtgaatttgaaagatactatttccacatgaaaagctaatgactgcacatgtaaaatcagtagtgtttaggaagctgtcatttaaaaaacaacaaactacctaattaaaaagtagcacaaataaacttttccctatgtaaaaaatagaacattgcttagccttttcttaaacccctccccaattcttaccaagaaaggataaatacctttattatagtcaaagctctgtttttatggtttttgaattttttaatctaaaattcaaagcaaataatcaatctttaatttatatttatcccaatttgattcaaagtgacggtccaaaagtaaaatgatcaattataactataatcaatcacaaataatgctatgtgagtttgaaatgttaatctaagttgccttttccaggtatgcattttaaaattaaactcttctcagtaagatcaaggctatccttcatggatttatgatgtttgataatcaccacgttgtactgatttgctgtctcacttcactgtttgatatcaacatatgaaagtaaaaatgctatttaggggataactattatctgagcactaataaattaaacgctattttaagccaacaacaaaattgtttagggtacaatttttatttaaccaactgtccattataaacattataaaattctgaaagatcctagaatcttatatagcttttttgtattttttcaaatgtaattgacaccagcatgaattaaatttcatatttaaaaagcttctgactacattacaacatactttaaaattacttgcaagatatgataattctaagattacccacatatcatgcaaatgaaacagccaggtacttcctaccaacacatgatacaataaaatccagaagaacttctgaattagagtgtagtagttgcctagggccatcatacctaattatcacacacttggtgggttaagaggacagaaatatattctctcatagttctgaagcctggacctctgaaatcaagatgttggcggggccacactccccctgaagaccctagggaagaattctccctcgcttcttcctggtttccagtggctcctggcaatccttggctttctttgatttatgactgcataactccaatttctgtctccatcttcacatgaccttgtgtgtgtcttttcctgtatgttataaggacatttacactggatttagggcccaccttcacccaggatgacctcatctcaatcactgggttaattatatctgcaaagaccctacttccaaataaaatcacattctaaagttcctaatggacataaattttggaggtacggtatttaaatcactgcacagaacatgtaaagacaaaaatctggaagctacctgaatgaaaatggatattcccttgaacttcgacaaaatcatattctatttttccatgagaaacattttattaatctaaaacaatattcatatttcacaagtacacctcttaaattatagcttggacttaagaaaaataattagctttggaaattatcagtacatgatatctagtatttcctatatttttaagaacttctacctcctagcaaaaataaacaatgcaatggataatttctgtgttctaaattcacacacacaaacaggaaagggactttaaaaatgatgtgttctcttttaaagcagaagcccaaccacctgctctgaatctaaaagtttcctgaaagcaatgaagggctagtttattatgaaggtgttgatagctgattctgtggagactcacacagaaacaaagaataaattttaatcacacttaatgctaatgtggtagtaaggttgtgacaatattcaaatatgactaatttcattgaattaactacactcgggcttagcttagttgtccaaatttattacaaatagctcaaactaaataattcaactcttctgttttctatttattttttgttgatgcttaagagtaaaaagatatttcaactgaattttttttttttttttagcaatcagttctcttgttttatcaccataagactgtaaacggccgtaacaggtcactgaatctagcactgccttcaacaagaaatgcacctagagcaggaatatagtacttggcactcatctctagacctataacctaacagatttttttttttgtctgtctttggtgaaagtaacgtaaatttagagctggaaaggaccttagaggtcatctagtcccacccaagcatctttgaaaacaaaataaagaagtgtgttggcctgatgcagtggctcacgcctgtaatcccagcactttgggaggccaaggcgggcagatcacaaggtcaggagatcgagaccatcctgcctaacatggtgaaaccccgtctctactaaaaatacaaaaaattagccggacatggtggcaggtgcctgtagtcccagctactcgcgaggctgaggccagagaatggagtgaacccaggaggcagagcttgcagtgagccgagatcgtgccactgcactccagtctgggcaatagagtgagactccgtcttaaaaaaaaaaaaaaaaagaagcatgtttatttcatcattttgtacttatacactgtgtatttccagaaaagcccctgagacagcttagaatgaaaggcacagacactataaaacaagggcaaaatgacagaataatgaagagaaagaggtgacaattacatgggacaacctagggaaggaaacactacccttcagcctaaaatttagtcctaagccccttgttcttaaaggccaaaaggaaaaccagaattcaaataggtattgttagttaataaaatagtatctggatatatcagcaactattttttggtaactctaaactcaagcaaaatatatgtcttcaagcaacagacaatggacaatataataaaaataatcttccatagcaatttccaaacttttaaagatgtaagaacaaatgatcttttcttacaggatgcttagttgaaagctgcccgcatgatggtattttaaactacatgatgttaaattccctgcatgatggtattttattgggacctggttatatgatttggtgaagaatgtaacctttgagaacttagaagagtgaatggttaatatttctctgaatttttttgtttttaattgatattttattttatccctcatagacaatatatgcctgggaaatacactgaagtatagtaaaaaagaatctaagggttaaagtgttgaggtaaatgagaaagcagaggttgtgtctgaagaaccgtgtggtcgcactgcaccacacagcaaacagaaatatgggtgagcacaggccgggcgcggtggctcaggcctgtaatcccagcactttgggaggccgaggagggcggatcacaaggtcaggagatcgagaccatcctggctaacacggtgaaaccccgtctctactaaaaatacaaaaaattagccgggcctggtggtgggcgcctatagtcccagctacttgggaggctgaggcaggagaatggcgtgaacccgggaggcggagcttgcagtgagccgagatcgggccacaccactccagcctgggggacagtgagactccgtctaaaaaaaaaaaaaaaagaagttcaccctatgcaggcactataactacgagtccctcccatctgagccttgccttccagacaaccccaccaatacataagacagaaaaaaagcaccttgcaccttccagactgacttgtttgccagccgcatagcactgagtcaccctagttaatgatatgagagaggaagaatcactcagacgaatcctgctggaatttctcacctataggatccatgagatacaatgaagtggtcgttgttttaccttattaaatttggggtagtttcttttttcttttcttttttcttttttttttttgagacggagtctcgctctgtggcccaagctggagtgcagtggcgcaatctcggctcaccgcaagctccgcctcccgggttcacaccattctcctgcctcagcctcccgagtagctgggactacagtcacccaccaccacgccaggctaacttttgtatttttagtagagacggggtttcaccgtgttaggcaggatggtctcgatctcctgaactcgtgatccgcccgtctcagcctcccaaactgctgggattacaggcgtgagccacggcgcccgggccatttggggtagtttcttaagcagcaatagtaactgtaacactgactcacttctactgccaccaatcactatcctcctttcctgatttacttcctcgtatgtaccatcttttaaaaaacaaataattaggccgggtgcagtggctcacgcctgtaatcccagcactttgggaggctgaggtgggcggatcacgaggtcaggagatcgagaccatcctagctaatatggtgaaaccccgtctcccctaaaaatacacaaaattacccaggcgtggtgaccggggcctgcagtcccagctactcgggaggctgaggcagaaaatggcgtgaacccgggaggcggagctttcattgagctgagattcggccctgcactccagccttggggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncggcggatcttatatcatcgccgctctggtcgaattcgcctcagcctcccgagtagctgggactgcaggcacccaccaccacgcccaggctaattttttgtatttttagtggagacagagtttcaccgtgttagccaggatggtctcgatttcctgacctcgtgatccgcccgcctcagcctcccaaagtgctgggattacaggcgtgagccacttagcccggcctaattatttgttttttaaaagacggtacataggaagaagtaaatcaggaaaagtggatagtgattggtggcagtagaagtgagtcagtgttacagttactattgctgcttaagaaactaacccaaatggcctgggcgccgtggctcacgcctgtaatcccagcagtttgggaggctgagacgggcggatcatgagttcaggagatcgagaccatcctgcctaatacggtgaaactctgtctctactaaaaatacaaaagttagcctggcctggtggtggtgggcgccttaagtcccagctactcgggaggnttgtaaaaggacggccagtagaccggcagatcggatatcatcgccactgtggtggaattcccacaccactccagcctgggggacagggagactccgtctcaaaaaaaaaaaatttaaaaaaagaaaaagaaaaaagaaactaccctaaatttaataaggtaaaacaacgaccacttcattatatctcatggatcctataggtgagaaattccagcaggattcatctgagtgattcttcctctctcacatcattaactagggtgactcagtgctagtcggctggcaaacaagtcagtctggaaggtgcaaggtgctttttttctgtcttataaattggtggagttgtctggaaggcaaggctcagatgggaaggactcttagttatagtgcctgcacagggtaaactttttttttttcttttttttttgagacggagtctcactgtcccccaggctggagtggtgtggcccgatctcggctaactgcaagctccgcctcccgggttcacgccattctcctgcctcagcctcccgagtagctgggactacaggcgcccaccaccaggcccagctatttttttgtatttttagtagagacggggtttcaccgtgttagccaggatggtctcgatctcctgacctcgtgatccacccgcctcggcctcccaaagtgctgggattacaggcgtgagccacagctcccggccaagaaggctctcttaaaaggaatcacttcttgttttcttacaagttataacctcactaccctagagtcacattttttaataacttacgaattttctgaatcttcaaataccctatggccccatggtaaaacatcagatgacatttgcctctcatttaaaccatttttcttttcctctttcttctttatttttcttatactctctcctcatttctttttctctcttcctatttctctttttctctctgcttcttcctacctcccctcgtgactttgtctcctcatcccatcaccgtgctacttagatgccacatcaatttgactagcctcaaatttacaatgaatactttttaaattcatgcttctgaaacttttaaaggatgaagaggtataaatgtctcaaataataatttgcttgatggctgaaatgaatggcatttctcaaaaaggccaagggactgaatacagaaatttaaacaataattttccgttagtgatacggtttggatgttttgtcccctccaaatctcatgttgaaatgcgacctccagtgttggaggtgggcctagtaataggtgtttgtttcccaagggtggatccccatgaatggttttgtgctgtcctcctggtaatgagtgagttcttgctctatgaattcacgagagatcttgttgtttaaaagagcctggcatctcccttgctccctctctccccatgtaatatgccagctccccctttgccttaagccatgattgtcagcttcccgggcctcagcagaagctgagcagatactggtggcctgtttgtacagcctgcaaaccatcagcccaaatactcctcttttctttataaattacccagtctcaggtattcctttatagcattgagatggactaacatagtcagttttgacaacatgaacctttcatattaaaatttaatttctaaattcactcatttactgtgattggtttatagcttttctgtaataatgaattttacgtgtgactttcaatgtgctttaaaacttgattcactttttagctctatttttggaaactaccagcttccactgttgaggcaaaagtgtcatcattgaggctctcctgctgaggtagctgttgtctgatttcccttcagttctactgctgtcccagtggaaaaagggaatcttcaccacttacatgacatgtttgcctgaactctaatcttccacacttgctgtagaaaagagtaaagtggcagttcagggcagtttaccaatttagaaacggtgtccgctcagtattttcctctgtgtcacttactaaaacatataaagaaaccatggacattaaaagaaagagagaggtttaatgtgatattttaattctaacaaggatttatgggcacgtgaatgctcaaaatcacatactcccttagtgtttttcatctcacacatatcacatcagacacatatcacacacatcaggcacatatcacacagaacttgccataattaaattatcagtttttgaaaaatattatcatttgctctctttttttctatataaataaatttttttaaaatatgattttcagttctgggatacatgcaaggaacatgcaggtttgttatataggtatacatgtgccatataggtggtttcttatttgtgctttcatcttatggctttggctagaactagataataaaagtatgcatcaatttaagagttatttttaatcatggtaaggacatatctataactactttgttaaatttcatcagtcatgcatgttaaatatcattaaataaatatcaaaaatgggctgctgtaccagaataccatagacttggtggcttataaacaacagaaaggaatttctcacagttctggggtctgggaaatctaagaccaaggtactagccaatctggtgtctgggaaaaacttttgttctagttcaaagaaggctgccctttctctataacctcagttggggaaggagcaagggagttcagggggctgctttagaagggtgctaaacccattaatgagggctgctctctcatgacttaattagttcccaaaagccccaccttcaaaaaccctcacattggcggttagcatttcaacatatgaatttgagagggatgtaaacatttagtctgtagcagtaaatgtacaatataaagtaaatagctttattgttgtgttgcattatattaatatatattttctagtattaaatctttgtatgccaaatcactggggtgggtgatttcttagtaagtgtagaattcagttcctttttctttcagttaagaatattttaactatgtttataagggatactgtttagtaattttattctttttgtattcacttcatcaagagttagtaatagttatatttgctttgtaaaatgaactgaaaggaagccactttttataactttatccatatttcctagtttggggtccattttacaagatgttttaaacagatgcttattaaaaacaccggttatagggactttaataaaaatttttaaaataatgttttacatttcttgcaaaaattgatgcctgcaacctatttactgtttttaaaattaaattaagattcatttaagcagtacatgtttattttagtgaaacacgtatttaattttctaagatagtattttttgtctttaaaacaatttctgcatgttttgtttttttttcactttaaattttatgttttctcagtttttgttttatcacatttgctatatttttctgtatcatgggttatttgttaaagaatgaacttgtgtatgtttataaattgttactgtttttgtttataatttattgccttctaacttaatatgtaattagcattccttttaattttgcttgtatgctttgctgtaccattttgaaattcttgagttaaatgcttaactattttttatcaagtttaaatattaaattaaatatgtcccatcagtttagtcattttaatattctcactcatcagacattttttgggaacaccatatgccttttcatgcagtcagtttcaagaaaatgaaaattactttttatatgtttatactcaaagcttggctagagataagtctccccttccttaagttggggagagagtgatttcttccaggctataatcaaaagagatacaattatagtaactttttgtgtttgtttgggttgtttctgtttgtttgtttgtttgtttgtttgagacggaggttggatcttgttgcccaggctggagtgtagtggcataatctcagctcactgcaacctccgcctcctgggttcaagcaattctaaacatattttagcacaaaactatttaagatttcaatttatatctttttattatcttccatatactcttttgatacattacccattatgttgattattaacgtacactcaagtcaagatcttttattatgtgaggtcatcagtcaatgataacagatattgatgaattagtctcctcatcagaaattgagcaacattttcattcaagacgacacatgggcctttaaagcatattcaataatactgagtctcagtgttctcctgctattttctgaatgtgcatttagacctttatacatctatctatctactgacccatttattaaattttcagcatttactttgtactccaaggaccagaaccatgtttgtcttgttcactggtgtactcctattgcaaggacctagaacatagtaggagctcattaaactctgaggtttcaaaataagtgaatagaggttgtagcaggaagaagtctaagatagcccctatgaccttcatttcctcatgttaccctgttgatacctcacacggcaaaggagtcttgcacatgtcactaaggctaataatccgtcagccttaagacggggggagtatctgggtaaacctaacctaatcacaccaaaacttcacaatcagggagttttctacaactgagagtagaatgggaagtcagagagtttcagagtccaagaagcatttatagcacccttattgactttgaagatgctttgcttcttcttttgagttcagtttgagattatctttctaataattgattagattttattcttgtaaaaaaagagataatttaaaggaatctatttttaaatactctgaggagggtgatactaggggtgctggttgtcctgttttaactttgtcttaatttctaatgtaattaaattttgagtaggtaatgtgacctgtgtggtttttattttaaaaaatatattgaggttttatataatctatttttaaaatattcaatggaaacttgaaaacatactgtttcacatattctcgtatatatatattaaaaatctttttttatttattttttatttttatttttttttgagacggagtctcgctctgtcgcccaggctggagtgcagtggcgccatctgggctcactgcaagctccgcctcctgggttcacgccattctcctgcctcagcctcccgaatagctgggactgcaggcacccaccaccacgcccagctacttttttgtatttttagtggagacagagtttcaccgtgttagccaggatggtctcgatttcctgacctcgtgatccgcccgcctcagcctcccaaagtgctgggattacaggcgtgagccacttagcccggcctaattatttgttttttaaaagacggtacataggaagaagtaaatcaggaaaagtggatagtgattggtggcagtagaagtgagtcagtgttacagttactattgctgcttaagaaactaacccaaatggcctgggcgccgtggctcacgcctgtaatcccagcactttgggaggctgagacgggcggatcacgaggtcaggaaatcgagaccatcctggctaacacggtgaaactctgtctccactaaaaatacaaaaaattagctgggcgtggtggtgggtgcctgcagtcccagctactcgggaggctgaggcaggagaatggcgtgaacccaggaggcggagcttgcagtgagcccagatggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatcatacaaaaaaaattgtactgcaaaaagctatgaatgaataaaacattttattaaatgtatttggcaccttgtatatacctagttgatctaggacagagaagatacttagtaacattcattttttcttactgtaagaataatgacccaggaggcggaggctgcagtgagctgagcaggccactgcactctagctctagcagacagagtgagactccgtctcaaaaaaaaaaaaaaaaaaaagaataatgaatgctcatcagagggaattgaattttattattctaggaaatctgatggaaaaagtgaaaaataaatattgataccatttataaaacaatgaaaagacttataagagaagccatctaggcttttctctatacttaattatacatataaatacatcagtactttacttcaaaaaataagatcatagggtacatttgattttatgatctgaactgctcacctgaccacacaaaacaaatactttaccatgacattaaatagtctgctctctggttgttagtgctggcatactattctatcatatggaaaaattacagttttccttcacccagtcaccgaaagttggatatttaggatgcgaccagtttttcatgataataaagactaataggaatagcagtagacataagatgtttttggcatcttttttttcttgtaatacgttctacatattgaaactaataattgtattttgctacatattgccacgtttttctcaaggaaaattatagctaacagaaagtgtcagctttctctgtgtgttaagggtgtgggtggaagctcggcagtgacgctgagacatattggtatggaacatcattggactctctagagatcaaggtagcagtcctgtagaaatgttagcccgagctgtgtgtcacctgggagtactccaaggacggccaaaagaaatattttagttagaagacaatttataagaaaagtttagaggcttcctagagaggtcatagcatacacaattttatttcatcctttagggcaagccgtatatatatgttctgcgcacatctcctcctgcaccctcctcaaaaaaaaaaaaaaaaaaaaaaaaaaaaaagctgagatctgatgtaaatagatagctgtgaattatagcttggtccttaaggaatatctcagaaacttcaatgttccttcaccccctccgcaaacccttctgaattgagaatgggaaccttggcaacagaggggagtcatgcacctcccttttccatctgtgactctggcatcttcctccaggtcagccatggtgcaaactctcacagttactttctggcagtttcctgcattccaaacctgtttctgaaatgggcaatatttgtccccttgaaaatcacctgtgataaatgtggtatagcccacggccagtgaaaattttcctacagggagacatattcctaagtgttaacattaactttttcagatgtttgagtcagactcaattgccctttcatattatagattgaaaacaacacttggttgatgttagtatatctgattgaggaaatatgagagcctttttaatttagatttgctcgcctagaaaactcactttgaaacttcttggtcatgttatgtttgcttatggcaaagttatcagcaaaaaagtcactgttatgcagcaatttatctttaaacactaaatgacatctatcatttttcaaagaaaatagtgtcagcagttaaaatcctaactgcttgagcactgttagttgacaattataatgccccattgcttagaaattaattgacctactttcaataagaaacataaaaagtaatatcacagcaattttctggatctattttattccaaaaccaataaatgttacagtgttgttaaaagtaatagatttaaaaacattttattttcttaaacttaacaattcaaataacataaaataatattacgtttctattaagtattcatttttatacagaccaaaagttctttagaaaatgtcttcatgtataatataaatttgatttttagatgtgagaaaagcaacaatcataatcgttgcctaaatccacaaaataagtagatattctataatatgtatttcagtaatcacaatgtattggattcaggcagagatgagagacactctgattttagcagaaaaagactgtgttaaattacctctttgccttttctcactctgttcctaggatagcaatataataaatagtaactttagaactgggatacactgagaaaatgtcctaatttaaatctcaatagatgattacacaggtagtgtttacacacacacacacacacacaatgacaggagtttttaaagatattagtatctcggaatttttgaattctgaaaactgtccaagcttttatcattaaatcacttgttatgaaacccattttagaaacacgctttcctatttttaatagcctatgatagtcatacagaatgagttaatcaaaattgattggtcaattgctaattgcaaattctttgaccgtagcatgtcagctgattctatgaacttctacagactctttcccttggtccgggagttgccacaacactctgactcctttccccacaactccattacatgatattgtcacctccccaggcttacgatactaatattccagagagatgaacagtccttgattttgaatagcaatgcagtagtgaccaaaacagatttagttttggttcagaagaaagtgctggatatgccctcagtaactttccatggtcatctaattcagcaattagtttgagtaaattcaatggaaggctgctttctggaatgggtagtgtaatgtactgacttccctattagacatttcatttaaaaaaatcaattgtccgcataaaacaaccatttcaatcagtgtacattcaactggaaaggaaagttagaggactttttttgaaagtaatgggattggggttggccgttgctaatttctttttgattaaagcgtatgtaattgttttgtgttggataaaaatttgactttttatttgcgcggatgctgctgatcttatatgttatcatttcccattcagacttgagctgtttacctgccgggttttctgttcataaaatgttgaaaggacgttaaaatgtagaacttttacattttttatttaggtgactaggacaaattctggtaatttgtaggctacaacttaaatgtatttctgcttaaaatattttgaaatatggtttatttcacaaatgaggttccaaactataaccagctctcactaaattcttatttatttatttatttatttatttattttgagacggagtctttctctgtcacccaggctggagggcagtggccggatctcggctcaccgcaagctccgcctcccgggttcacgccatcctcctgccccagcctcctgagtagctgggactacaggcgcccgccaccacgcccagctcattttttgtatttttagtagagatggggtttccccgtgttagccaggatggtctggatctcctgacctcgtgatccgcccgcctcggcctcccaaagtgctgggattacaggcgtgagccaccgcgcccagccaaaagatcatttttaaattatgtatctgggaatatattatcaaaccaggcctgaaacttattaaaaagatggtaaaatctaatttaacttcatttaatactccttttctcttagtcttataaaagcaaatgagcttgttggcttttcattatgaaaatataattttaatttataagacatatgtaacaaagcaagatagctgctaaattcactctatcctagtaacttcctattgcatacattcatttttaatgtaataagaaaatcctttcaaaatgcttaaaagaatcacattacccaagaagaggctcaacatttctagaaaataaatatgttcttaagacacttaataattcttgaaatgaagacctaattcttcagggctttaaaatatttgatgtgcactctttacatatatagagagtttaaatttaataatttcccttcttaaaaaagaagtgaaacataccacaaacatatcaaagcaagttattcatacttctcatttaagtaactgtattgtcatagcaaaattattttatatcatcaaacagcacaaaagccttattagaatactaatttcaatgtctgtttcacagatttgctcagaatagattttttcatgcttctgcactaattcattgaaggacaatgttttaccgattcctgaaaaaatatcattatctgccccatagtggtggctcatgcctgtaatcctaacactttgggaggccgaggctggcagattgcttgagcccaggagttcaagaccagcctgggcaacatggtgaaaactcatctctaccaaaaaaaaaaaaaaaaaagtaaaaagttagccgggcaaggtggcgggcacctgtagtcctagcaactgaggaggctgaggtaggaggatcacctgggcctgggaggttgaggttgtggtgagccatgattatgccactgcattccagcagtgggtgacatagtgagatcttgtatcaataataataagataaaatagaaaataaaaatatcattaactgacattttaaaaagtatatttcccaatggataaatatactttgtggattaacaagagaaaaatttcaagatactgtaaatttaaaacaaatctttatgtataataccatcgtaatgtctttgaccaggagcaatctatcatgtgagataaaaaatattaaatatgcatttattgaataaatgaatgaaaatcatgattaccttgatcactatatttaaaatttaaatgaagcaggaaagtaaatcttcctaattatcatatacttaacataactgtttaaaatcactctaataacaagtaatatgttaattttgaattataattttaaaatgcctgtattgtttcattcactcatccttccattagttcagtgaacaaatattgattacttacccactatgtgccaggtatcatcatagattcagggagtacaaaaatggttaaacgaagggatcagctggagtgaccgttttctagaaacaatgcctatttcagttatgaactagtctgttttgaagaaagtggtgagggaaagctgaaaatcctattttcactttattcaacaaatcttattgaggtcttattatgaatcaggggctctcctaggtatgggcatacaaaattgattaagactgtgcttgcttgcagaaaacaaacaaaaaagcatctctataataaaaaggaaaaagaggaaattccctttgtaggtttcatagtttatagtgatactgctgatgttgtctcagagaattagtcacaattataggaactcagaaggcattccgttgagatgaaatagagactaaagtagcagagattacttagtgaaataacaattcgaacatagttataattcattttagaagatattatggctcacacatagtagatgtgatgactgaataacaggaatgtggaacgatggcaccttggtagccattacccattgccaacatgattctgcattaaaaaatctgtgcaaaacggccgggcacggtggctcacgcctgtaatcctagcactttgggaggccgaggagggcggatcacgaggtcgggagatggagaccatcctggctaacacggtgaaaccccgtaactactaaaaatacaaaaaattagctgggcatggtggcacgcgcctgtagtcccagctactcgggaggctgaggcaggagaatcgcttgaacctgggaggtggaggttgcagtaagctgagatcgcgccactgcactccagcctgggcgacagagtgagactccatttcaaaaaaaaaaaaaaaaaagaacacaactttggagtatattaataaacattgtgttttttaaaaaaaaaattttaatctttaatttccgttttcacatatttcttcttgcttccaaaaggaaaggagtgggtagctctgttgtacaccgtccacggcccctggatccgggcggggtcccccgggccacctgggggtccacatgcagcccccgggaggccggtgcggggtgaggtccgggggccgccttattgctgaagtccggccggttggggccccggcggccgctaggcgctctggctgcgcagctcctgggagatgaagcggcgcaggcgctccaggtactggctgtagagctggatgtctttgtgcccggcgccctccacccacagcggctccacggccttggggcagcgctcctagagcgccagcccctgcgagaagtcgatcacctcgtctttcgtgccgtggataatgagcacgggcgacgtgatcttggacaccttctggattctgcgggaggggcgtggggcgggtgagacctctccgggcccgggccccgccccgccccagtccccgacccagtccccgtccccgcccctgtccctgccccagcctgctcacttggggaaggcgtcgaagcagtaggtcttcttggtgtcgggaaggcgacgctcaggtccaaggtgagcggcgagtgcagcaccaccgcggcggactcgtagcgcgaggccaggtccacggtgggcaccgtgccgatgctctgccggtacaggatgatgctgtccgggctgatgcggtacctggcggcaccggagcagggtcagccgcggcctccgactcgcgcgcacccctcccgccagcgggcgtccccgggcccagctccagatgcgactctccagtctcccggctcagcctagtcagtgggtcaggcccaggctccacagcagtcccaagggccacccccagtcccccaagaccgcagcggtgggcggagccggcggcgtggtcctgttccctggcgctatggttcactggcgtttcctagccaggatctgctggatcctggctagggagtccccctcgggctagggtaggggaagccctggcgcctctccttctcctggtcatccctgggcgcacactgggaactgtgtgcccccccacatcctgaatgcttcatgccttcctgcccaggttagaaagccgttcctggtgcactggccggaacagggtacactcttcctccctgcagcccttgcccacccccttggccatgaggaattcaggcagctgtgtccccacatgtctccacccaattttggactctcggagtcccatgctcaatgaggtgccagcccaacccaggtcaacatcgagggtggcggctgcgggggcagcacctcctcccaccagcgccttcccttgggagtggacaagtcctcggccacctcagcaccaccagctcccacccagggccacccccaccgccaggtcactggtgtgcggcccctggcccagctggtccagcaccagtaccaaggcctcctcgtgcccagtcccaaccacgcgggacccacctgccaccctgtcgatgccgcaaccccagaactctcctcccacacgctccaggctctgatcccaggcagatgccctcctgcgaggcaggagcatgggcaggtgtgcgtcccatctgcctggcattcggactccaccagcagggctgtacccctccttggcctggaatcccagcctcctggcagcactccacagctcactgttcacccatgccccaaaggatgctgcctggctggtgcctgtggccccagctctgcctcagcctccttggcctgctccctggcagccaaggccagtagtgtgctgagccagcccagccctgtcacctgctccaggcaggacccccagctgccacctggatgtcaccactcagacaatcaaacaagacacatcctcagtggaggccctgagcgcgatctggcctccccctcatggctctgggccgaggttcctgcaggacaaagcagcagcaggacagatggccgagcagacagagctcagagctggccatggcgggtgtgactctgccagtgccctgggcagtagagacaggaggggtccgaggaagctgcatgaagtggtgcttggtttctgcgcccacactgccaggaggcccccagagccagggtggtgccaggggacccagctcccaggcccacagaagggactgcctgggatatcgccaaggcatcgaggaccccacctccccagggcctctgacttctcagagctgcgcctggcccctgcaggagcggggcagaccagtggggggcagggccaggacgagacagccccagcgggtggcaagcaggaaaggcctccagaggcccacgcgggtcttctgatccagagcagcactggcccgggcggtgggcggtgctcaaacaccagtgaagggcccaggaaagtgcagggctggggacctggatgtttaggagggctggatctggaatggaggctggcccagacctcaggtgtgtgctgggggtctgcacctgacccagcaggccctgccccgggatggccgagctccacagccacagggcctcatgggccaggcctcgggacctcgatgcagcagcctcgcctcacctggccccaagtgctgcctcggccattgggctcccagccacacgtgcacagaccccccccagacaccacccaccccctcccgccgggtggcgtccacgcccctgtgacaagctcagccccttcctgtcctcaggccaggggatcccagagagcctggctccacaggccagggtgtggggggacctggccacacctcagccatgtggaggcggcacccgcacgcctgagctcacctttccggctctctggccgcatgcgtccactgtggctcctctcctgcagggccgcccaccttcctcccagggaagcccgcccctccccccggcccccggcctggtcccctctccggtgtgcccaggctgagctgcccccggggtcgccctcacctggtgcgcagggcctgccgggcggcgtcgatgtcggcgtagaggttcgtctcggagggcctgcccgagctggcaccgtagccggagtagtcgtaggagaagatgttgcagtggaggcgggaacacaggccaatgtagaagctgctcatctggcccaggtccacgcgttgccttccttgttcatgcaccgctggtcagacgcaattcagctgatgtaggctgggcttggctagcattggcttgaagctgcagctggtgtccagatctgttccatgtatttgtgatcctcctcagccctcccgggtacttgaagcatgttattgttgtggccaaagtcaggagtgcaacctgcctgtgcaaaaacatgccaggcttctgttgccttaaatcctctaagatacccctttggcttaagcagagtcacacagcaaggatcaaagtcaaggagtggggaattatatctgtcccttagagatggagataggagagagtgtgaacaaatgcaggaaaatgatctcatctaccagagtgtccttaaagattttaacataataaattcagtattgtttttgtttgtttgaatgaagctttgcatggacacagtacagtacaaaagtactatttgaactctttctccacattcataaaattgctacatagtttctaccatgattatatttttatgatccatttttgtgtacagatctgaaaactttatactagaatttattagctgaggaaaggaacatgcactgacatcatcatacacaaatatttctcaacattttaatgcttgtggtattgttaatgtttctgtggaaaattacttaaaatcatagaagtgatttctaagtcagttattgatttattctgatgaattataaaaatcagactaaattagtaatagagaaattacacttgaaatactagtctgagctacaaatgagatggatttttgtgctcatcatttgtactctagttatgtttgttgagattgggttatgaaaacatcattataacattatcagcagaaaagcctgttgtgctataattaaatcatctaaacaatcatttttgtggtcttaatatcctggatttctcaattgattgtagtagataagagttctctttaaatactacttattatcggtagcttgcttttctgtgaaatctagaaaatttagaattctgcattaacatttaataaaatacctgctatcctaatattgatgcattatatttatctatacaacatgcaacaggagagaaatatcagatgaattagaatatttgcagcctatggcaattatctgtagccacatttttttttgtcttcagaaaaatgtagatgattttggaaatggattagttctagtctcaatctaggaagaattacttatggaagttttgtgtacaggatactgatgttttcaaatataacgcattattattttagtttagtttcttttgccacatacttagaaattgttcaagtgaacaggctattaaaacgaatggtatagataaatggtatagataggcattgtaaacatcccacttttcccaagccatgaattttaacactggattaaggagatgaaaatggagccattgggaatgtggattctttgctaataattatttttcttctttaaaaagattcttcaaaaggcaagaacatggaagtatttcaggagatattcttgaggtatctaaaatacatactcttcctatcaaaatcaataaatagatggatgtaagtaagataaagtcagggcaactgattttgcatgtgagtgtacacacagacacatatccaggttttctccatctgttctcagttgctgaattattagactcagctgaccgcttgactgtgtttaatctgataaacagactcttaacaagaagaacaatgttttaaaaactggactgttcctcctacttctcagcatgcatcagccactctctttccccatcctatctcctgccaaattggtctctacttatctgttccacttggagacactatttgatgttgttgtaaatgacataaatgaatattcactctacctgctttcatattaattcagttttcataggatggtctctgtgggatcaagcaaaaggacttagtggaatatctcttatgactccataaagtaaagaatgtggtgagtttagcagagtgcaccttcctttactaaatgtgaatgatgtgtcagtatagggggccagagtgaaaagtcctaacatatgcttgtttgggcagccaacaattggtcacattgcacatttcatgttacaaaggagcctcatggtagtataaatgagggtcaggaaaagacacttaactgtgctctgggctttaaaatggagccagggcaagaattctggaatttgacaatgtcaggaaggaaacctctgtaagcaggcacgcaggggactccagaaatctcttctttgccactacaactctggactttcagaaatacacaccccattctcctgtattaatacacacttcatgttcacaacatcaaaaaccaattttaaaatagtaaacctaaggtagatggaaaggcattatagcctcagcatgcccgagatgtgaggagcaaatcagaaagatgtgagtgtgacgagaaagggacatcgtgctaaccaatcatttaaaatttttactccaaagaaatggcaatatttcacaggttttttctcatcaccaatctcacaaatatacatgttttttgaaaattttcctctcaattcttctccttgacagtgaagtccagaagaggttggtttagatctaactcttttcagcctcaatactccataatcactttggcttttttgattatgactggacggcatgtactattattttaatattaaatatttaggaaataattttaaatgttatccttaaataactatgggctttattcatttactgtatgtatttctcaaacattcataagaacttaaggattttaattcaaatggtccctaaagtagaaaatgcactcacagattctgcatatgtcttttaagaaacagaaacgtgccatttgttattaaattgagtagactttgtatcctttagaatttgggcagagttttcttgctatattgtagagaacctatcaaccatatcttaattttcttctttttgaggtcttcaaaattaacattggcattggtccactaattccttgttttctatttttggatgagtgtgcatagattacctccatcttaattttcaacataaacttttagcagactctttcacctttcattgccatgtaagcagatgtgatttttattcttttttccttttcattgaacagttacttcatttgaaatttttcacttgatttaatttaactttattttttggtggtagatacatctgttgccacctgtgtctggttggcattttaatgtgttgcctcgaagctgtaaccacaatagtggcacattttcctgctgttcctttattctttgttccatgtgtatctattttcaataaattgcattggtatattatcatagattttctttttgtctctcagattttctgttgtaattatttttatttatgcctttggaaatattttatgattgttacataaaacagcagagctctttcagaaagttttcatggttttccaaatgtacattcatatagattatttagtagttattacacaatgatctttggagcaataaatgctgttacgtaagaacaattcccaaatgtaatttgagttataagctagcctttgatggcctagaattgatgtacctttataattctaatctgcatgcaaatttaagaagaccaaggattgaggattgggtgcataattttcagggcccagtaaaaagtgaaaatgtagaaccctttgataaaaacttacaaagaatttcaagatgaccataataggccatgcacaaggcctttgtagatgggtagagtgaccatgaagccatgggcattgtttggttttgtttaatcttactgtttggttgtaaagcagatttttaaatcaagagaaaaaagaacaccaaagaagatctctgtcaaaatgtttgaagcattatagaagattagatccatataaatgaaagggataaagaaaaagcacatatccaacctcaaatataaagcatggaattctcatatgaactccattatagcacttgatatttcagctctattttcatttttgaacaactctagatatatctatatattttagtctaaaatttaatttttataaattgtaagtacttccccaaattctaccttagataaacaattcagagataactctgtttcctattctattaggtggaaccatatgaaattgtcagtattcagccttttttgtcctacaaaaaaatgacagttttgtgtttccacctaacacatggcagcccaataaatatgtgaaggtcaggaccacagagctaccacactaaacaatactaaatgcatacacataccctttccaaaacccggcaggtcttcttttccccaagtgaaacattctttgactcttcacccattattcatgtgagaaattttccaggcacttcaacatgtcagctcagtgactgtaacaattaggtttattaattctcctctcacaatttgacattctttattgaaaagcatgatttaaatgttgactaatagtctgcatagtgaaacatttttactagttccaatgacctaaaacagtgtaaaccatgattcagaaatttattttcttaaaaacttctaaacaaaatgtctgctaggataaaccggtgcaatttctatgtgaaacctaagaatttcaatgacacattttcatccttattgccatcaaataatccctttaatagtgccccatctttcttactccttcatatgattttctatattattattttccatcactcattctgttaaaactataatagtttcttcagagaaatgacagattttcccacttcagaggcatttctgcattgagctctcataaacctctctaacatggtgggcaatagactcaataacatttgtgtataaactcagttgtgaattacaaaaggctcatctataacgtcaaaaagcaactcggtaaaaacaattctattgaagatagtatgatctaaatatataattttaggatggcttcaactgagacaaaaatagcatcgatacagtgtggagcaatgaatttctaaaatttttatcagcttaacatttttcatcagcacaatttatacagaagcccaacatgagacattcttgttcacatggaatttctctgcccgctggagccctgtagaaatcccactgtgttggtaaacagcagtagcaacaagaagatactaaactggaattctcagtggctcaaccaaaccaaagtttgttggttgctcccataaagttcaatgtcagtcagaataaactcctctagccttaacctatgacacacatggcacataaccttccaagtactggcagtggaaaaggagagaacttgggaatgaggcaggggcttcatggtgaacatggtgaaacctcatctttaccaaaaatacaaaaattaggtgggtgtggtggagtgtgcctgtagtcccagctactcaggaggctgaggtagaaggatcgcttgggcctgggaggtcaaggctgcagtgaaccaaggtggtgccactgcactccagcctgggtaacagagtgagatcctgtctcaaaaaaaaaaaaaattgtgaaggtgaaatttaaatacctttgtgcatagctatcagttattctttgttttaatatttagtttattgtgaaatataacacgtatagaaacatacataaaacaacacacagggccaggcccggtgggtcacgccttgtaatcccagcactttgggaggccgaggcgggcggattacttgaggtgaggagtttgagaccagcctggccaacatggtgaaaccccatctctactaaaaatacaaaaattagtcggatgtggtggtgcatgcctgtaatcccagctacttgggaggctgaggcaggagaatcgcttgaaccagggaggcagaagttacagtgaaccaagatcgcgctactgcactccagcctgggcaacggagtcagactgtgtctaaaaaaaaaaaaaaaaaaaaataggccgggtgtggtggctcacgcctgtaatcccagaactttgggaggccgaggcgggcagatcacttgaggtcaggagttcgagaccagcctgaccaacatggagaaaccccatccctactaaaagtacaaaattagctgggcgtggtgttgcatgactgaaatcccagccactttggaggctgaggcaggggaatcacttgaatctgggaggtagaggttgttttgagctgagatcacgccattgtactccagcctgggcaacaagagcaaaactccgtctcaaacaaacaaaaaacaaaacaaaaacaaaaaacacagtgtaacatgttattatgaagtcactgctcagggaccaacttggccgctcctgtgcctctagagggaagctccttcccactgttctttagagttttatatgttaagtacaggagtcaacaaactaggcctatgcaccacatctggcacccagcctttatttattttttgagatggcgtctcactctgtcatcctggctgcagtgtggtagcacaatctcggctcactgcaacctccgcctcccagattcaggcaattctcctgcctcagcctcctgagtagctgggattacaggtgtgtgccaccacacccggctaatttttatatttttggtagagacggggtttcaacatgttggtcagtctggtctcgaactcctgacgtcaggtgatccgcctgcgttgccctctcaaagtgctgggattacaggcatgaggcatgatgcctgacccagccttttctaaaatgaaggtttcggctggcgcggtggctcatgtctgtaatcccagcactttgggaggccaaggcaggtggatcacctgaggtcagtagttggggaccaccctggccaacatggtgaaaccccgtctgtatcaaaatacaaaaattagctgggcgtgatggcaggcacatgtaatgccagctactcgggagcctgaggcacgacaatcacttgaacccgggaggcggaggttgcagtgagccaagatcacacgattgcactccagcctgggcaacgagcgaaactccatctcaaaatacaataataaaaaaaaggatgtccttttttgtctctcaaccccgttttttatttttttttattttcagacagggtctcactctgttgcccagggtggagtgcaggggcccgatcttagctcactgcggcctcaacttccccagctcacaggatcctcccacctcagcctcccaaacagctgggaccacaggtgggtaccagaagttattaggatagagtgaatttagcagctatcttgctttgttacatatgtcttataaattaaaattatattttcataatgaaaagccaacaagctcatttgcttttataagactaagagaaaaggagtattaaatgaagttaaattagattttaccatctttttaataagtttcaggcctggtttgataatatattcccagatacataatttaaaaatgatcttttggctgggcgcggtggctcacgcctgtaatcccagcactttgggaggccgaggcgggcggatcacgaggtcaggagatccagaccatcctggctaacacggggaaaccccatctctactaaaaatacaaaaaatgagctgggcgtggtggcgggcgcctgtagtcccagctactcaggaggctggggcaggaggatggcgtgaacccgggaggcggagcttgcggtgagccgagatccggccactgccctccagcctgggtgacagagaaagactccgtctcaaaataaataaataaataaataaataaataagaatttagtgagagctggttatagtttggaacctcatttgtgaaataaaccatatttcaaaatattttaagcagaaatacatttaagttgtagcctacaaattaccagaatttgtcctagtcacctaaataaaaaatgtaaaagttctacattttaacgtcctttcaacattttatgaacagaaaacccggcaggtaaacagctcaagtctgaatgggaaatgataacatataaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcctccagctcctgcatcttatcatcctgctcaaatatcttatactccagccacatcaacacctctgcctgcttgacaaactactgctccagaaacaccatttaatccttcagatactgcatcatcacatcctatggaatcaactgctcctgctgcatctgatcaaacacaatacacatcttatacattctggatatagagaagcccatttgaactcagacactagggaaaaactaaaggagaagttataacttgaggtagccttggatgtattgaggtaagaagaggacatctatggtatggttaatgagaacttcagggcaaaggatgtcatcccagcaaggaaaacggcaaaggtacgtgaacaaggcagacagggagaacaggcctctattcacaaagcagagagtacaaacgttggaaagcaatggatagagggccacaccctgaagattccaccctgaatgttgaagactctccactgagtgatataatgggctctggaaattcataagggggaagttggcaggtgggtgtggaataaaaaagctacatgtttggtacaatgtacactactcaggtgacaggtgcaataaaatctcagacttcaccactatacaaattatccatgttacctaaaccacttgtgctccaaaagctattgaagtaagacatttatttatttatttatttatttatttatttatttatgtttatttatttatttttttgagacggagtctggctctgtcgcccaggctggaatgcagtggcgcaatctcggctcactgcaagctccgcctcccgggttcacgccattctcctgccttagcctcccgagtagctgggactacaggctcccgccagtacgcccggctaatttttgtatttttagtagagacggggtttcactgtgttagccaggatggtctcgatctcctgacctcatgatccgcccgccttggcctcccaaagtgctgcgattacacgcttgagccaccgcgcccggccaagacatttaaaaaatgaaaacaaaacactatcacctgagtaatttgtttgcttacattaaatatcataatacttttcagcaaaaaatattatcattttaatgtaactttcgttccctgtatttgagcggagtactgcactatccataaacaccctctgaattttctacagtaatggaaaaaaatctttgaaaaaaataaaagaaggttctatgtttgagaatatggctatatgaaaggggtttcaagaaatatccagttcttcccaagacgatgtacttccagtgaccagttttaagaagtggaacaggccaggcgcggtggctcatgcctgtaatcccagcactttgggagtccgaggcgggcagatcacgaggtcaggagatcgagaccatcctggctaacacggtgaaaccccgtctctactaaaaatacaaaaaattagccgggcgtggtggcgggcgcctgtagtcccagctactcgggaggctgaggcaggagaatggtgtgaacctgggaggcagagcttgcagtgagccgagatcacctcactgcactccagcctaggtgacagaatgagactctgtctcaaaaaaaaaaaaaaacaaaaaaagtggatcgaatatttcctaacgaggtccttcaagtaataataagtgattaaactttttgataatgataatatcaattggacatgataaaaatactattaataaatcttttgatttaaaaactaaccttgtacccacttcttttgtaggcgtggggggagcttagagttaagtattccagtatccgttagggatttggcagtatacatcaataacaaatagtagaaggaaaataattatacctgtgtcatatatatatatatatatatatatatatatacacacacacatagagagagagagagagagagaaaccatctcttaaattacctgtagcaccactatgttattctttactctcccaataccccaagtagattgcacatgtgactcttttattaatgtgttgaatattcataatgataatgaataatatgaataaataaattgataagtgcgtaactatgaattaggcattgctttactcttatctggagatttcaattcatgataaacatcttttagtgaccatgaataagaaactcatagacctgcattagagaaatgcaaatctaaaccacaatgagataccatctcactccagttagaatggcagtccttaaaaagtcaggaaacaacagatgctggagaggttgtggaaaaacaggaatgcttttacactattggtgggagtgtaatttacttcaaccattgtggaagacagtgtgtgaattcctcaaggatctagaactagaaataccatttgacccagcaatcccattactgggcatatactcaaaagattataaatcattctacgataaagacacatgcacacgtatgtttattgtggcactattcacaatagcaaagacttggaaccaacccaaatgtccatcagtgatagactggattaagaaaatgtggcacatatacaccatggaatactatgcagccataaaaaaggacatgagttcatgtcctttgcagggacatgcatgaagctggaagccatcattctcagcaaactatcacaagatcagagaaccaaacgccgcatgttctcactcataagcaggagttgaacaatgagaacacatggacacagggaggggatcatcacacactggggcctgtggggtgtgggggtgtaggggagggataacattaggagaaatacctaatgtaggtgatgggttgatgggtgcagcaaaccaccatggcatgtgtatacctatgaaacaaaactgcaagttccgcacatgtaacccagagcttaaagtataatttaaataaataaataataaataaataaataaactcatagacctcaaagtatgggaagcctaactgcctacggccacttgctgcttcactctaaaatctgtttctgcatctgcccctcagtcaatgactgaggcccacagggtggctaatgcagatccctctttaggagacacagggcttctctgaggaccagtcttggctcaggattccctgaagccttttctcacccttccttagactgtacattacgctccagtgcttccactcaaccttcctttcctctttccttcattctaggtcagacttgcctcatagctgagacctcttccaggcttactcagcttcctctccattttctctcacagggatttcccttaataaaatcctcttgtgtttaactcgttttcaacatctacctcttggaggacctggactaacccaccacataatgtttgtattataattacttccattctacaggttgagaatctgggatctggagaagttaagcaacttaagttactcaagtaaggccacacaacgtatataaagtgtgctgcaaggagttaaacccagggaacgcacactccaaaacagaaccatcaacaagtaccaatcctgaaaccaactaataaaaggtaaagatacaattagcttggtgcaaaatgttatttttctctctaattacattttctaaggtttcactgtttgtgattaagaagggatgaatgattttcatcaaaactctgctcaacaagccgggtgtcgtggcatgcacctgtagtcccagctactgaggaagcagaggcagggggatcacgtgagcccaggaggttaaggctgcagtgagctgtgattacatctcgttgaccacgtgaccctgagtgtaactcatagacctcaagcctgggcaacagagcaagactctgccttaaaaagtaaaactaagcaaaacaaaacaatcctgaacaaatggttgcacataaccagctaaacagtaatataacagttgttggcagggtgagaagaaactagcagactgtaggtttgtcatactgtttttttgtttctccagaaacacagatataatataggcaatgaaagctgagactcatctcttaatttcagttaagctattaattgatttacatcatttacttacaggtcagaaaagttcctttcaaaaggcaggaatgttgtttcatgttaatctaaggacttgcttaccttttgtttctgttcttaatgatcacagttactaatacagttaaataatatttagataaaatacattacaattatagctgatcaaaaatctcattccaagctgttatattgttgactatctcatgatcactcttcttatgaatcatgtaaatagggaaaaatactgcaaagtagacccacgttacttcaaatgaaatatgatttaataaaatcagttattctttgccaattttgtaatgttcaaaataaccacaattgaaatagtgatacatacacatcagaacagttcaaatgaaaaagagaaatgataccaagtgttggcaaagatgcggagcaactagaactctctcccattgtggatggaaatgtaaactgatggacaccaccattttccatgtatgctaaatctgaccatattctatgaccctgagcatatacccagcaatatttaccaaaagacaaatacatgaatgctcagagaggcaccattcaaaataaccacaaattgaacttatatttgtataatgatatagtatatagcaatgagaacctaacaaattacaactatatgcaaaaagattaacaaatcttataaactaaatattgaatgaaagaagcaagatacagaacatattctacgatctaattcactaaaaattgtaaaactcatcagttatgttccaaatcaccataagagcgatcctatgaaatagtgtctagaagaagtaataatataaaatttcctgacttgagtactggatacacagaagggctaagtttgtttaaaaacaaaagaagtattgagctgtacagttaagatttgggtattttactgtttgtatgtattttcagcgttagaaaattatgttaaaaagtctttatgctctttttcttaatatatttacaatagacaaattttcattaagccacagtataaataaaaaagacccacacaggtatttttaacatggatgaagtggttctgtcatcattaaatgagtactttaggatgcaagtctgatataaaaacttacttccctgaagactttaattttgcatgcaaaatacacggtttctaaattaaatttttttgtaacaaagcgtttttgagttcccctcatggaattttaataaatcattaatttcttctttttctctttcatgcacaagcagtggataaacatttcaaagatccctacagaagtttcttcccttgaaatactgttcacatgacaatgagaaggatggaataaaacacaaaaaaggtaagcaattttttttttttgaggcggagtcttgctctgtcgcccaggctggagtgcagtggcgcgatctctgctcactgcaagctccgcctcccgggttcccgtcattctcctgcctcagccttcgaagtagctgggactacaggcgtccgccaccgtgcccagctaattttttgtatttttagtggagacggggtttcaccgtgttagccaggatggtctccatctcctgaccttgtgatctgcccgcctccgtctcccaaagtgctgggattacaggcttgagccactgcgcccggccaacaggcaaatttttcgttggggaagtagtagaccaaccatctgtgcttatttcttctaaacagagctgggaatgagtgacagcagttgaacaggaacacttgctccccaagcactacttgtttttcatgaagaaggaaaaaaggcaaaagccctgctacatttacattcgcaaaattgttttcaaatgaggattaacaagatgttagttccctctctgttgaacacataaaatattaaaaggcagtgctaatacatctatatacagcacatcaggaggaaggaggaagtcatttctcctgactttaccaacttgtcttatttgaaactgataccgtgccctattggctgataggagtttcactttatttagaatacaatagaatttggctcagattcacaccaaaagtatagtattttgatgtgcacttacacgatttcaggggaaaacaatatctggaatgtgaccctggaattcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagtcttattacaggtaggaaactgaggttccaagggggtgggaagtcctcctaagaggaggggtcagactggaagctacacaaaaagaggcagaaatgtccctccgcctcttaatcggagcctggggaaacaaacacactcgtgcaaaatctccaaagaggtgagctcttcaccctgtcaattttatctgcctcgtgaaccccagggctcaggctccaggcccgggctagctcacacaacagcagaagggccttaggtctgggcactgagccaaaaaaagggaggctgtggtccctgctttggttaccctgccgggtctgagcgccaaatcggatctcctacttctctctccctccctccctctgttcctggactgggggcaggcccttctgctaacagaaagccttccagtcggagaaagctctggcagcctgccgcgataaagggccctgggggcgtgaggagagcaaggggctcaaaatcagaacccagcgtgacgacagtgcctccatgactgtgctcccgcaatgcgcaggctccatgtcctggcgcccgcccgcccatggacccggcgggggcttccaggctgggctcagccattacgccggcgtgcgggggaggaaactcgcctcccgggcactcggttgtctcctgcccccgcccctccctccgatccgggcccatctctgacgtagtgtgaccttgctcatcccttccaggctgtgggcctgttttccctgtgcaagatgagggtcctggctgtcctgaggacgctgtccgggcgccgccaggggtgaccgaattcagctctgctaagactgttgggaaatgaactccctgtcggcgtgtggcagcccgcctgcgccaagcgccacaggaaaagggggcgctcctgtccctttgccgccccccaaaatttttctgggaacggaatccactgactcgcccctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatccatcttgaaaagataagctttctgtttgtctttaaaatatgacccacaatatgcctgtttttaaacagtgaatgatgctctaaaatcacaatataaattcaggcagtgctccttacatggaaagtttaagtacttctaacactgctctttttcacttgttatgaaaacacagaacaattatctaagcatctaattattcaggtcctttgtttctcctccaatctattagttttatagtaattttagggcctgtgaggatgaagctgtctgtgacagctaccacaaaggttactataggtggacaaatttcaaacaagtttatcaccactaccatccccaccataaaactgtctcaatcaagggcaacacaattcaatattagccaagacaacctctttacctgtcactgcttaagaaaaggatttttggtcttatttagaaataactttccgtacctatttttctccataaatccactgagaccaatgtgtggctctatcgcaagcaccagcaagcaaaactgcctgctagaaggttcagtttttgtatctttccaaatgtagaacacagctatcttcaaggatttcataattttttgaaaattgatgcacaaacttcttgaaagttcagagacacagcagctgtaattattctgaaggctggttacgggacacattaccttcatactttgctgtttaagaaatgtggggtggagaatcaagtaaactgatagaatttccatataaaattctaagtgctctgagaacaaaagaaacttaaaatacacacacacacacacacacacacacacacacacacacacacacacacacggttttccctactaatcattttacaactaaacaaccaagttgctaaaccagagcccacaaaagcagagtcaaagttctaacacttggtaaaagaaaaatgcacacatacccctgtgagctaaaaaaaaatgcttaagtattcaaagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaacagccgttgaaattggagattggaggctacagtttattgagacctggtttggtgctgttagggagctagaaggctgactgcagggcctgaagagtgggagagacagctcctttagggcctgaagagtgggagagatgtgaggatggggagacagctctttcaagaaattccgctgcggttgagaacagagacactcagtggggtcgaatgagggttttgttcccatagtagaggcttgaacacatttacaggccaatgggaaagatccagttgagagcgggtagttgagccttcaggagagaaaagggatgttccatggggcaaactcctgagaagggggaggagatggaaggaagcttctgtggatgtagcagatgcaggagggtttgtgtagttttagccgggctcgagccggtggctgacgcaggcaggaacaatggctcacccatgttttatgtgtatttccgtgtgcgtgctcctgctttccccaggtctgggccgcctgcctggcccgtgtgccgtagggaatatccacactgggcctgggcggaggctgggcatctcccgctctgggcttgctccctgatgagattctcagaccgtgcttcccctcattcatgagaggaaggttcacagagcaggcgtgggaacctgcctggccgccagggcctcctcccgctcaggctgaggtttgctgcatctctgtccttattcccttccagactggattggctgaaccaggtgtccactctttttggcccatggcataaagaagggtttgggcaacccagtgtgccccaggttgttaccgcccccccgcctccgcccccacccagcctttgatgggcccccttctcatcaatccatcacccctgcacatgccaccaggactgcctggaccagagcccgggactctctgaaacccactgagagctcggccctgggaatgggcctcccaatctcggtctccagggggtgggccccaggtccctagtcttcctcagggtcttctccactgttctgcctcctctcctgatacccagttcctagccggggtgaccccagcctcccgtaacagcctccttgtggtggtgctgggaagaaggggcccgtgtacccggcagggccccccaggcaatgggcatgagcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttaatgttagccttctcagtaacacagccagtgtgccccatgggcatctgagggtaggctccacacaccagatgtccacaccttagtgctcagcacaaggccagacacaatgtctgatgaccgctataccgtgctgagggaaagggataagggactagcagaggccactcaggtttttcttgggaggagcatgaggcagaggagggactagcagcagggaaatcctacctgcctgaccaatagcaggcaacagctccatgaggatgctctcctcagaagaaaggtgtatcctgacccaggtccttaccagatgtgaagcagcaaaagcgggagaagtgtgtgtgcatcctcattcctggaacttagaaaacctgccactaaccacgcagggtgctgaggggctacagcccctgcctgccaactcaccctgtgctcagagaggtccctgagggccagggcttccagctggggtttcgccttctgtgcttccttgcacccaatgagcctcaggaggccatctgctgtcttagagaaactggggcctcaggaaaggaccccaaacctcacaagtatatggtacggcagtacacctcctgatgcctccagaagtctgtggccagggaacagacaagatttggccccgccctgcccagtaacaaggtccctcacacccctcctcccatgcctggcaggaaggtgactcaggcagtgcgtctgggtagcctggggctgcgcttcccccaacgcaacatctaggttcttaggaaacttcatttgttgtgaaaatcggaaatgaaaagacagttggtgacaaactcctttctccatcacctccttattggacagaaacgacccaggaatgcgcctcgcgtgagtcctattctttcttggggtgcacacccgctgctggaagtatgaacagcaggtttgagggggaggggagcgctgacccgggcactgcgcagggagtctcaaggggggctgacgcagagggagggtcaggcactcccgggtcaacggtctcggcctggcacccacctcggtcacgacggtggacaggtagacgtcctggctgaactcccagccatccaggcagctctcctgctccagctgccccaggtccacgtcgcgccccggctccagcccgagcgccgagaagttggcgatggtggcgagccggtagcggctgcagctgtggggcacctcgcggccgtcccgcagccgcagcgggacactgttgttgcgccaggcgctgctcaggttcgcggcgtccggcactcgacagcggtgctccggggtccccgccaggaacacgactgacataccattgaagccattggggatgatgctggcgctgagcaggaagaagatgaggcgctggaagggcccccactcgcccaggaaggcgatcacctcgtcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtgttcatgttcccagggtaccatagcagctctacagatgatgcttctttcttcccctgagaaaaggatgcctaggatggacattaactcagcccaagtatatataactgtggtcctagaaattggttaattcgatctgctattccactggagttgtctaatagtgtggcttgaactctgtttttaggttttggacctccgagctggttaaaggagcatttacaaagtgaatacctcctcctcgtagggacacctctcttcaggggaagagaggtggagctaattctcccgaggtagaggggaaggggaagttctgaatatcccttttacattgctctatctcacactgaagtcctttcagggaagagtacttagggtgatagtgagcaggctgttgggacaattcccaagaggcagggttataaagagggggaacaatgtgggtaggagaagggtctgggacaactgcctctgcttgagggggaaggaggttagggatattggacgggggaaggtggtggaggaagttccatgtgttggtgagctgtctaggaacagggaccttatctttctcagaggagttaatttctgacttgcttttcaggattgattcctgagtccaaatgaaacaacaatattttatcatttgctgctttttcttgtatttagtcctttcactctcttttcaatattttagcataagccctaggggactatcaggaggaatgttattgttgctagctttatcctttttctcccctgcattacttgaggtatttcccatcttgaaaagggattggggtgaggctcaatttcccctactagaaatttcttcccagttacgagaggtttgtataaggctcaacctctcctactggagatttctcacctttcctttccttcccttcccttcccttcccttaccttaccttaccttacctttcccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatgccctaataaaagagtttcagcacagatctctaaagttctggagcaaggccatgcagcagagagatattcgacttttgaaaagcagctgtttggccccaataaaaaccaagagcctagcaatgggacatcaagggtctatgcaaccagagatacccattgtaagccaggtattgtcagagtctaccaagtcgtaagattaggcaggtttaagccaggcatggtggctcacacctgtaatcccggcactttgggaggaagctgagggcagagaattacttgagcccaggaggcaacatggcaaaaccccatctctaaaaaataaagaaaaaaaaattagctgggtgtggtggtgtttgcctgtagtcccagcaacctgggaggctgaagtagaaggattgcttgagcctagggaggttgaggctgcagtgagctgtgattgtgccactgcactccagcctgggtgacagactgagaatctctctcaaaaaaaaaaaaagcagacttatcagcaatccatcatataataatagaacaggaatggtaaattcaggatcaggactaagcaggtcaatagggtgcatgtaagtcaacaaaaggtggctcagactcctatgacacctacctcagctatcggctataccaacccttctgtcttagctcagacctacagccttagtaggtagttctctgtaaccaactgatggaggggaaaatagcccttactcacagatggattagctttagacattgatactagttaaaaaagaaaaaaaaaaaaaagagattgttcctgtaacatagctccatttagggggtagccctaaacaactttgaagggaaattcccccagtgggctaagctgtaagcagtatacttgttcattcattttgtatggaggacaaaacaattccagatagagatttacatacacttgtgagcaatggcaaatagtcgagtggtacctgttcagccctcacttatgtgcaatctggaagtgcaagcagttgaccaatggagacagaactaggaaacaaatacctcctcattctatatggctctttagaagcccccagtgggattaaacctcagtaacccacagcaatggggattgagacaaggctgaggtgaggaaaaagagcaaggcacttgtctctggtgcaaatttaaggaggcaccaagaaattcagtaaccaagattaattatattttaatgcaatattttttaaaatagaaattaatgcaaatacccatgatgaacgcaatatcaaaattttcaataaagacaggctcagtattgctaattttccatttattcttaggctccactagggctccacacaacactgttactgatcttggtcatcgccaataaccatctcaatttcacagtctatgttggctttacctccctctctgttcactctcctccctagtccctcacttctgttttatggtatcattactcagaataaacgaccttatatacgttcttgtctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncatatatccagaattagtattgctggatcatatggtgattctatttttaatttttttagggaccaccacattattttccatagtggctgcaccattttacactcccactaggaatgaacaagggtttcaatttctctacatcctcactaacacttgttattttctgtgtttaaaaacaacaacaacacttttttagaggtggggtcttgccctgtcacccaggctggagtgcagagatatggtcatagctcactgcaacctcaaactcttgggctcaagtgatcctcctgccccagcctcctgagaagctggaactacagtcacatgccctcatgcctggctaattttttatttattttttgtagagatggggtcttactatgttgcccagtgctgtcttgaactcctgccccctagcaatcctcctgcctcggcctcccaaagtggatttctgggtgttttttttttctttttgtagtagctatttttaagggtacaaagtggtacctccttatgattttcatttgcatttccctagtgattagtgatgttgagcctcttttcatcgcttgtacccccaatttatagacaaggaaactgaggctttcatcagtgatgtaacctgcctggagtcagccaggtggttggcagtggagtcaaaactggccctctactgagtctgactccagaactctgtgtgctgccgcccctctgggggagagccatccatccatcctgcttaccctggtacttgcttccttccctcctcctcccaaccaccagagcccagttttttgttgttgttgttgtttgtttgtttgttttgagacacagtctggctctgtcacccaggctggagtgctgtggtgtgatctcagctcactgcaacctccgcctcccaggttgaagtgattctcctgccttagcctcccgagtagctgggactacaggggtgcaccaccactcccagctaatttttgtatttttagtagagacggggtttcaccatgttggccaggctggtctcaaactcctgacctcaagtaatctgcccgcctcagcctctcaaagtactgggattacaggcgtgagccactgtgcccagcccctagttgctttttattttacttccaccactcaaaaaggaagccaggaagggaaaagctgccaaaaaaagcaaatcctggtgcatgtgtgtgaatgtgtgatgatgtacatccttagaggtccctgtgaacagcgtacaacatgagtagctatggacttggaggccagcagctactcacccctcacgccctacagtgaacaaaaccagcgagcaatggaaaagcagacaggtcagcccagctgccagggaaggctgccactcatgggtccagcctccataacaggcactgataacactnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntccaaagggtaagctaagataataattcctgtaactgtggtgttgttaatagcaaatgttttttaatgccttgtgtgtgccaagttctctgcggggtgctggagagacacaaataaataagacagacacagcctctgcccttatggatgatacctggacccatccctgagtactcaatacgtacttatgcagagaagaagaatgcatgaaataagcagtctgattattcccagcagcacagacacctgatgggtgtgcagtaaatacgtgaaggccactagggcaggggtgatgtgtgacctggccaccacacatccccaccctgaagagggcttccagaccctgtgactgccttatgacttggtattccagcatgatagggtctcagcaatacagcaatctccaaggaccaaggccattacaggggaaaaggaaatctgagggcttccttaaagaactttcgggagagctggagaagccatagaatctgcagcttgtctgacctgctgcctagaactcagggtaccttatgagtgggtttacagcatggcccctaagaagggccacccccaaactccaggtacagaacctgacctggcatctcccctgtgggaaggcacagtcagaagtaagcctctgatgttctcttaagtcagggatgtcaacatgagctcatgtgagggaatgactggcctggacccggatcctgcatcattccaatctgtccagatgctgcccaatgaaatggggaagtttatggaccagattctaaaaaattcatccagagtccccaccccacctccacctccaaacttgtgatagaagcctttggagatggattacactgcccagagactcaggggccaggaaggtcatattcaggaggaccacttcacattcccccggacagaagtaaacgggtaatgaaggaatttcaggatggaggcaaggagtgtaggcagtctttgggatgtgaaatcgggggaaacaagcaatgtatgaagaggagtttcaggaattcactttgggatacattgggtggaagcttccacagacccttgaggatcccttccccccagaaaaggtctgcactgtttacattcactaggactcttggagcccagctgacaggcctctgaccacaagccatgctgtacaccaaaccctcaggacagccagtgataagtgatggctgccccttactctctaccccatttagtagggtctaagtcctggggagcttctggcctacagacctcagagagacaatgcagtgaccagctctcctgctggcccttccacctttcttcacttgggatccaagtctgcaaggggctgagcagaaacctcctccaccacaaagtgatggagaacagcccaatggctggtgctctaatggattcagacaccgcacccccccacacacacacaccccaaatacactcccatataaacaccgctaccacacaccacttgtttctctcccagctgaacagatagcagcatcttgcctcctacagaggcacccacattctactctgaagggcccctcccttccttggactgccctaggtttgtgcttctcaagcagttctcctctttgcgggttgtcagagacccagtggacacatttcatcccaccacctgtgaggagcccaagagcagggtccttatcacagcttgactaaaaggacacataaggttaaggatttgggctaaatgagagacctccacagagtctggaaaagtaaaaggtgtctccctgatgtagccagatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaacaatcttctagaagagatcacataacactgttacaaaggatctggagaaagggaccctggcttcatcactgtggctctccagtcatgctttacatttggcagtgactatctccattcaactcaattccctaaccctaaactagctgacatttatcaaatactgccctttaccaggtctaagtaagtttaactccccccacccccaccaaaaaaaaatcaagatactaagggatatactattcacaaaagggaaacctgtctcctcttcatatacctgttcctttcaaggaagggtataaaaatggggatgagggaggataaccactaggaatttgaccctatattataaattggtcagataaatgaaaataattcctctggactcaaagtgatatggctctgaaaacgggagaaacatcggggtcctttgtctcacgccagttaaacgacatggacacacaggagtggttttaaggaacagaaagtttaataggcaagaaagaagaaaggctccctgcggtacagaaaaaggggggtctgaacagagaaaaagccccgtgtgtggcagaacagtactcggttatattgggaggctggaggaggtggtgtctgatttgcacagggcccagggcattggtttgaccaggcaggtcattcatgtagcccgagaaaaacgtggccctcccaccctagccttttaatatgcaaatgtaggtcaccatgttgtcctgcacacatggggtcatctggaggtgtcaccttgaggtggtgactagaagaagagggtgggaatctccatgttgaatggacacagtttctaagcgctggcatttgcatatcaaagcttggcagcctgtagtcccagctactcaggaggctgaggcaggagattcacttgaacctgggaggcagaggctgcagtgagctgagatcacaccactgcactccagcctgggtgacagagcgagattccgtctccaaaaaaaagataaaaagaaaagaaaaagaaatgtttctggagttgtttctattaaaagggaaagccttactgaggcctccttaccctctctatctgcctagtataatttctgaataactcctctattaaaagtaccactgaggtgcttaatatgacatttctgatatttcccaatgctcctccacaaattcaatttggaaaggtaatctgttccaggagggcaaaccaaagaaaaagtcctaggctcctgagtcaaggcttgtttctttcctttgtacaagctgactactttttaatcatagtaaaaatgagaaaaatgcaagatgaagttaacagcattgctttatttcccatgaaaagctgttataaagcattctcaaaataaactgttattcagccacaaatgacaccatcacttttttattcatagggcacagtatcgctgccaaagagctttcctctatatgctctcttgcagggcaaaaaatattatctatgttatacagaaacacagtaaaaaaagtgatttacttaaggtcctaactactaaataaaagctaaactactcacttcctcctagattcagagagagctccaacattttctaaaatttggtatcttgttgttgaggtaggcactttttggcaataatgaatagacatttaattagccaatcaaaaaaacttattaggtacagtaagttcctcttcaaaggtttaacctgttcaacttcctcgttctttgttcctaagaacaatttccctgtaccttctcacccctatttacctgcttagttatctgctcagttacctgccttgtaaacaactcttcccgtcagtcccaacctgtaactcacattccctctcccttccttattagggagaatattcgcgatagcaaatcaagtctgcttagattgtgtagtccgactccagcccatgtggaaatgacagagaggtagggactgcgttagggatataaactcctgctctatcctgctcggtgtgctcttgcattcgtgactaacgcaaacagcagtcttttgcagaagtaagttgtcttgctgagaaaactttttttcctgagtgctggttcttccttgcagcactgatcatttgtttcttttttctttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngttgtaaggactatttgagaaaaacagggcatgtaaagcccccacaggaggctgggcataaggtggtgctcactacagggactggagggagctgttaccaacacccattagggtagggcctggcacaccctggatgcttggccaaggccagccatcattatagcttgtggggaaggagccccggatgatgttcttgggactcctggaggcttcatgggctgagattgcaagcccccagccctgccgggccgatagcctcctccctgtctgtgtgaggctgtccctccctaccaggtcccgcgtaggggaggtcctggaagcaagggaggggctggatcttgagccccactggtgaagacactcccacatatcttcagtccctgtagacctgccccagaggtacctgctaggcaagctgtggcctgtgcctccccagcgctgtaaatctccccagatcccacccaaacccaacctcagccatcctggctccttgggcctgagctgctgccgcgtgactttgggggacaaaggaggctcttcctggcaaaccttctcccagactgcctgcctggggcctgcatccccagtcagctccaaacaaggctgttgctgctgctgctgccgcagccgcagctgtgacgtgtggaggcctttcctcggagggcaggcagccgcgtgggcaacagatgtctcagctccctgccgcctgcagccgtcagccgccgccactgagcctgtcagcggcctcacgcccagggtgcctggccagcccgcttagtgtccccaccagccccctcagcggacacacagcatgacacacacaagcagacacaggcttgcgtacacacacacacacacacacacacacagcaggaatcctataggaaagaggagatgaaaggctctgggatgtgttgaaggcccacctcactcggccccagggacctggcagtgagggcagatgtgggaagcctcctaggacagctgggcctgcctgtcaccctggcccccagaaacgggattccatgattccacgctccacctggtgcccaccccctcccaagaactggacagaagtctcttaaagcccagccggcttggcccagcccccatggcaagaggtggcagtagggtgggggaaggtgcttctctgtgcctctgacacaggcccccaaagacaagatcagcctgtgtgggagcaagggatggccgtcagatggtttcaggttatctcctctgctccttccagactgagagccgccaagggcagggcctgggttctctcctcttctgtcccttaggctggggacccccaagggcagggtctgagtcctctcttttggccctccagacacgaggatgtcgaggctgggccaggatcctgtctcccctagacaggcaccccctcgaacagggcctgagtcacctcctccactcctctatcctcagactagccacgctccagggctgtgccggctccttttccttctctgtgggcaaggcagggccctgggaaacttgaggaacgggcctgaggctgtcctggcccccggctttgtgtcatcttgtggggaggggtctcacaacctcacagttaagtctccctttccccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctgtctcctgttcaggagactcaacatctgattgttttccacctcagcctggagctgtcttcccacactctctagctccttccttaggtggttggtctcatcttgtagctgctctaccttagatggccctgctgggggctctggggccaggggttcagctgagaaagcaagcagagaataagggcctctggattctcaaaaaaaaaaaaaaaatcctccctttggtgcacagctcctcctctcaggcttcccaaacttggcctcactgctaatgactcctcacacccggatggtagacaatcttccaagtcactttcagatagagagcactgtgggtggctgacaatgggcactcctccctctttactgatggggacactgaggctcatggagatgacaagacttgtcctcccctggcacagacctctttccctctgcctcaaagcccttccatccacccacctccctggggcattctaagtcacccccacagccctctaatgccagtccagctgccaggtcatgccagccccatcttacccgtctggtttttgagtttgaacaagctcctcccaagcttctgtaccagatgtatctcatgcttcttctcctccttagatgtgcgaacctgcccaaagcaaagggggaaaagggccctggagggaggggctggtgaacgtccagagacagagtttgagaaaggcccaccccccttctgccagtttgtgatttagaaacgtgcattcattcaacaaacatttactgagcatgtacaggccaggtacagttcttcatagcagagatataaaacagcaaaggacagacaggagcccttggccctgaggtttccattctaggggcctttaaatctctgactttcagagctaaccaagacctttgatactctctacctcctccagaaacacgagcataaagaggagagatggcttgtccagactcaaaaagcaaattagggactgaggcagggcagaaatatggacccctgacaaccagtcaggctagtgcttcccagagaggtgacaaccccagggcatgtgtggcaaggactagagcaggggtgtctggagaagagagagtcagcaaagagggcagtgcagaagacccatgctgcatgttctgtgctctggggtccctccaggtgagacctgggtgcccagctccccatttgcccttggcatcaggggcccctagctcctttcttcagggccccaagaggaaactggagtccaggattgaccagctgtaatcaggggaccccactggactcttaccagtgaattgatgttttcagtgagttgactgattattgcggagcttgaatccagggccactgctagttcttggtactggctctgaggtgcatgcagagagaaggagttggaggaagattgtggcgaggggtagagagaataatcattagggctggtgggggtgtgtgggctgcctcagctggcagaggggcaacaagcccctgctgtgggaggaggttggagggctggcctgcagggtcactgcacctcggcccagggcctcttacctccagatcctgcagggtagtagaggatgcacggccctccccgtagatacctgttgctgactgcaagagatgagagtgcacatggagatgttctgtcccccctcactgtctaagccctctgacttcctttcttcccccatcaactggcaaaagcttcttttctgcctatcttggacccttttccccataactcctttgtgccaacttctctcgtggttcttatctccccaccatcccaccctggggccctttcagtgactcctaaagggacagcctgatggcaagtggctcttctcattggcctggcttccccttgagactggggatgaggaaaatcaaacagcaacgaccatttcctcagtgtcctgggtgtttgcagcaggccatgtactaaggattcacataaaagcaacaataacgaatctcatttaaacttcacaaatggaagtcaaaaaataccacctctattatacagatgtgaaaagagaggcccaaagacctcaagcaacttgccctaaatcatatgctaatcaatccctaatcaattcttagcagacggagaggcaggattcaaatccagaattcttaaccagtacccaacagtccatctacaatcttaacaattaccctctactgccccttgggccccctgtccccaggagcctggcccgccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggggttttcacaatacatcgcatgacacaccatcttccaaatctctaaacatttctctccacagcccagtcctctccatagttgtccaaatccctccctcttttctcttgttgtctccaaaactcaaaaccatgctctgactttctatatcccgccctccccttcttggaccatctgggaagccccctgcttccccagggtgtcccctcctccccttctgggatcagtcatctttcctcaaatggaccagttcggcctctcttagtttctccaactctgcatctcaacctttctcccttcactacacaataatgtccaggaggcaaagagcccacaaacctgggaacctccctttccagaagggaggttctggaatgactacaaatatttggttatgattttcttccctgccacgcctgttttcatgggcagtgctgagccccggtcctggcagagctcagaaccaggctctcatgagctggggcaagtggggcctagggaacctctgggttgaggaccttgcaccccactctgcagctgccctgctgatttggctcatgcaacctctcctcctgggctcaagcgatccttctacatcggtctcccaagtagctgggatttgggctaccacgtttggctaatttttgtatcttttagtacagatggggtttcacctgtagcccaggctggtctcgaatcctgggctctagtgatctaccctcctcagcctcccaaagtgctgggattacaggtgtgagccactgcgcccggccttgtgccagcttttaaatatcaacaaggacaaattagagaacagtggaagagggtgagcagcatgatgaggtgatacagaaataatttcacatgaagaactgggcatgcctggcttttttttttttttaagctattctgggttggatgctgaggctcacacctgtaagcctgtaatcccagcactttgggaggccgaggtgggtggatcacctgaagtcaggagtttgagaccagcctggccaacatggtgaaaccctgtctctactaaaaatacaaaaaattagctggaattggtggcatgtgcctgtaattccagctactcgggcagctgaggcaggagaatcgcttgaacctgggaggcggaggttgcagtgagctgatatcgtgccattgcactccagcctgggcaacaagagtgaaactctgcctcaaaaaaaaaaaaaaaaaagaaagaaagaaaagaaaatatatctatgcaccagagctcaacactaggttaggagcatttctgagatttggagctattcaaccatggaagttcctggcacatacatcaggtattcacaataccctttctcaggtgtttggtcactgctagtgagcctgcctggatcagtgtttcccaaatggcagtcatttgcatctttgcattttttttggggggggggttgtgggggtatataccataccagattttttaaaaattgacattaaaaatacatgtataaaatgtgtaaagtgcactaatctaaagtgcactggatgtattttttattgatgtacatacttttgttatccatcacccaggtcaaaatacagaatcagcaccacagagggttccctcctcctccttcccagccaataatcttctcctcctacctaaccaactgttcttacttcaagcactgtcaactagtattttacattcttgaactgcatataaagtgtctcaagtttcacttaacacttttcttgaaatacacttgttttttgccactttttatttgacctaagaagtaacattaatgaaacaatgatttgacgtgataggcatttccctcctaatgagcactaaaacacttaactatttgaaaaaagaagtttctccgtgtaccagctaatatattctcctcggccgccgttggtacacggaccacattttgtttctcaaagcaatccgatgatttctgaggtcctttgcagcttgaagacggaacgactgtggtgatcgagtagccaaaagttcacggaatgcactgtcacaattgtgattccgccatagcgccgtgcatccatccaacacttgtttaatacctatatttaatacctaataccttagagtgtcctaggctgtggacacacaagactaaaccccacttcctgagttgaagtgggggaaatagaggagtaaatcatttcacgatgtgtggttaaatgctacagctcaggtaaccacgagcacacagagaaagggcagtttctagaaacagggcggagaggagaccgtgagtgggcatttcccagagcagtctctgccagccaccctgctgtgatcactttgccacagagcagccccggcggtcaacctcagcctcccttagcaacctgagcgccccgcccaggtgccttactattggtctcgtggagcgggatgggcagctctgccgtgcaatcccagctcgcagcccttgctccgcgtgtactcacgggaggactcgcagacgttactgccttcttgcgtgccccggccacccccgggcggcttgtagccggtgcgcggggtggctggggctacgtgcagagctgtcgcggagccggaacagcagcggtgaagcccctcggctcggccgagaccgccgtgcccattgctcgcctcggttgccgccgctttagccgcagccgctgctgccgccgccgggggagaggcagcctattgtctttctccgcggcgaaggtgaggagctgtctcggctcggcccgcgggggagccccgggagccgcacggtgagagcgcaacttagttggcggagttgggggaagttttgtgatttgaggaggggtcgggatgcggagcgcggcccgtcccctgcggccgctcggtggggcgggccccagaggagggtcgggggctgcgcggggcttcaggggcgggcggcacggatgggtagccgggcggcgcggggacctcagctttgcggacccctcctccctgcgcatcacccttctcccgcattgtctgcttggggctcggcgcgcctcccactccgcagcccaacttgggggccgtcgccgctttccggatggggggcgcgcccggcggcggatggccccgaacccttgccccgggtccccgggttggcgccgctggggcggactcactcctcccctggggcgggcggccgcggtgtggagtccgcgccgcgaacaagtgctgcgggcgcgagggagcggttccccggggccgacgcggacggtaaacctgtccggcggcgcccgcctgctggggcctctccgctgtttctcgcgggcgcggcccggctgaaactgcgaccgtcggaggcgagcggccctctgggacccgtgcagccggtccaccttgcagctatactttgagactaaacattttttttttttttttttgcaaaggcaaaccggtatgtgaagttgaaaaaagcaaaaaccctcaaattttccttctttcttcttttttttttttttaaatcaagaaagggggtagataggtttgttttgttttggaaatagtttttatagcagagtgataccgtcacatttaatgatcctactgtgaattcaagaattcacgatgaaagttggattgagcggtattttggtgttcattctttgctgatactcattaatgaagttagttggagaatttattgcttcagtacagtaaaaaccagtgtgcctttttttttgttactactcccccctccccgcattgttttatttttcgaagaagcactttattcagtttttctaagccacgggattgcccagatgaggaccaacggtgcagttcttgaaaggtcattattggcaagtttgtgagggagctaagatgagttgagataaaccagtgttactgttcttgtattctgtcgtggactcttggggatttgcaggctgcattaagtacaagtctggtccagttttgggtgcacgtattccactgaatttggttcgtctggcttattatatgaacatgattctgtttcacttccccagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatacttcaaaaggactcaaagccatatactagttcccaataggcctgcacaagttattagaacaagctgctttgcattcttgtgtgatcagaaccagtaactagatggcaatcaggtctgttactgaagatggaaaaactatacttaagtttgtataacaatctttcataacatggcttcacagaaaagaagtataaaaaggattccttggttgaaaaagagtgctcttttcccttcattatttaagattagggcaaatttataaaacaggaaaaaaatagcacaaatcccttggcaaacagagtaaaacatctactctgttttgctttttttcacttcttacactctctttcataggaagtcaatttacagacttccatcaagcccttagagacctttttgtactatccatgacaagctcttgatgttatctctgcacttttgacaaattcttagcagttaacttacaaggcagttaagatttttgttcaagcacaatatagctagaataggctcatacattcaataaaacaaatatttaccaagcatttattgagtggaagataaaaagcacaaagcataattatgaaatattttcccctgccaccataaaaaaattaaacaggcttacagaatacagtgtaagaaaacatgaccaaagcaaaaatagtaaggactaaagaagggaggaaggggaaatatcaacatggactgaatatgacccaaaagagccttgatggatggtcagacatgtaaaggcaaattggttagggttaaggggtggaggtcagggcacgttctatagggaaacggcagctgatacagaagcctgaaaggaaaagcgggcagggcacctggacaggactcttcaggaacgagcacgcacgtgcgtgaaaaacaacttagtgaggtaccgtccacccaaacattagagaaaccgcgtaaaaatgcttcttggtaagcatgaagaaggcagggctcggcctgtagaagaactcaataaacatttgaactgtctaaagagtaaaagttaatgaataggccaaactcactcctttctttgttttaagagctacaactttagagaataacaaatcacaaacccagtagacaggtcctggcatttgaaatccaaccccatttttcccttaatctttcccctctgagcaaatggtatcgacatgaacaagccatgttgatttgatcaagacactcatccatggttaaaagagtctttactttcaagagatacaaacagaaatatttacatgggctaatttactgggcaacaagagagaaactccgtctcaaaaaaaaaaaaggaaataaaagcatacaaagtgaaaacaaagaaattaaactgcccttatttgccagtgacattactgtctatgcacaaaattccaaaaatctacaaaaaagcttctagtactaaaaatgagtttagcaaggttgtagaatccaaggtcagcatataacataaaatcaccttcctatatactagcaatcaccaactggaaattgagaagtatcattcacaacagtaccacaaacatgaaataaatgtgtaagattacaaaatacaagcaagatccaactgctaaaaactacaaaacactgacgaaaaatctaagaaggtctaaataaatagatataccatgttcatggctcattattaaaatgtcagttgcctcctaactgatttccagtttcaatgcaatgtcaatcaaaaaccccagcaggctctcacgcctgtaagccctacactttgggagaccatggtgggaggattgcttcatcccgggagtttgagaccaggctgggcaacatagagagaccctgtctctacaaaaataaaaaaattagccaggcatggcggtgcatgcatgtgatcccagctacttgggaggctgaggtgggataatcgcttggttcaaggctgcagtgagcagtgatcctgccactgcgtttcagcctgggcaactgagtgggacactttttttttttttttttttttttgagacaaggtctcgctctgtcgaccaggctggagtgaagtggtgcaatctcggctcactgcaacctccatctcctgggttcaagtgattctcctgcctcagcctcccaagtagctgggattacaggtgcccgccaccatgcccagctaatttttctgtttttagtagaaacggggtttcaccatgttggccaggctggtcttgaactcctgaactcaagtgatccacccgcctcggcctcccaaagtgctgggattacaggcatgagccaccgcaccaggccatgaaacactttcttccacccacggctttctcttctctccccatttacagcaataagacagcctaacctgggaaagagagagagagggaagctacttccaaatggatgcctgtccccatcagtaataaccaagtctattcaagtgctagatgttaactttaaaagaaggaaacatcaaaagtccaagtttcagccgggtgcagtggctcatgcctgtaatcccagcactttaggaggctgaggtgggtggatcacgaggtcaggagttcaagaccagcctggtcaatatggtgaaaccccgtctctactaaaaataaaaaattagtcaggcatggtggcgtgtgcctgtagtcccagctactcgggagaggcagaagattcgcttcaaccggggaagcagaggttgcagtgagccaagatcgtgctactgcactccagcctgggtgacagagcgagactccgtctcaaaaaaaaaaaaaagtccaagtgtcttcgcctagctttgtcaggaatgtttttaccctcagtctgtaagtgtgaccaaatatattttttaaaggtttaccctcaatctgttaagttcaaaggtttactataatctcttcataagaaaactattggaaagatggaataaaatacacagaaatgtccttaacaggtaaatatttatttttctttcttattattatactttaagttctggggtatatgtgcagaacgtgcaggtttgttgcataggtacacacgtgccatggtggtttgctgcacccatcaactcgtcatctacactaggtatttctcctaatgctatccctcccctagccccccaacccccaacaggccccagtgtgtgatgttcccccctccctgtgtccgtgtgttctcactgttcaactcccactacaggtaaatatttctagaatgtatctactccatcagctagtgtaagtattctaaactgtgctagtatagctgctttaaatcactgctttcttctgcaaatggtggcacctttaaagtgttatcttgaaggggaagtgagtgatttgctcatgtctctactgaactaacactgttaacacccagtccagttctaccttaaacaagtcggagaaatacagacataatccatacttgttatttgtcaagactaaggtaaaataaggaaagttggaactcactcatatcctcttatgactgatgtactgaaaacaatccatctctcaccatttcctaaatagcatagtcacaaagagctctaccctaccaagtactctgcaagtcccactctcaaaggaagactcacaggtgactgagaagataaatttgctattgtttccattatccttcagttcatctgacacctttgaagaaatgcatttggataagactcacaagtctcagggccccttctttatgaaagaaatagctaagcctccatactcagaagcatcagacttttcagaatgcttaagtcatgtaaaaacgtatcaaaattattatcattacagctaccaggaaatagctacctactccatgttagatactgcagttaagtatctcacacagtttcactgattcctaacaacactgcaaagcatgttactaacccttaaggagtaggaagctgaagctctgagaggctatgcaactactcaatggaaatgtggggatctgaactctacctagctccaaagggcgtacttttttctaaaatttctaatttttttccaatttcacaatggaggcagagttttcactacaattttaataatttcaccagctgggtggggtggctcacgcctgtaattccagtactgtgggaggctgaggtgggaagacggcttgggtcccggggagacaactgggcaacagtgaagattctgactctaaaaaaaataagaatttcaccaaaaggggggacagatttctaaatcggaatctcttgttaaaatccttagagcactagttaagccccacttcttttcaaaaaataaccgacagattaaaaaaaaggttagaaatccttttaaagtaaatttcatcagagatctgcaagtgaattgtcattttggacaagtccccagagttggtggccctctcctgtgtacaccagctaccactaggcagtaaaagtaatttacccaattcaaacacataccgggcctgcactatgttaaaaccactggcaaagagggtacaaagttaaataaggtctatcacagccctcaaggagttaaaggactagaggaggagtccatttatagtatagtatgtgtgcagttaccatttagtcaaggcaaacgaactgtgagaaatcctacaacaatagtacctacagtataacatgccatcaccgcccacagaaggaaagcaactggtgccctcgtcacgttatgttgttagtacttgcttacatgatgtccctccctgacaatcccttccaacctctgtcagcctccttccccacaatcacacacacacacaaaaccacactgccaggaagggaagccattgagtgagtattgtgaatcctacaagtggctctgtagtttaaaagggcaatgcctgtgcctgaagaaaatttgtctttagcttcatcaggtgaagaaaattggttttataacacaaggcccaccaaaccagaaaagcccaggaacgcttctccacaggactcacttagcacgagaaatcactcagagcaaactgacgcacacagtatttgtcaaatttttctttttcatttagcagaaggtaaggtaaaggactacaactgaagttaataaatgacactctagccattttgatcatttgtcactataaatgatagacatttaagctagttccatctggggaagtgaaacagaatcatgttcatataataagccagacgaaccaaattcagtggaatacgtgcacccaaaactggaccagacttgtacttaatgcagcctgcaaatccccaagagtccacgacagaatacaagaacagtaacactggtttatctcaactcatcttagctccctcacaaacttgccaataatgacctttcaagaactgcaccgttggtcctcatctgggcaatcccgtggcttagaaaaactgaataaagtgcttcttcgaaaaataaaacaatgcggggaggggggagtagtaacaaaaaaaaaggcacactggtttttactgtactgaagcaataaattctccaacgaacttcattaatgagtatcagcaaagaatgaacaccaaaataccgctcaatccaactttcatcgtgaattcttgaattcacagtaggatcattaaatgtgacggtatcactctgctataaaaactatttctaaaacaaaacaaacctatctaccccctttcttgatttaaaaaaaaaaaaaaaaaaagaaggaaaatttgagggtttttgattttttcaacttcacataccggtttgcctttgcaaaaaaaaaaaaaaaaaatgtttagtctcaaagtatagctgcaaggtggaccggctgcacgggtcccagagggccgctcgcctccgacggtcgcagtttcagccgggccgcgcccgcgagaaacagcggagaggccccagcaggcgggcgccgccggacaggtttaccgtccgcgtcggccccggggaaccgctccctcgcgcccgcagcacttgttcgcggcgcggactccacaccgcggccgcccgccccaggggaggagtgagtccgccccagcggcgccaacccggggacccggggcaagggttcggggccatccgccgccgggcgcgccccccatccggaaagcggcgacggcccccaagttgggctgcggagtgggaggcgcgccgagccccaagcagacaatgcgggagaagggtgatgcgcagggaggaggggtccgcaaagctgaggtccccgcgccgcccggctacccatccgtgccgcccgcccctgaagccccgcgcagcccccgaccctcctctggggcccgccccaccgagcggccgcaggggacgggccgcgctccgcatcccgacccctcctcaaatcacaaaacttcccccaactccgccaactaagttgcgctctcaccgtgcggctcccggggctcccccgcgggccgagccgagacagctcctcaccttcgccgcggagaaagacaataggctgcctctcccccggcggcggcagcagcggctgcggctaaagcggcggcaaccgaggcgagcaatgggcacggcggtctcggccgagccgaggggcttcaccgctgctgttccggctccgcgacagctctgcacgtagccccagccaccccgcgcaccggctacaagccgcccgggggtggccggggcacgcaagaaggcagtaacgtctgcgagtcctcccgtgagtacacgcggagcaagggctgcgagctgggattgcacggcagagctgcccatcccgctccacgagaccaatagtaaggcacctgggcggggcgctcaggttgctaagggaggctgaggttgaccgccggggctgctctgtggcaaaggatcacagaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaatatgttcataaagttaaatgaaataggatataaaattgggcctagtgtttaaaaggtaaatatatttacatgaaggagaaaacaactcacctcccactcttagagcctctgccagtttatcatagcctagtttcttgagagaataagctacatgtcttcaccttttttcactgagctcattatactctggattctgccttcatcgttgcactaaaatttatctcctagttgtcaaatccagtggctcccctcttagtccccaaattgtcccctctgcagtattttgatactgttgattgttcctttgttgaaacattcctccattcttaatgtccaccaataaagagttggttaaataaaaattatagtgtaccgttttataatattctgttgttctgttgtggaccaaaaaatgcagccagtctttccataagagcacgtgcaaacttctaagatatattaagtaaaaaagtaaggcataaaatattgtgtataatctgacccctttagtacacagtgtaaaaacatctgtgtctgtgcttctttatacttacttttttctcccctggtgaatacaggaaactgtgagtagtacaacacaattaaaaaaaaaaaaactgtgtgtctgctgcaccaggacctgtgataattgggtataaaagacaaaaaagacatgtccctgtcctctgggaagggacatgataatcaaatgagacttctgtcggattcttttctcctgttttgatcttatcaccctttcttggtctcctccgatctcttcttccttgtcctacttcttctcttctcattctgtgctttctctgagtaatctttgactcccattacttaagtcatgacctgtgttccagggactcctaaatttgtattcatctccagagtttcaaacccatatatctgtctgtatatcatatatttagggaatctcacttggagtgacatgggtgttcaaaatgatgatatttaaattttcacgtatccatctcctagcactctatctagtcacatatgcctaaacctgggaactgtcttaatattcttttatatacacctgttctgacctcccccccaaactagtaaatttctaagacctgtccttctgaatgtctcttacaattttccctgtgatctcagtttcttcctcccatccctcaaatgctttgtgtgtgtgtgtgtgtgtggtgggggaagagagtaaaattgaaatttgtggaaaacgtactagcctgtctgtctgtctttcgaggtgaagtctccctcttgtccccctggctggagtgcaatggcacaatcttggcttactgcaacttccatctcctgggttcaagcaattctcctgcctcagcctcctgagtagctgggattacaggcacctgccaccatgcccagctaatttttgtgtttttagtagagatggggtttcatcatgttggccaggctggtctcgaactcctgacctcaggtgatccacccgccttggcctcccaaattgctgggattacaggtgtgagccaccatgcctggccactaccctgtcttgttgcttggtatgactccactaccctgctgcctctctccccgtacagcagcataatttaggaatcagagagactgaggaggatatatattatttaggtgcaccggcccagtcagattaacatctaaaggactgagccctgaacaaagagtcaggttaccttttaagcattttgtgtcggtcattatgccgacaaggtgtccgcactaagttcagtatcagtatggtgacctcctgggaacaggtcatcggcttgcctaaggatgggagaactggcccaggtcagaaagggagcaggtcagaattcctgcaccaatcggtagtgggactgtgcctgggcaatatagcaagatcttggttcttaaaattcaaaataaagaacagctcattcccctctggggaggggctggctcaaggttacacagtgagtgtgggggcagaggcgggcccactgtacctcccttgttgggttgtctgaggacccctctggccaccccccacaggagatggaggaggacatctggacagtgagcaggaggcgcttcggcccatgccgaacatcccaggggacctggagagccgggaggccatggtgagcctgactttccctgcccctactttgccaccttcctctgtggtccctccgaaacccccttatgttcttggtttccccgccttctgacttctgtggactttctctgcttctgggagccagtggtcagacaccatttcacctgtgaccaacaggtgcactctgtgaggcccgaaatgaaggggctatgctccatctgcctgccccagttgttatgtgtatacccctacaagaatactcacctcttgtcttcaggtggcatttttcaactccgctggagccaatgcccaggaggaacaaagggtgtgctgccagcccctggctcacccagtggcctcgtcccagaaaaagccagaggtagcggccccagccccagagagtgggggtgagtctgtgtttggggagacccaccgggccctgcagggggccatggagaagctgcaggtgagtaggtcctggcatcggccaacaaggggggcgggggggcaggacaaggcaggtgactcctgacatgtgaccccattattttggctccacagcgactttatggaaggagaaggtggacctgaaggagcgggtagagaaactagagcttcaattcatccacctctcaggacagacagacaccatagggagtgagaggctagggcaccgctggggggagctgccaggccgtctgaggggccccagcatctgagccatgtcctcctgcaggaaagtacatcagccagggggcagtgtcagagacgcagcactgggagaggaggacatcgtcaggctggcccaggaccaggaggagatgaaggtagggtgtgcaacatctcggtgggggagggtgggggtgggtgtgaacgtgcgtgctggcaccggcatggcagctaacaccccttcctccaggtgaacctgcaggagctgcggggcaggtgttgcagcttgtgggagaccacaaggaggggcatggcaaattctgaccattgcccagaaccctgctgatgagcccactctaggagccccaatagcccaggagcttgggtgtgctgacgagcagggtggtgagtagagccctcaggcggggtgggcaggcaggagcaggggaggctcacactgtgctcagattcccaccccccctccctctctctgaagatctttgtgaggtgagcctcactgatagcgtggaggctgcaccaggagaggacagggagggttctccccacgacaaccccactgcacagcagatccagcagctgcttcctgtaatgcaggactccccaggagcacccaggcatgggcagcaacccctgcatgccattctttttgggctcccaagaacagggagataaacaccaccatcatctgagagccgggaaggggaaggcgtaggtgtgggcgtggcaaggttcctggaaaagaggggctggaagggaaaggggaggaagatggagggagaagctagagcttcataggtagtgcctgggggctgtggcggtcctccccaccccacacacactggcctctctcatggcacccaggcagtccacccacagttcagaccaatgctcaactcccccggcttccctcttctgtggtcaccccatcttccaacccactggcccagggccacctcttgcttggggagccccacccaacagccaccaagcctgacagaaggaacactgcttgaaccaaaatggtgaagctgtaagggatggctggctggagtgagcgccagaggcccctctctgggcagtcagaaagcccagggtccactgaagggaccctggggaaggcagggagggcaggtagctagatgccactgcccatagacttataagtctaagaggggaacctcaactggttggcggggggctgcaggttgcataggtgaggctgggcccttcctgctgggaaaagcagaagagggagactccgcggcaggaaaggcaggtgggctcgctaggcggagctcagctgggccagcaagcactgtggtctccttggctgaatagcacaggtgacccctaggagcaacaggccaaggtccgtgagcctgctggctggcagtagtgcttcagtagtgctggccagggacccagccttcagtcacatgctagcagctgtgatggtacctgggagggagggaagggggctgtgtgtccttgcatggcctatgaagtgtgttgtgggatgaccgcgtgtataggactctcaggcttttatcctagatcaccactggattgctgacagatagaggacgtgggaccgtgactatcacccctaatctgcagtggatttggctctcggcactcccaggctgggagctggatacctgccctggcagcatgactcagactgcatgacaggtacggcgtgcccaggatgatgtgcccaggcctctggccgcctgagtccagccccccacacaaccccctccaagctcccagcccctacaccataaaccatgagctctgtgccctctctgatggttccacatctgccaccttcggcatggagcctgttgtaagagcccccaggctcagccatggagaccttgagcagtggcactgagtcctgtggctggcagggagggaagtgagacagccagcagcacaaggacagaaagaggaaagagcaaggctgcagctctagaagggaggggcaggcagcctggctctgaggctccaggtatgccccctgtgtggagctggggcagcggggcgggcagaccattcatgcagcaggcagtgaggcatgtacctaccatggctgatgctcctcaggggccactgatagtgattctgaaagacagcatcaaatcacatggcaggtcccatgcatgggtggggcaggcctgggggtggcggacacacgcacacgccagattgtgcacacacatgctgtgaggccccacggcccgcatgcacactctaacacatgcccacaaacaacacgcatacgtcgccctctccgccacctcccggtgcccaacaccctcaccagccggcacgtgccacatggatctggggcgtgcagccactcggcacactgaagcacatgcgtgggcagagtcacaacacagatgctcacccgcacacagaggcatttgcaccagctccctgcacactcgtgcctggcgtgctcagaggaccacccatcctgctcagggagacagggcttgctcactaatgtccggctgtcatttctccacctaagagccttccatggctccctactgcctacagcgttgaatcccaacaagtcatactctttggactttgaaggttctccaccctgtgccccaccctccccacagagctcttcctcattctgtctctgttccctgctttggccagtggctatcctcaatgtgacccacactacacctctgcccacactgcagctctttacccagttaccctccagttcctcacaacgtatgcctatctcagtcatgccccggactgcattgaagccaggctgccttgaagaagctctcccagactgcccttttccccaaggcagggtcatgatttgccaaaggtttcgtgtgtgtgttagcaagactggagtcagagcaggcatcaaactttacatcccatatgtcacacctcaccatagacctgggtgccaaatagcctgaagagtctgaactcacgttggcagttagcaaagtgctcctacagccgcatctgcggttaacatagcatccctatggccactgtctcccttgatccccacagccatcctaggagaaaggcagaatgtcataatttgctaaaagggatgctgaggctctgggagggaaagggacttgcctaaagccccagggtgaagcagcatctctggactcccagtccagtgatcttgcccaatactttgctgcttgcctatacccctctaacttggtcaacagcacatcacagggcaagccccaatccctgcttcatttttatatatgggcgctggtcccacagccccactctccagccatttggaaacaaaaacagatgctattgttcttccttagagaacgtggccagtggagacggcacactggaaatcagagtgaatgttcttgaaagagggtcacgggtcaacaaggcccagccaaaggatgcagtagaaccattttccttagaaatctttgggagtgaagtaggcttcagccactcccatccctgccctcgcggctaccactaccccattagtttagacagggtcgggcggggaggggtgtggagaagaaatgagcttgcctgtggcccccaggctccctctgtcctagctcaggtctgggtgccattctttacactcgtgtgctcgctcacgcacacatcacacaccttgctggtcacacagtcacagactcgcctctgctcctgtggtccagtggccggacaccccctgggatggctcaaaggagtcaggacttggaagtggggacatcagggtagctgaaggaaatccacacacccagagcatctcggagttcagactctcagacctgaagtaggcgcccccgggactgggctaggagttggacggaatggaggatggaggacagcgagaagaaaggaagagaaatgcaacgtgtgggcagccgccaagagtgaaaatagagggaagtgtcatgcaagtgctggacagaaggcggcaggtgggacgagccccacagccccctcctcaaaaacgaccacctccaggactcagtgatccctggggggcaggctctgccagccctcggccacacgtggctccggcacccatggtcccagtgccttggatggagacggccagttctggcggccagatgtggtgctctggaatccagtcccatttccttcctggccacgcctgtccagcggcctcttcagccgcattcagcccctacttacctggggaccccggctggggcacgagagcaccaggggggtagggcccaaagggatcaggggaagcctctggcctggagggtatggggcacgcttccccaagggcggacccggcaggaggaagcccaggagctgggtcctgccgcccaggagctgggccctgccacccaggccgggctagggacatggcagggcctgggcatcctgacgctggacttgggcgacctgggaggcacagggaggggagagatgggcgaccccgccccagcgcagtgccggccacaccccaaggcggttgccagagcttaagccccgcccccagcagcgagaacatcccagctccacacaccccccccccccccggcagccagtgctccttgtcaagctccccccgtcactccaggtgggagccaccccggtgagggggtgtgccacttgcccccagggcactcctctgggcatcccgggtgggggattttggggccgtggggggcagtctttggtacctgtgttcgtcagggatgctctgacaaccaggtgtcgtccacgggcgggggcatgggcatggtgacagtggtcctgttgatgtcaccgatgatgctgagcgcctccttcagcgcgtggtgcatgtgcagcatctcgtcatgctgctgtgcctgctctgccaactcctccatcagtgtgttctggttcccacatgagtacatattggccagcggctccgagatgatgaactccggggtctgagagtgggcaaacagggaagaaggtgggacctggtgcctgtgccgccctgggtgccttggtggggccttctgggactgtgcgctggacttggagccccttggagtatgggttttcacatgggcttctataccgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaccacaagctttattatcaaggagtcttgtggctcctacttgagtcttaccccataccaggaagagtttaagaacccagggtcttagtccaaatttggggcaggctgggtgcagtggcttatgcctataatcccaccactttgggagaccaaggtggaaagatcacttgagcctaggagttcaagactggcctgagccacacaatgagaccccatctctattttagaaggaaaaaaaaaacaaattaacaaatttggggcagccatctctttccacaccccagtgggaagaggactagggcttggtcagtctgctgctgtcattgctgctcattgccacaaggtgtcactgttgaacacctatgtggtgcagtctggtgctgatggctgttgagctctgcaggtagtgatgccacatccctacagagatgcaccataccaggactccaagatcatggttcttagtgttctgcctctgcagttcccatactctgccatcacctattctagcatctgggagcaccataccagagccatttcttgtgtcaatgtcatggtgacagaactatgtccttcatctctccttgagatattcctccaccacaggtcaggcagcttttttttttttttttttttcccagaacacagagcatctgcctgggctccctgtccctgaacagttagcctggcttccttcagtgacctcgagaaactttgccaaacttagggggactgatcaacggattctcagttacccattattccaggggtgaaatctagattccaagacaatatttctggtgcttctcactcaaggaaagaggaggagaatttaaaaatacaggttgggtttctagaagagcatcttgctatatgtcagttccttgtgggcaaggaccacatctgattcacaccagggtccccagagcccatccaggcctggcccagagtttcctttggtgagtgtttggaggatgaataaagagatggcaggaaggcaagaggagtggcaccagaggcccttgtcctaggttttctgctctggggccccctgtggggaacccactgtgcttttataagggaaatgatggattcaaagtgctgccccccatctcccattccccgtctctcctcaggtcaggcttgtcctgggccaggaggagctgaggctgcagaccccagcagaaattctactgagtggctccgtcccccacaccacagttctgactgtctcagaggactggcccacattgtcagtcaatgggtttctgaatgcctcctctgtagtcctgggagcccccctagaagtcccctatgggctctttgttgggagcactgggagacttggcctgccctacctgaggggaaccagccatcccctgaggggttgcctccatgcagccgctctcaatggccgcagactcctccagcctctgacccccaataagcatgagggctgtgctgaagagttttctgccaatgatgatgtggccctgggcttctctgggtcccactctctggctgccttgcctgcctggggcactcaggatgaaggaaccctggagtttacactcaccacacagagctggcaggcacccttggccttccaggcagcaggctggcatggggacttcatccatgtggacatatttgagggccacctgtggtccatggttgagaagggccagggtactgtattgctcctcaacagtgtgcctgtgactgacgcacagccccacaaggtcagcatccacatcaacattcaccagctagaaatctccatggaccagtaccccacacgaactgaggagtcctcagctacctggagccacgtgacagtctccttcttggggagctggttgcagaggcctctcatcacctccaggaacaccgctcaggcctgacaccaggggctgccaatgcctccctgctgggctggctgcatggaagacctcagtgtcaatggctagaggcaggggctgtgggaagccttgctgacgcacaacatggtggctggctgcagactggaggaggtagacaatgcctatggccattatgaagctttctccaccctggctcccaaggcttggctgtccgtggagctagctgagccatgcgtgcctgagccagggctacctcctgtctttgccaatttcatccagctgctatcagcgcagtggtggtgaccgagggtggcacagcctggcttgagtggtggcatgtgcagcccatgctggcactgatggaggctgaactgcgtaaatcccaggtgctgttcagcgtgacctgaggggcacactacagcgagctcgagctggatgtcctgggtgcccaggcatgaaaaatgttcaccctcctggacgtggtgaactgcaaggcccgcttcatccacgatggccctgaggacacctctgaccagctggtgctggaggtgtcagtgatggcttggttgcccatgccctcatgcctgcggaggggccaaacagacctcctgcccatccaggtcaaccctgtcaatgacccaccccacatcatcttcccacatggcagccttatggtgatcctggaacacacacagaagcctctggggcctgaggttctccaggcctatgacctggactctgcctgtgagggcctcaccttccagctccttggcaccccctctggcctccccgtggagcaccgagaccagcctggggagccggtgactgagttctcctgctgggagttggaggccggcagcctagtctatgtccactgtggtggccctacacaggacttgacattccgggtcagcaatggactgcaggccagccccccggccatgctgaaggtggtggctgtccagctggccatacaaatccaccgcagcacagggctgcatctggcccagggctctgccatgcccatcttgcctaccaacctgttggtggagaccagcgccgtggggcaggatgtgaccgtgctgttccgtgtcaccggaggcctgccgttcagggagctgcagaagcagggggctggtggggtggaggatgctgagtggtgggtcacacaggcgttccaccagcaggatgtggagcagggccacgtgaggtacctgagcactgacccacagcactacaccgaggacaccgtggagaacctggatctgcaggtgcaggtgagctgggaaatcctgagcaatctgtccttcctagtgaccatccagagagccactgtgtggatgctgcagctggagccactgcacactcagaacacccagcaggaggccctcaccacagcccacctggaggccaccctggaggaggcaggcccaagccccccaaccttccactgtgaggtggttcaggctcccaggaaaggcaactttcaactacagggcacgatgctgtcagacggtcagggcttcacccaggatgacgtacaggctgcagaggtgacctatggggccatggcacatgcctcagtggcagtggaggacaccttctgtttccatgtcacagctccaccatatttctccccactctgtaccttctccatccatattggcggtgacccagacatgcctgtcctcgtggtgcccgagggtggtgggtgtgtcctctctgctgaccagctcttcatcaagagtctcaacagtgccaggtacctctatgaggtcatggagcagccccgccatgggaggttgacttggcgtgggacacaggacaagatcactatggtgacatccttcaccaatggagacctgatgcatggccagctggtctagcagcatgatgactccgagatcacagaagatgatatcccatttcctgctgccatcaggaccagagcagtggtgacgtggcctgggaggaggtatggggtgtcttctgagtggccatccagcctgtgaatgaccacgcccctatgcagaccatcagctgcgtcttccacgtggcctggggtaggtggcggctgctgactacagacaacatggccttcagcaatgctgattcgggctttgctgaggcccagctggtgctgacccaccaggacctcctctctggcagtatcatggccacggatgagcccatgcagcccatctgccgcttcatccaggaggggcctcaggaagaggcgagtcctgttcacacactcaggctgaccacggctggatcccgctgcaggtgtccgatgggcagcaccaggccatcacggtgctggaggtgcaggccttggagccttacctctgtgtggccaatggctccggcctcatggttcctcaaggaggccagggtaccatcaacatggccgagctccacctgggcaccaacctcaacatctgcagtagggatgaggcccactaccacgtcacagacagccctcactggggacagttgctccaagccactcagccagccacagccttctctcagcaggacctgctggttggggctgttttctatggccacaatggcagcctcagctcccgcaacaccctggccttctcaatggatgtgggaccagtgcacacagatgccaccctacaagtgaccattgccctagagggcccagtagccccactgaagctggcccagcacaaggagatctacatcttccagggagaggcagctgagatcagaagggaccagctggaggtgaggagctggaggtggtgagcggggtgtggaccaggtagagggccttcctcccagcctccatgccgggaacacatgtgacttgggctgtacctgtggtggtcccagcttgtgtgtgtgcacgtgcctcagatgtgctcccatatatgttgtgttcccaagagtttctggggagcttgctgtacacccatcctcctgggagtggtgtgtgcctctagagctggtgtccactcatgtccatggcatggctgagcatgcagattcctggacgccacccagccctacagaatctctgaagtggagcccgagaatctgcattgcagtcagttccctgggagggcatcacgggtcctgaacttttgggattgctggccgtggagacaggccgctgcctctcagacccctgtgtaccccgctctcttctcagagcccagaccaggaccaggagggtctgtcaagggcttctgctcacccaggaaccccacagagcagccacgggccttccagagatctgacatgccctgtgacctcaggccagtccttgcccgctctcagccttactcttccacactgcttatttcggagacccttctggtctgcatctggagcttggggcccatggtgagccagcagatctggcatcaggaaggcctcatgggaggaggcagtgtttgggccgggctctgaagagtacaggccattaggagcagagaatggggagtggtattccacgcaaaaggaacattccggccgaaggcacaaaacaggaatgtgagtttggaggcagtttagcctcttgtggatggcccatcaggtgagggagcccatgtggcctttggggtgtgagctctgtagggcctgtgctgggggtgcctgtgcctctaggaggggtggggtggggtggggcagggcaccctctgatggtcctgggtggtaatagcaggggttggggaggatgctgccagcaaaccagccacaggcctgaacagatcctgagcagggggcctgtgtgcgtgtgcacacacgcatgtgtacctgtacctgtgtgactgcgtcagcatctgatgaactcatatgtctgtgtcactgagtctggggacatgtgattatgcacctccctgagggagtgcatctcaagctgttgaccgacaccccgtaaccatgtgtggggtgggtattaacatgtgaccagctggggcaacccagtgaaaccccatctctacacaaaacatttaaaaattagccaggcatggtggcacatgactgtggtccccagctacttgggaggctgagcccttgagcctaggacgttgaggctgcagggagctgtgatcacaccacagcactccagcctgggtgacagagtgagaccctgtctcaaaaaaacaaaaaatgtgaccagctgcatgtctggctgctgtgtgtgtgaacccacatgtgtgtgtgtcactaaatgagcagtggtatctggggaaataagtggagcaagatcaaggctgttctggctgcttagggccacagtgggcccctctgagacccctctgcattcccttgtgagtcctcatgacctctgttaaccaggtagcccaggaggcagtgccgccagcagacatcgttttctcagtgaagagcccaccgagtgccggctacctggtgatggtgctgcgtggcatcttggcagatgagccacccagcctggaccccgtgcagagcttctcccaagaggcagtggacacaggcaggatcctctacctgcactcccgccctgaggcatgccttctcgctggatgtggcctcggcctgggtgctccccttgaggacgtcacgtggagctggaggtgctgcctgctgtcatccccactgggggcacaaaacttcagcagtagagggggcacagtcgcagctgcaccctggcccctccactgctccgcgttgccaggtcctgcttccccactctcccgggccttggcctgcaggtgctggagccaccccggcatggggccctgcagaaggaggatgggcctcaagccaggaccctcagcaccttctgctggagagaggtacggctgtgagagaggcccaggggctgcagcccagctctgggggcagagtggagggagccccggggactcccagtccaggggttatacagagaggagacagggagtcacatttcagaaagacctatgctttagatgctgtatctcgggctgggcgctgtggctcatgcctgtaattccaggactttgggaggccgaggtgggcagatcaggaggtcaggagatcaagaccatcctggctaacacggtgaaaccctgtttctactaaaaatacaaaaaattagccgggtgtggtggcccgcacctgtagtcccagctactcaggaggctgaggcaggagaatcgcttgaatctgggaggcagaggttgcagtgagccgagatcacaccactgcactccagcctgggcaacagagcgagagactctgtctcaaaataaaataaaatatcccctttcttcctcacaactcctctgggaaccagaacttatggtccccattttccaccaatggaagctgaggccctaaaagggtcagtctcttcctgcacccaaaggcagaacatgaagggtactgctggggcctgactgccagccctgggcctgcccctaggtggaagagcatctgatccagtacctgcacgatgggagcaagacactgacggttttgtcctgatggctaatgcctctgagatggaccgccagagccatcctgtggccttcactgtcaccatcctgcctgtcaatggccaacccccgacctcatacaaactcaggcctgcaggtgagcatattcctgggaccaccccccatgtctgctttgagaaagaggccaatgtcccctacttcccggcacagatctcccccactctgagcctcagtttcctcctctgcaaaatgaggacactactgtgtgcctcacgcagttgttggaaggagagatgtgagattgtgctgaaatagaacacaggtgggaggttttgttattggacatttgcaagtacggtaggcagacttctgagcagccatgggtggctctgctgttccttctcctgtggcttaggaccagaacacctgaaagaatcacttacaagcccttaagggctggcgtcagggtgggaccgttaagcttcccaccttcaccccagcaagtggaggcctcagcttggcttcccaaactcctgccccttgtccacagcagagcagggcccccatttggcaaaggtggaagttgaggcccagagatgggatggaacttctccatgattgcaaaagtagttctggtggaacagaaagggcatggctttactaagcccacgtggcagggctttgaaccccagcttctggggcgcgtcctccccagtcagcagaagccactgaaggttccgcaagagggctgacttgggctgtctctgacatggggcaccggggggctttggtggtctaggatgtgcctgtagggggtggcctcatggtgcggacgccacagaagagtgggacacagcaccctggaaccacaggctgggatggctgtgtggcagtgcggccaccaggtggtgccatctacccgtgtttgttccgggagcccagtgatggggccctgcctcccacagtatggcccctcttgccaaggctcggcctgagggctccctgcggccaggggaggaagcccaggaatgccagagggctgttttctgggcatgtgagtcccactgcagcactgcccacaagtaattgacccagcaagagtggtaccaggacctcaggaacgggtgcctgttctgcttgctagtgggaggcctgaaaaggggccccctttgcccaacacgaggagggcccgtaactgctctggaagcacctgggcccatcccagcactgcttctgtgctgcaggacagtgccaaccatcaggcttcagctctctgcgcctcccacccctcccttagctggaaggagtgctcgtttctaaaatcactgttcccacctgtgcccagcccctgccaggcacacatggagggtctgaaaggagactgctgccccaccagtgagctagattaaggagcactgttggtcagcgctgggggtttctgggggtgagaacttggtgacggtaagagctagggccttcctgggttgggtacacaagctggtcttgagggacacacaggactaggacagatgaagagcagggatgctgggcctggagggtggccttccctggggtgacagggaaggtgaatgcagggaggccatttgtgcaggggagccacagcagcgccagccttgatgccacctgagggcctgagcctcagtggggttggagccctggtggcagcccagggccggggaggaaggggtgggtaagtgtggcagggcagaaccttcacaggcctgtgtccccagatgtgggagggggccaccgtgcccatccctacagaggctctgaggagcatggatggttactctgggcccaaggacctggtgtacaccattaagcagcccagcaatgggtgggtagtgcagtgggcggtgccgggcactgaggtgcgcagcttcaagcagacccagctggatggtgggctcgtgctgttctcacacagaggtgggtgctgagggccgagccccaggtttctgctgcccacgggggcaccctgaggtggggagccagttcaggccagctggacccaacacccttgtccccaggggccctggacggaggcatccactttggcctctctgacggtgaacatacttcctccagacacttagcttctgagtgacggcccagaagcaagtgcttcactcgctggagggcagccggacactgactgcccaggtgggtgtgctgattgtgggcgttcctgggtgcggggggctggggcagagctgagggtggcatgccagggtcacactgcctctctgcagccacaggcctcggcctggatcacaaaggctgatggccccttttgcctctggcagagtccgtccagccactcagcagccagagcctcagagccagcaggcaccgacccccagctcctgctctaccatgtggtgcggggcctccagctaggccggctcttccacgcccagcatgacagcacaggggaggacctggtgaacttcactcaggcagaggtaagggccccactctgcagccaccactcagatgcgcccagcctcaggtggccactgtgccatggacatcatgtggacatgggcaccagctccagcatcaccggcagcagacactcccaggcctgccatggtccaggacctggtgtcctgccctctaggagtcatcaggctggcagggcaagttcatgttcccagaaggagggagaagaatgcaggaagtcggggatacagggccccagagcagggctggggtcttggggtgtggcttcccgaaggaagctagagctggacccaagggtctggagagggagaaccatgtaggggcactagtggcaccccagcagctggtgaggggcagtgcttggtgggggatggagtcggaggtgaagcagctgctggggcctgtgggcagaggtgtgagcctcgggctcagatcaggtgccagccagaggaagagtggatcctaggagcagatgagctgatgaaaggcagctgagtcggccaaaagggggaagccactgttcatctgtcctggtggcttcagagaagaactagagctctcagccatgggtagtggcagactctctgtggtaactgtgccacgggggccagcccactcatggtttaaatgaacacctctccccaaaggcagaatgggagttgttccatagcagggcagggcagggcagggcagactcttgtgggccgccctgggcaggcagcacacctgatgctcccatcaggaggctgcgtgagcatctggacccagcacatgatcacagtgagttctcggcagggagcggtcttgtggggcgcagagctgactctgtcactcaggagccacggcacacagcactgccccaagtacctccagaggggatccctgtcagcccttgaaaatggcagagcccaccccagcccccttttcaagctcccttgcttcggcaaggacctcctgagcctggcgctctccctcctgagaggtgcagatggtactcagcaagtgcaaagccgaggtttcttgggcctctcacatcagcacctcccagacctcggttctgtatttccctggagctccactcctgctatggtgcccttcccacaatgagatattcatcaggctggtgtctacagctgctgcgtaccctcagttgctgggagcctttgtcaagaatgcccaggaatgaggagggcacaggacccagaccatcagcaaccctcttgcactctatagtcccatgttactcagagcttccccatgctccagcaagatgaaggactagattgaatgggcaccaggctggcagtgccacccaggaaagctgggaagaggctacatgggctacctggcccactcagggaggagggcaggactgggtattgtcttgacagcaaccctgtcccacaacactgaactgggcagggaaggggtcaggtgtcctcatttttcagataagaaaactgaagctcccagagggcaggtaaatgtattcagagcacatggcgagtaagaggcaaatcttctgccagcaagtccaggatttttttcaccagaggacattgcttggtccccagagctcaggaccctgtgttttgtctcactcccacccacagagctcctgtatccaggcatcaactccaactcccactcctggaggccgaggcaggaggatcacttgagcccaggagttcgagaccagcctgggccacatagtgagaccttgtctccacacaaaaattttaaaaatagctgggcttggtggtggcatgtgcctgtagtcctagctactcgagaggctgacgttggaggatcactttgagcccaggaggtggaggctgcagtgagcagtcatcactgtactccagcctggtgacagagcgagaccctatcaccgccccccgccccaccaaaaaaaaactgagtagacaggtgtcctcttggcatgataagtcttaagtcccctcccagatctgtgacatttgacaggtgtcttttcctctggacctcggtgtccccatctgagtgagaaaaggcagtggggaggtggatcttccagtcgaagcggtatagaagcccatgtgaaaagccatactccaaggggctccaagtccagcgcacagtcccagaagggcccagcaaggcagccagggcggcacaggcaccaggtcccaaccttcttccctgtttgcccactctcagaccccggagttcatcatctcggagccgctggccaatatgtactcatgtgggaaccagaacacactgatggaggagttggcagagcaggcacagcagcatgacgagatgctgcacatgcaccacgcgctgaaggaggcgctcagcatcatcggtgacatcaacaggaccactgtcaccatgcccatgcccccgcccgtggacgacacctggttgtcagagcatccctgacgaacacaggtaccaaagactgccccccacggccccaaaatcccccacccgggatgcccagaggagtgccctgggggcaagtggcacaccccctcaccggggtggctcccacctggagtgacggggggagcttgacaaggagcactggctgccggggggggggggggtgtgtggagctgggatgttctcgctgctgggggcggggcttaagctctggcaaccgccttggggtgtggccggcactgcgctggggcggggtcgcccatctctcccctccctgtgcctcccaggtcgcccaagtccagcgtcaggatgcccaggccctgccatgtccctagcccggcctgggtggcagggcccaactcctgggcggcaggacccagctcctgggcttcctcctgccgggtccccccttggggaaacgtgccccataccctccaggccaaaagcttcccctgatccctttgggccctacccccctggtgctctcgggccccagccggggtcccccaggtaaataagggctgaatgccgctgaaaaagcccctggacacgcgtggccaggaaggaaatgggactggattccaaaaaatcacatctggccgccagaactggccgtctccatccaaggcactgggaccatggggtgcccgaaccacctgtggcccaaggctgggcaaaacctgccccccagggatcactgaatcctggaagtggtccttttttaagaaggggctgtggggctcatcccacctggcaccttctgttcagcacatggatgacacttccctctaatttcactcctggcggctgaccacacattgcatttctcttcctttcttctcgctgtcctccatccttcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttaccaccgggggaaatggatgaaggctatacaggccctctctctattatttttgacaagagtgtgagaatccacaattatttcaaaataaaaagacctccctaagtgcggacagaatccagccttgggccaaaggtgcgcaaactctcctcaaaatggggctccctgacagcacggccccctcctccaccagggcttcttccctagggctgggaagcacctccctgagatgcaggctcccaccctcctgcagctgcagtacctgatgagcaggatggcagtgtcatgctgcagggggtgggcgtctcccttcatgttgatgcttttctgccacttgcagaagctcttcagggtgttgtctgcatggtgcatgatctttaggtcctcctgggggcagagagagtgactgctcatgcctcccctgagttccaagaaggtcaggcccaattctcccccatacaaaggcaggagacagaggcccagcagggcagtgggaggcccgcaggcaccagtccagcttccggcctgaccatccctcctgtaggaacctcctgcaggagacctgggacctgagagagggtcagtcaggaaccagggagtggcaggggacacagtccagtccaaggaggccttcactgtgcccttccatacagagcagcacaggtcatggggcaggagggctctggcagccgaagccattgccaggcagcgtgggaccacatgaccgctcacctcctcatcttccagaaggaccaggagcacaatggtcatgtggatggggttcccaatgctggggtcgtgaaacaggccagccacctgcccaagagatgagggggtcaggctgtcaccaggatgaaggatacaagcagccaatgcccaccccaagccacccacccacccagggcaatgcacacctgtgctcacacacagggacgctcacacgggtgcacacaggctgcacagcggataggcaatgcacatgcaccaatgcatgagtgtccccacacctcacacgcactgccccaatgtggcagcagcagaacctacagaggacaagaggcctccgacgccccttcccagaccacaaatctttcctagaccacagacaggtaagcttggtatcagtccccagcaaagtggctccagaggaccagaagcccctgagggtctgctctgcctgcctgaggactgacccaagctatattctgagtcagggctaggggcagcttagtgccaccacaaaggccttccctcagcatatataacctcactgtctcccaggagctatgggggtaatacaggcattgggagatgttggagggaggcagggtcttaattggctgatcaactcaaccaagtaacattggttaatggcccaaggtcaatgtggggtgtttcaactggataaatgatatccagggaagcccagccctgttctgctgcaggtctggagagcatgccagaggtgtgcagtgtttgtgaaggtaagatctggaggttacagataaccacaggctcctggtgagctgaaagtgtgacaagagcccctcgaaaagggcttgtggcctcagagagtaagaacagaattgggggtgaaaatggggtgaaactggctgagcacggtggctcatacctgtaatctcggcactttgggaggctgaggtgggcaaatcacgaggtcaggagctcgagaccagcctggttaacatggagaaatcccatctctactaaaaatacaaaaaaattagctgagtgtggtggcatgcgcctgtagtcccagctgctcaggaggctgaggcaggaaaatcgcttgaaccagaaggcggaggttgcagtgagctgagatcacgccactgcactccgacctgggggacagagtgagactccatctcaaaaaaaaaaaaaaaaaaaaagaaaatagggtgaaaagggacctgtcttgctatccttgggacaaacccacccaagctctaggactcagatctgagtctagcacagggagaacacggataaattggggtctgtaggtggcgttggtaaagaaagatgaggctgtcctgaaggtggctgtgggtcagatactgcagcagccaaaaaaatagccacagccaaccttgatcgagcctaacatgtacagtccctgtgctgggggcttagcatgcattatctcatttaatcttacttctgaggtaggcacaattatcctcattttacaaatgaagtaactgaagctcaaagagagggtgaagctgggctcagaacccaggtttcactgcttcaaagcccctgcttatttcctaaatttggggaatgctgcctgcctattctgttggggattctcaatgaatatttactttgagggctctgagaagtcctgtagtaacgaagtctgttttacctttttttttttttttttttttcgagacagtgtctcactttgtcatccatatggagtgcagttgcatgatctcagctcactgcagccgctgcagcctcgacctcctgggctcaagcaatcctcccacctcagcccctcaagtagctgggactacaggtgtgcaccaccatgcctggcccgttttactttttttaaccctgtgtggccaaacttattcaacagcagcatctttttttttcacagtgcactactggcattctttggaacacactccctgaaatattccttgggaaatgctacaatgagacagagtccccacatgcagaatcatgctcttccacatccatcaccttatcccaggtagagcgatggctctcaacaagtcagtcttaaataaacatctgatcctgagggaacatctgttccccatccttctggcccatcctggcccagggcacacgtctccagggcttctcctcagcgagttctctggggcactgggaaccacacagggatcagaggcgaggggcctgaattcccctcctggctctgccccaaacctgtgctgtgtggctctgcctgaccactttctttctttgatcttgagattccctgactaaaaataggaataagttgatctgcctcatggggggacctcaaagggtaaatgaaatggtggatataaacgcagtaaagtactgtgtccatgggaggggaactcctgggcttgacaaagctggctactgggcccctatctccccgtgtcacttcctcccaccctgggggcttagtgcatctcaacactgacccctgaccccaccctctaaaccccagcctggggaggctggccaagacccagcccagcttgccctactgagcctgctcccctgacccaggctgctccagatcagaagaggaagcacatctatgaagctggggaaaatgaggccaagaagcatgcctctgtggatatgtgctccagcaaatggagtaccagagctgtgggcagcctgagattggcatgccagccaagcattccccaaatcccagcaacccttagcaggcagctcttcacctggactggccggcactactgctgctctgcagaggaggcactgggtaccacactccaggtcccaataatagaggttagttattctagggtgggagcagggtggcatggggagggaggttcctggctaatggccctgttggagctgggcatggctcacctggtctggacactggagggagaatggctggcagagccaggtgccataggcttggtggggagggagcaagagggaggttgagccccaaggtgggagaagtaggtgagatggagagagggaggtcagtctaggggactgactgggacaggcctgaaaggcagaggacacagtcttgtggcacaattaagggcacacgctatagtgatgtatccgtctgtctgtctgtatcctctggtctaagggacaccgagcatgggcatgttacgaggggcttctagaaaggccccttcatgtccccaggcctagcacctgcctgagaactgggagtagaagagcataccttgcaccccacaggtacttggagcactggaatcaccccgctgtgccagcctctccggggccggatgcttgtacaccacatggggctgggcatggctgggccaggctggggcaccgtccaggggctgaatgaagtagtccttgttggagagcaggaacacacctttctagggaagaagcaccagggtcacacagggagggctggccctcagctgctcttcctgcacgtcccagaggcccatcctgctcagctgagcccccactgcccacatcatctgtgactgcccacagacaccctgcactttccgcctgctgggcctttgctcactctgtagcctccatctggaaagcccttctctgccatttcacacacagccaaaccttcaaagcggagctcagaagcctccgcccctggggatgctgccccacacacccaccctattaggagaggaaaacgggtctgcacccaaatctgacaaaatggtgtcttccaaagtcccagacagctgtcctgagcagggcagcttgtgcccaggcctccaggctattctgcgtcttctctgcaggccagccatttccagcactgtgctccctcccagctggccagggcttctgaccttccctctatctccctaaggcaatgaatcactccaaaagcatccacacccacacccgagtggcggagatgcccacggccaccaggacaccctgttctctgggcccagggctgcccagagaagggaagctggcaggagtgtcttggacatgtccgccaacattcagagtccagggaggggaggggccccaggaagcatctatgatgcccactacctcctgaggaagctcagggctccaacaggaaagaaggttttacatccctcggacttcccctcataggcaccaattctgccccttgagtcacacaggaccagggggcctggagggagggctggagagtgcatcagctcttgggtctggagacctgggtatgaatgcgaagtccccccctcccgcccaccactcactgaatgactaggtgagcctgggcaagttcccctctgagcctgtttcctcatctgtgaaatgggaatgatgccccatgtgcacagctgtggcacaggctcaacaagatcaattgtacattaagggacaggcacaggctccataaatgggaatactgtgcagggcagatgggccttcaaaggtccagacgttgtgcagcttgcgttgtgggctgccctgtcattaggccctgtgcggccacagcccatggtttttgcctgagcaatctaagctgagggcctcctgggaacagtggacgctgagagtgtgcacacatcccctactcctcccaaacccccaccctccagagctgggagagtggggctggtcacctgaacacgaacagaaaggggccctactctgcctggagtggaagctgctctaatcagcacccaatcagggagcaattagggctgcagtagccagcaccacccttcagccagtcgaaaccaggaagctgaggcctgcttttcccggagctctgatccgagcagaggggctgaaaggggttcctcaccacaccctgcagaatggctacagggtgaggggtggctttcctggagaaaagcagcctaaagggacctgtgaaggaacagtcataactgatgccccaaggaagagaagtcaactgctttttcagttacttagtccagtcaaacagaggttctcaaaatgggatctctggacctgcatcttcaatattacctgagacgttttcagaaatccaagtgtttgggcgccattccagacctaccctgcaaaaattctgtttaaacagggcctgcaggtgatttgagctcatattaaacttttcttttcttttctctttctttctttcttttttttttttttttttagtgcctggggtctcgctgtgtctccagctaagcgccatgatcacaccctacgtcctacatcctttaactcctgggctcaagtgatcctttcgcctcagcctcccaaatagctgggactacaggtgcaccaccacccggctttcacattaaactttgagaactgttgtcctagagatgaacgaggcctgcgttgtcactcccactttacaggcgtgaataccgaggctggcagagaaaaagtgcactgggcaaagccaccagacaagtgcgtggcaaggctagagccaatctccacatcccaccacccgagactgccccaagtatacatgtcccagctcactcaccaggccgtcgcaggcgctgatggccgccaggccaccctcgagctcggagtcctgcacctcgccaagcaggtggcaggcgggggtgtgggcccggatgtgcgcgcgacccagggcgccgcgccgcggcatctcgctcacaaagccgggcgccagcaggtgctgattggcggtcaggttgaagcgcagctcgcgcctgcggtattgcagcgggtagaaggcgggcgcgtctcggcgcacagatacatcccgcttgcgcagtgcgcggggccgcagctcacaggacaggaaggaccccccagcgtccacgcgaacctggtgcacgatatccggtgccgcccggccctcggttacacttcctgcagggagggaaccacaaaggccttaggcccagggcagaccggggtccttgctggtggccagggaccagaggggagcggccaagagggggctgctggagtcagagtatctggattcaaatcctcgctgggctatctactaactctgctatttcatctttccgtgcctcagtttctccatctggattgttgcagtaactccttttgttgttgttgtttgtattttgggtttttggttggttgttttgagatagtctcgctctgtcgcccaggctagagtgcgtggcgcgatctcggcccactggaacctccgcctcctgggtttgagcgattctcccacctcaggagtagctgggactagaagcacgcaccaccacgcccagctaatttttgtatttttagtggacacaggatttcaccatgttagccaggctggtctcagattcctgagctcaggggatatgctggcctcagcctcccaaagtgctggaattacaggcgtgagccactgctgcccggcctggattgctgcggtaacttcttaacaggtctctctgtttccactattgcctaccccaggtgcccctcccctcatgttttcaatatagcagccagagtcattcaaaaccagcctgatcatggtccttctctgctcaaaatcctgcaatggtgcccatctcactcgagcaaaagacaaagttctggcctgtatgagacgctaggcaaggtgacctgtccaatctcatttccagctacaccttcttagttccctccactccgcccactggcctccttgcagttcctccacaggccagacatgctgctgcttcaggattttgcattgctgttccctacacctgcaacactcttccctctgttttccacgtggctaaaccactcacttttgagttcttgctcaaatgtctccttctcaatgaggcctcctataatgactttattttaaaattgcaactccctggctctccgtatccctcttccttgctttatttttccccatagcacttctgacataccatatcacttagcattttcattattttttctatttatttgttttctccctcccctcccaatgtagtctaggaaggcaaaaatctttatattctttgcccccagcttttttggaaacagggtcttggtctgtcgcccagacaggagtgcaggtgtgcaatcataggtctctgcagcctccaactcctgagctcaagccatcctcccatctcagcctcccaagtagggagggactgggactacaggtgggtgccaccacacttggctaatatgtttttatttttagtttttttaaaatagagatggggtctcactatgttgcccaggctggtctcaaacaaactcctgggctcaagtgatccttctacctcggcctcccaaagtgctgggattacaggtgtgagccactgcagctggtcctggataatttttttgtgtgtgtgtggagatgggagtcttgctatgttgcccaggctggtcttgaactcctggcctcaagcaatcctcccacctcagcctcctaaagtgctgggattacatgtgtgagccacgacacttggccctttatattctttgttgaagatttaagtgtcagaggaagtgtccagaacttagtccttttttggtatttgttgaatgactctgtagaatgtggataaccacagcacttacactcttgatgctgctgtgaggattaaaccaggtgagctactccacatttagcagtgcctgaaccactggttgaatatgatggcaattatgattgttatgattattattagcctgatggatttaaaaatgtgctctcaggtgcgtgagcattctgcaagtgtctccaggcctcctggaatggggagacagagaaagaccaccccagtggggctgcctggcccctaactgccacttcaacagagtggctctggtttctttcttttacatggaagaattcatttaaagaaaggttccagggatggaaaaaattggcagacctctgctcaggcccttgcagtttaaaaacccctctctgttgctctgtcctctaggatttcccaataaggcctggattcttatccttttttgccacaaactccttctcagaacaatattttgaaatgcagaaaataaaatacataggagtggttgggcccggtggctcacgcctgtaatcttagcactttgggaggccgaggcaggcaaatcacttgaggtcaggagtttgagaccagcttggccaacatggtgaaaccctgtctctactaaaaacacaaaaattagccaggcgtggtggcacatgcctgtaatcccagctactcaggagaccgaggcaggagaatcgcttgaacctgggaggtggaggttgtagtgagccgagatcgcatcactgcactccagcctgggtgacagagggagaccctgccataaaaaataaataaaataaataaaataaatgcacaggagtaccaaggaaattgattatattgaaatacagttatcaaaataatttaagaccaggcaaggttgttcatacttgtaatcccagaactttgggagaacaaggggggaggatcacttgagcctaggagttcaagaccaactgggcaacataatgggaccttgtcgctacacagacacacacacacacacacacacacacatacaaaattagccaggcatgatggtgcacacctgtagtcccaactacttggaatgttgagatgggaggctctcttgagcccaggaggtcgaggctgcagtgagccatgatgatgccactgcactccagcctaggtgatagagtgagacattatctcaaaaacaaaacataacaaaacaaaaaataatttaaaaagtagggtgtggaattatactttaaacaagattttctggcaaattaaacaactatggttttttttttttttttttttgagacagagtctctctctgtcacccaggctggagtacagtagctcaatcttggctcaccgcaacccctgcctcccaggttcaagcaattcttgtcccttagcctcgcaagtagctgggattacaggcacgtaccaccacacccagcaagtttttgtatttttagtagagatggggttttgccatgttggaaaggctggtcttgaactcctggcctcaagtgatccactcacctcagcctccaaaagtgctgggattataggcgtgagccactatgcccagcaactacggaaattttgaagtagtgatgaacgtaaaccttatttcaagatacatgcaacaactgtaatgagatagaaaaatatttggtttgttctattggtaacaaaatcacaggtgctgttgggatttgctaataatattcataattgagggaaatactaaatttcattgagaggttacaaaaagtaaatatgtaatattttcccattcaagctcatggatcccctcagttcacggtcccttaggctgtggaccccaggttaggacacctgcagtagggtgtccagactgcttcctaggtgagagagcaaagggaggctcagagaggtggagagattggcctagagccacacagtgacagtgagagtggcagtgctgagactgggactcaagtcccccaaatggtttcagtctcttcagtaacattgctttatattctcaacagtccatcccttactgggcctcagtttccccatcgttaatgtgaaagagttgaattagatcacgtttctcaaatctctttggccaccaggtctagtctcaaaagaaatctcatgtgccgggggtgggggagccctggcatccatgcttttcccactcttttccctctctgcagttcccaggctctaaagagcacagttagggaacttggcaatctggagtttctcgattgggtttatacccagctcccaggatcctggctgttcacgacaatagactccacgggctcacatgaatgcctgagtgccctgctgacatcccaccaggattccttctgctgctgcccagcccaaagctccatcccagcaggctgcggaaaccaaacccgccctccagtctgtcccctgccaaactgcatgtagagtgccctgcacacgtcagtgctgtgcccctgctgagagcatctcccactgctcacaactgccccagcagtgccggcctcaaagagctttctctgagagtcaggaggttggatgggctggggcaacgtgctatgtggctctgagcaagtcttcctcatcactgagcctcaacgggccactagtgcaaggattttccagatctcacagatgagtttcttaaaaacaaattcccaggccccatcccagactcactataccagcatttccaggaaactaggactagggactaggaagctgtttttaccaagaacctccgggagctgtgatcctcaggaaagttaggaaatcccccactgggagtgaacctggctggtcatcagcagtacgtggagagctctgaaaaactgcagatgcccaggacccagcccagagattctagttccacagatccagggctctgggggccctagaatgtgtattttctgtgtttttctagaccttcccagggattctgatctagccagttcagaggctggcattcagaaaccaccggactggatgatttaaggtgacttcttgctctgacatcctaataaggacatatgggactacaactcctcaaccacagcgtgcagatttgcttgtgttgatcagttattgattttttggtttgttttggctgacacaaatattgaaaaatgttttagtcaattgccaatgtttaggaatcacatgatcttgtacaaaaatctcaattttcagcttttcttgaaaagtcttatcatccatccatgtcaggcttaaattgctccctggcagaagtggctggggtggagcagtgagttccctttaggaagggcctatgctccccggtcctcagtccccaccactccctattcattcccagcactgtggctgcaagtaggctccctttcccatcatgcttgtgtttcctttcactcagtaaagaactgagtctctaacaaaagtgggaaaacaagagatgggccaagaagccccatgtttcaggaaaaatctgtctccctacccacctcgtttgctcatttatgttacctgcctagtccatggcatttggtatgtgacccttggctactaactgtgagggggcactaggtgctccaaagtccaggacagtggataagacaccatccttgccttcaaatggagaaatggccggacgcagtggctcacacctgtaatcgcagcactttggaagaccgaggagggcagattgcttgagctcaggagttccagaccagcctgggcaacacggtgaaatcccatctctacaaaaaatacaaaaattagccaggcgtggtggtgtatgcctgtagtttcagctactctggaggctgaagtgggaggatcacttgagcctaggaggtggaggttgcagtgagcagagactgtgccactgtactccagcctggatgacagagcgagactctgacccccacaaaaaaacagaaaacaaagcagaaaaatgggtgtggtagacccaagacccccactctggcacagtgctgacaaggtccaagcaaggggaagggatggcaccttatgaatgcgttggaatgaagaaaagtttcatcaaggaggatgcatttgagatgtcccttaacatatgttaattcaacagtgaagacaaggagggcctcttggtggtaggggcactgtgtggtaaaccctcagagaagtggggaaaagccaaaagtaagaatgggcaacaagaagtttaatcttggcccaggcatgtgttttgtaaaatgggagacaatggatggacaaaataatgcactgtcaagagcgtgggcttgaaagtaacaagacccagggaatccaccactgagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttagtgaaccactgttttataagtgaccaatgcacgatgttgtaatatcatgcaagggtggaagatccaaagttcaagaaaaaccaagatttgatggagtatcaaaaaagaagcctaggcaacatggcaaaaccctgtctctacaaaaaatacaaaaagttagccaagtgtggtggtacacacctgtagtcccagctactctggaggctgaggtgggaggatcaccttagtccctggagactgaggctgcagtgagctgtgatcacaccactaccttccagcctgggcaacagggcaagacctcatctcaaaaaaatatatatatccacaatgatctaaaatggttatctgtatgagattggcctttgttcacattttttcaagaaaatatcacacaataaattgaatgcagaagcaaactgacatatcaatttgctaatgacatatcaaacatcatgcaaatgacatatcaaacatcaaaataatttgcaaaagatgtaagactgtactactttgggtttagaaattttcttttcataaaagcatttataacaatatgtggtgagcttttaaacaatattttaaatatttctgatttaatttctagtgataaataccaatagatataccctacataaaccaaagctccttgggacctcaatgtatttttaagagtgtaaaggaatcctgaccccaaaacttggagaactgctgccttcccctccactttcttccttctctagaatttcttccttggaagaaacatccctttgccattctatattaacttacatagttccactgaggcaagttttgctacctccctcccatctttccacctctctctcaacacaaaacctgaccaaagcattctaccagcccaccccatttccagtgattagctgtcaggtgggctaagccaaacaaatctgggttttccctgagactagacctctctttctgggagagatggaatcacagggacaaggttggccaccttggggtagtgagaattcatcctgcctaaacagggagaattcaaacaagtttctagaaagccaaactactttctagaaagtcaaagataattatattttttgccatgactgtaagaatgcccatttcattgcacactttctaacatttttaccaatctgataaataaaagctggtactgagatgaaaaaaaggctgggcacagcggctcacacctgtattcccaacactttgggaggctgaagtgggcaaatcacctgaggtcaggagttcaagaccagcctggccaacatggtgaaactccgtttctactaaaaatacaaaaattagccaggcatggtggcatgcgcctgtaatctcagctactcgggaggctgaggcaggagaattgcttgaacccaggaggtggaggttgcagtgagatcacgccattgcactccagcctgggtgacaagaacaagacttcatctcaaaaaaaaaaagaaaaaaaaaagaaaaaaaaagttcccatacaatataatttcttccatctctggaaacaaattcagcaatgagaactgaaagtcaccacgtggaaggtttcaaggatttacgtctacctactgatgtctaaagcattagttaagttacaaaaaaatacgcacacacgcgcacgcacacacacacatacccgtatgtattcagtaccagaaaacatgactgactacatggtaaagtcatccaacagaaagcacacaataactgaaggcaatgtagaggagtaagttataacatggatctacaatactgttgagtgaaaaagcagattacaaacaaatatctgatttttaagggagaggaaacatatacaagcacaggagaaaagaggtgagcagatgactggaaagatacaaatttctgacagtggcaccttctgagtggtagaattacataggtaatattttctagttttgcctaaaagttttctaaatttcttaaaataagaaggttttgttttccatattacaaaatatccatcaccccaggaaatttaacctttggcacaaactctacaacatgttcaaagtttgttcagttgaatatttaagagacaatctattttgaaagacatttaaaatgaccaatatttaaacctatgcattaatatttttcaatcacgttttaaattttgtaattttgataagttttagatccatcttgaaaagataaattttctgtttgtctttaaaatattacctacaatatgcctgtttttatacagttaatggtgctcaaaaatcgcaatataaattcaggcagtgttccttctatagaatgtgtaagtgcttctaatactgctctttttcaccagttatgaaaacacggaacaattatctaagcatctaattattcaggtcctttgtttctcctccattctgttagttttatactaatttcaaggcctgtgaggatgaagttgtctgtgacagctaccacaaaggttactataagcagacaaatttccagcaagtttatcaccactaccatcccaccataaaactgtctcaatcaagggcaacacaattcaaggttagtcaagacaacctctttacctgtcactgcttaagaaaaggattttttggtcttatttagaaataactttatctatttttctccataattccactgagaccaatgtgtgcctctatctcaagcaccagcaagcaaaactgcctgccagtatgttcagtttttgtatctttccaaatgtagggcacagctatcttttgatatcataattttttgaaaactgatgcacaaacttcttcttgaaagttcagccaggtgcggtagctcacacctgtaatcccagcactttgggaggctgaggcaggcagatcacgaggtcaggaattcaagaccagcctggccaacatggtgaaacctgtctctactaaagctacaaaaattagccaggtgcggtggcaggtgcctgtaatcccagctactcaggaggctgaggcaggagaattgcttgaacctgggcagcagaggttccagtgagccaagattgcaccactgtactccagcttgggtgatagagtgagactccatctcaaaataaaaaataaaaaaaagaatttcagatatacagcagttgtaattcttctgaaggctgcttatgggacacattactttcataatttgctgttcaataaatgtggggtggagaataaagtaaattgacagaattaccatataaaataaaattctaagtcctctgacaacaaaaacttacacacacacacacacacacacacacacacacacacacacacacacagctttccctgctaatcattttacaacaaccaagtagctaacccagagcccacaaaagcagagtcaaaattctaacacttggtaaaataaaaatgcacatatatccctgtcacctaaaaaaaaatgcttacgtattcaaagacagcaattgtagctactgagaacatcattgtaagcaaactgaggcagagaaaacaaacgtgctgatgaggatttgaaacacctaagctgcagaaacccactggatggtttcctaggttccgagttggcattatctttcagaacgatcttctagaagagatcacataacactgttacaaaggatctggagaaagggaccctggcttcatcactctggctctccagtcatgctttacattttcacttcttacactctctttcataggaagtcaatttacaggcttccaccaagcccttaagtgacgtttttgtactatccatgacaagttcttgatgttatgtctgcacttctgacaaattcttagcagttaacttactaggcagttaaggtttttgttcaagcacaatatagctagaatagggtcatacattcaataaaacaaatatttaccaagcatttattgagtggaagataaaaagcacaaagcataattataaaacattctcccctgccaccataaaaatttttttaaagccttacagaatatagcataacataaccaaagcaaaaataggactaaagaggggaggaaggggaaatatcagcatgaattaaatatgacccagaagagccttgatggtcagacacgtaaagacaaattgggtagggttagggggtggctgtcaggggcacattctacaggggaaaaacagctgatacagaagcctgaaaggaaaaccgggcagagcacctggacaggactcttacctgctgcatccagggtacaatgcgcctttccagaacacagcagcgacccggggtagagggatcgctcaaacagcaccagaggctgcattccaacttttcctccatcaacgagtccgttttcattgttagtttctccttaaacacgattggctgaacatgcgggaacaaggaaaacctgactgaagaacgaggcatttaagcttaagggccttggatctgggcgcggtggctcaggcctgtaatcccagaactctgggaggcagagatgggtcatttgaggtcaggagttcgagaccagcctggccaacatgatgaaaccccatctctactaaacaacacaaaacttagccaggcgtggtggcgggcgcccgtaatcccagctactcgggaggctgaggcaggagaatcgcttgaacccacagactgtcaagagatggaggctgcagtatgccgagatcgctccactgcactccagcctgggcgacagagtgagactccatctcaagaagcgcctgccaccatgcccggctaatttttgtatttttagtagagacagggttttaccatgttggccaggctggtctagaactcctgacctcaggagatccagctgcctcagtctcccatagtgctgggattacaggaatgagcactgcgcccggccaaaaaaccgaaaatcttaaaggcctttccccttccctcactgggctcaaacaacagcgggagccgccctgccacgccccgtcgcggtccaggggagcaggctagctgactgagggcgatcatgggccccaacaggtctgcgggcgacgcgggctcccacctcagggcgcagcgactggggcgagaggtgccggcagcccccaagccagccccgcggcaaggagccagagagacgcgccctccccctcctcccacgcaagcctcacacagcggggcgggccagacgcgggagaaaggggcgcgctcgccccgcctggggaaccggggcctctcccgggcaggctcccctttgtcccgggactctgggcgcctcctctccgccctcgccctggcccgtgaggccgccactgggcgcctcaccgtgatgttgcagtggagcgtgagctgtggcgggggctcctggttcttgtggaagatagaggccaacaacctcagcttggccttgaaccctcacacggacattttactctcacctctggcgggaggggcgcggaaggtgagcccgtcgggagccgctgtcacggccgcaaccacccgcgggacctctcggcggcgctctcccagctccgcctctccctgctgcctcaactctattcggagtagggctggaaaatggcaaggggcaccgaggcctctgcggggagctgtgtggcggcctgggcggctgctccccttgtaacagactccaccgacaggaggcgctgctcctgtcaagccgcagcttaaaagggcaacagcaccacagtccccgctaccgcctgggaaagggctgcccctaccccgctcccgtccctctcgcccctcacacccgtcgcccctcacccctcaacccgcgcgccccctgcgcacccgtttcggcggctgcaggagtccagagcatgcgcgcgcttccggctgccccctcctcgccttgacccagcactgctggacccatctggtccgttcttcacactcgcggactggaggctccgggcagcacaaccaccaactcgtgtgtgtgttggggtgggggtggggggcagaaaaccaccaactcgtgtgtgtgtgtgtgtgtgtgtgtgtgtgtgtgtgtgtgtgtgtgtctcccaagggaacagcactgctgagttcaggctatcagctcatggactgtcagcaaaatacagtcacaagaaggctatgtgctgttttgtctcttgcagtgacgtcatgttgctcatgttttatgtttttcagagttcattagtttctgtttgctctcagttaatatccagctcaatagattgtgtaagtagaatacccccaaactgaaagtcacctacataaaatatagtgaaaaatatgtcacccacttaaactatagttgaaaatatgtactcattagttttgtgtagccaacactggataatgggtaaggggaaaggatcccagggctagactgcctgggttcaagttccgatttcctgctggctgtgaaatacttgacagcgttcagcctctgtttcttttcttttttttttttttttttagcttaatcccaaatatgatagtaagtctcagtttcttgatctgaaaaacagaaattattcaatgacagtctatgtgaaaactttaaagttttcaaagccactatctagcttaggaaagtcctcagctttaggggttaaagtttttaaaaccactgcctggttcaggaaagccctcagctgtagccattattagctatgattattattgtggtggctacacatacattaatgaggcaggaaaatgctcaaggataacaagcaagtatccagattatctcatcagaccaagacagatgcatatgcatgcatgatcatgttttagctcagagccatttgtctaaaaggctcttgaactcagaggcccaggagtatcaactttgctttgcagtggagccatcgcttttgttaatcaatgaaattgacataatgctcttcttttttttttcctttttagcaccaaccatgtgcctagagctaagtgtgttaagaagagcatgcttcaagtggctggagtgagcaattcaacttgtggaggaatgagaagtgacagtgttgagacaagcaacataaaaccccagggtaaggtagaaatcactgaaagtcaggcaaaggaactggcgtccagtaatgagtcaggctttgccagcctctggccctacagatggctctttgcagaggaaaaaattaagccaggcccgagggcacagatcctaagggaatgctggcagctctaggctgtctatgagagtccagagatgctgcttcaccctggggctttaggcaagtccctttccctcccagagcctcagcatcccttctagcaaatgacgttctgcctttctcctaggatggctgtggggatcaagggagacagtggccatagggatactatgttaactgcagatgcggctgtaggagcactttgctaacttccagcgtgagttcagactcttcaggctatttggcacccagatctatggtgaggtgtgacatatgggatgtaaagtttgatgcctgctccgactccagtcttgctaacacacacgaaacctttggtaaatcatgaccctgccttggggaaaagggcagtctgggagagcttcttcaaggcagcctggcttcaatgcagtctggggcatgactgaggtaggcatacatggtgaggaactggagggtaactgggtaaagagctgcagtgtgggcagaggtgtagtgtgggtcacatcgcggatagccactggccaaagcagggaacagagacagaatgaggaagagctctgtggggagggtggggcacagggtggagaaccttcaaagtccaaagagtatgacttgttgggattcaacgctgtaggcagtagggagccatggaaggctctgaggtggagaaatgacagccggacattagtgagcaagccctgtctccgtgagcagcatgggtggtcctctgagcacgccaggcacgagtgtgcagggagctggtgcaaatgcctctgtgtgcgggtgagcatctgtgttgtgactctgcccacgcatgtgcttcagtgtgccgagtggctgcacgccccagatccatgtggcacgtgccggccggtgagggtgctgggcattgggaggtggcggggagggcgacgtatgcgtgttgtttgtgggcatgtgtgttagcgtgtgcatgtgggccgtggggcctcacagcatgtgtgtgcacactccggcatgtgcgtgtgtgtgtcccccacccccaggcctgccccacccatgcatgtgacctgccatgtgatttgaagctgtctttcagaatcactatcagtggcccctgaggagcgtcagccatggtaggtacatgcctcactgcctgctgcatgaatggtctgcctgccccgctgccccagctccacacagggggcatacctggagcctcagagccaggctccctgcccctcccttctggagctgcagacttgctctttcctctttctgtccttgtgctgctggctgtctcactttgctccctgtgagccacgggactcactgccactgctcaaggtctccatggctgagcctgggggctcttacaacaggctccatgcccaaggtggcagatgtggaaccatcagagagggcacagagctcatggtttatggtgtaggggctgggagcttggagggggttgtgtggggggctggactcaggcggccagaggcctgggcacatcatcctgggcacgccgtacctgtcatgcagtctgagtcatgctgccagggcaggtatccagctcccagcctgggagtgccaagagccaaatccactgcagattaggggtgatagtcacggtcccacgtcctctatctgtcagcaatccagtggtgatctaggataaaagcctgagagtcctatacacgcggtcatcccacaacacacttcataggccatggaaggacacacagcccccttccctccctcccaggtaccatgatagctgctagcgtgcgactgaaggcagggtccctggcccctgctgaagcactactgctggccagcaggctcacgcaccttggcctgttgcttctaggggtcgcctgtgctattcagccaatagtgctgctggcccagctgagctccacctagagagctcacttccctttcctgccgcggagtctccctcttctgcttttcccagcaggaagggcccagcctcacctatgtaacctgcagccccccgccaaccagttgaggctgccctgttagacttagaagtctatggccaatggcatctggctacctgccctccctgccttccccagggtccctcagaggaccctgggctttctgatggcccagaggggcctctggcattcactccagccagccatcccttatagctccaccattttggttcaatcagtgttccttctctatcaggtctggtggctgttggatggggctctccaagcaagaggtggccctgggccgtgagttggaagacagggtgaccagagaagagagaagcccgagggggctgagcattcatctgaactatgggtggactgcctgggtgccatgaaagaggccagcgtgtgtggggtggggagggccgccgcagtccccaggcactacctatgaagctccggcttctccctccatcttcctcccctttcccttccagcccctcttttccaggaaccttgccatgcccacacctacgccctcccctccccggccctccacagctgctgcagcgcacccatactctgcacttgcctcaccagctctggcttttctctaacccgttttctctctgctttctctccaactgccagctgattgggtcaggcaagtccatcccatccggggagccccaggccccacttcgacctctaaacagattcctcctcttctcagagacctccctttccaagcctgcctgggtgggtgtcctgtgacttgacagtggctcccccagccccaaagccagcccccttcttctgtgacttagtctgttgtagtggtgagctgacacgtccaggtttgaccgttgctgaaacttgtgccccctctgtggtatgcccctgccctgttctataaatagctataaattctctctcacacacacacacacacacacacacatatatacatatatatacgtggccaactgcctcgcctctagcactgggaatcagtccccgtgctgtgcttgtggagtcttgtagcccagcaagaggaagctgtctcctgacatcgcccctccaaagtgcaccacctccagtgagcttccgggacatgcgcggcctgtggacagccagcccccgccatccctcccgcccttctggccaagcatggcggtgctgtgcaggcagctgtgtggcctgacagtctctaccagtcctgctgtcccttggctgagaaacccatttctggatgacagagaatgtgtcctctgctggctgtgttctctatggagctcaggggagggaaaaggccaagccatttttagggtgctgttgggagcagtgaaaaggtcacacccttttcaagggacacttttcctggaaagtccctggagcttagctggctcttaccctgtgaagccggctctggccactaggggacagggccctgaactcagcctggagggaacctgcggggcagccggcactctggagggacagacaggccacccggtgcagacaggagagggaggcagggggacagaacggaagacacctggggtggatggaagtcagtgcccttgggcactggtatctgtcttccctgccacagctagatcaggcttctcaaccagttggctgtcagggccagagtgtactccgtaggcgccatggcagtccccatgaaatccaccaggtgtcaccaggcagcatacaggtaacaggcctggaaggtccccaacagcccagctggacatgctgagacactctggggctcctcattcagtgggacaaactgcaggacccagtgagggaaatgggaacataccaggccgagcagtatggctaaatccatttattccaaaatcaaaagcaaaaaaaaaaaaaaaaacaggagtcccatcaccagggagccatgaccccatccccgcctccttcctcgctcctatgctagcaataaataagtttcccagtcgcgaataattataagaacctcttcctcatatgccagctgcaacctccgctaggtacgatacagaatgttacacagctacagtatgtacacgggggaaggggggccacccccagcagcctgtgccctggcctggtctacagttaactccactgtcccgcctcagctgcctctctgagtaagaagatgggagcccccctgagggaaaagttgctttggtgagagtaagaaggccgtcagacctcctccaaacaaaccaactccaccaacctctggctcttaaataacaaacatcatcatccagaaatgtaaggactcagccttggtcaaggtggtaaagggtctgtttgtctccctccattagacaggggtcttgtcttgctaccctaatggtaaagggctgactggggaggggttgtagggacatggtgggggtgaagactccagacccacttctccaggcttatgctgacaggggcctgcttttatttatttttatttttatcccatgatgtttttttaaatcccgtaacttctttttcagaactttttaaaaaaacttttcataaaactttttttttttacttttttcccacatctttttttgccacaacttttccacagtattttttatcccgtaactttttcatcccacaactttaattcctgtaattttttagtttgtgttcttttaataaacacacttacatggttacaattttgtaagaataaaaaccgattatctcatgccaagcatgcccagcatttgcacagtctcaatacctttaatactatagttttcaagacacacaaaatttttaggcaaaacagcaccttgaaacaatctaataatttattacattacagtagcatcacagaagcagtcaataatgccactttagacaaaaatcagtatttccatcatgcattctgtgtataagaattcataaatcggtaaaagtcgttctaagaaaacttggcaaatacagctttggactggaattggcatttctttctctacttttccttcccctagattctttgttttaagctacagtattcgtattttaaaatgttttaaattattttaagacattaatttaacagttacatttttgaatagttatttgaaagtgactgtaagataaagttttagagaatctattttggatagggttgatttacattttcacattttctaaaaatcagctttggttttagaactgattgtttttcatttcaggaaaacctatcaggtttaatctattactttaaaaataattatcatatattgcagtctttaaataggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatttatcagaaagaggacaacccaagcctcatttcagagcaaagtctggtatacgcttggaaacctatgtgtctgtcacccccaagtacattaatgcattttctcaagagaatcaagggaaaatgatgcttcagaaagatgtcccgcatttatcctgtggcactcaaagtaccccaggttgagacgatatgaggaagattcaagctgtcaagttcagtttcccaagatctattccacagaagatgagcaaatctcacttcagaggccactgactgaagggcagtctggtcccagaaccgtggagaactcagaaaaaaatgttaaagtctctctggaaagtagaagcctgggaaaaaaccaaaccaaacccattctcccattgccacccagagatactgtgaacattttgagctcacaggggaagtgtaggcttttcccactgtcaatgtctatgttaagggagtaaggcagcctgaaacctcttgctcctaggtcccatagtctccactccccttccagctggaaatttgtgctgcaaccagaggaaccagaaatggggtgagaaaacttaggggactgggttgtaagatcaaaggctggtcttgcagcagtaatgacagttcctaggggcactgtgacatcattgcattccactcctcccaggggaggggaccacatcagcgcgatgcccgagtcgctgctccacgatgggggagggaaacacacggtttcgacccaggtcctcagagacgccagcccaagaagcctagggaggtcgagcttggggcagcaggaggggagggcagagtctgcagtagggagccccgggagtcaccagcccaaagccacccagggatgactggtgagggcagggcctggggctgggggacccaggtcctgggagacgcaagcccaaagagcccagggaggttgggcttggggtggcaggaggtgagagctgattatggagcagggagccccaggagtcacctgcccaaagtcaccctggggtgattggcaagggcagggactgggctgcttgctgaaggggtggggctgactgactaggctttggttgggggagcccagaggggctggggttggggggccccatctggtatgcctcaggagtggtatggactctggcacaggtcttgtcatcggaggggatctgtggctgggttgggggccatgacctggtgtgttttacctttttcttggctgcggccaatttcccctgttgtgttttttctgacatcgcggggtggggagggaggcggggttggggccacatcagcgaaataccagtgagcactgctcaatgcctccagtcacctaccaggcagctgtgcaactgagccacaggtggcgtaaccagggcaccaatggaacgcagaataggggcgtggccttaatgctccaagcccattggtcagtgagaaagatgaaagggaaaggaggcgtggccaggcagcagcatgtccagagggacctgtggcatcataaggaaagctgcccatgcaaccgctgtccccgcccactcagagaaaggggaggggccgcccactctgggagaggggaagggctgggttttgctttaaaacttttaaaactgtaaaaaataaactttaaaaaatatatgtgtatatactttatatatatgtgtgtctgtgtgtgtgtatctatgtgttcctccagagctgtcttcattatgcagcttctgtgcaaagtctgtgattttggcctatatttttcatcttcaaatggagtacaagaattaccagtattaccttaactgagatatagatcctataaaaatggaaaatccatagcatgcttgatgattaatgaagccgactatagtatccgacattccaataagacaaaataatcacaacaatttctcttttttggaaaaatgtttgtcttattctcctacattattgttaagatttcttttaaaaacaagaaacatgtctaatatctttaaaaacacaaagcttttgggccgggtgcggtggctcacgcctgtaatgccatcactttgggaggccgaggtgggtggattgcctgaggtcaggagttcgagaccagcctggccaacatgatgaaaccctgtctctactaaaaatacaaaaactagccaggcgtggttgcgggtgcctgtaatcccagctatttgggaggctgaggcaggagaatcacttgaacccaggagatggaggttgcagtgagccaagctcacgccactgcactccagcctgggcgacagagcaagactccatctcaaaagaaataaaataaaatacaaaataagtaagaacacaaagctttcaatttaataaccacttaaagctctttactggtttaagagaattacaaggcccatttttctagaatcacctggcctctctaagccttgcaaatgaagctgaatttctcacttgatacttggctctcacttgcagtcatgaaaaccaagaatttgttatgtcactgtgtattgcttgttacctgaaatccacactaggctgggatcaagggttgaatctttcatgattttctccataacctgtgtgcttcttatcccacaccaaactaagctttttttctagagctctgcaacttacagttagtatatgagagcagttctcaaaaatgtagtctctggactagcagctccagcagcacctgggaacttcttataaatacacatcctccggccccaccctggacctgatgaatcagaaactctggagtagggctcagcaatctgtgctgcagtaatccctccaggtgttcaagaacctctggcatacagcaggtagaaaaatgtgtttccttctgtaggtccaaaaccagggatactatatgttttctctatatgaaacaatgacgtgcaattaaaagacataaatctccttcctgctcccaccttccagccaatgtgttttatttttatgagttaaataagaaaacaatcagagattttgtctaaatcgcatatttacaggtatcagttctcatccagcctgatcttatccaatatcatttatattctcttacatgtgaagttttagagaaggatcttcacaatgtaagactcaggcacactagcagttctgtaataaaacaccaagtagatcagaatgtccaaacttactggagaagaaaagtggaatcattggctatattttcaaattgcaataaacaggatattaaagttttgaatttttttcaccttcatccttccacgttaatagaattaagccaaaatacttgtcttccaaagcctctagccaggcaaaattttactatattacttcttgcttttcaatggctataaagcagactcctggtaggcacatttggtatacctgcaaagatgaagaactaaacagttccatctgttcaatactgaaacaaaagtcctgcaaacctcggatggtgagtgtaatacttcagcactagcaccaaagcctcaaatatgaaaagataccaagaacaccactagcaaacaaaactaaactctcggctgggagctctagttcatgccgtaatcccagcactttggcaagcaaaggtgggaggattacttgaagtcaggaattcaagaccagccttggcagcatagtgaattcacacctctacagaaagtttttaaaattagctgggtgtggcagcacacttcctggggcagatgtgccattgctggaaacttctctatggagagtaccaagtacttctacctgtagcattttccctggctggaatcctgcaattatcacagtagcccgagatccaagaaggcagagcaggagcatcctgtcccctccccagcaggtgcaagggaggctggggggtgaggcacaagcccgtgggagggtgaggagcaggagggatgcatggtgagcctctgttgactgcttgctgcctcagctggaaggtcaggaccaaatgtctattacaggttaaattacagaagtatttcagattttggatttttttcagattttggaattcgaaaatctgaaatccaaaatgctccaatgagcatttcctttgaatctggccttcgaacatcatgtcggcactcaaacagttttggattttgaagcatttcagattttggattttcggatgagggatgctgtattatcttctgaatgaggccactcattcaggaaagcccagagcttggggacgtggagctgcagaccaaagaggtgatttctgtagtggctttcagtgcggaagggcctacaaagtggtttaaagcaagccacaaaataggaaacccaatatttagctaatggaactctgataaaacctgctcaagatgtctgtctctactaattcagatggagccaagccaaagcatcattattattttaaaaaggcaccaatccctctgcaaaagcactgaattatatcatgatacaatcatcaattgtaccatgaatcaccatcagcggtggtcttttagggatatgaagaaggggttttcacaatacatcgcatgacacaccatcttccaaatctctaaacatttctctccacagcccagtcctctccatagttgtccaaatccctccctcttttctcttgttgtctccaaaactcaaaaccatgctctgactttctatatcccgccctccccttcttggaccatctgggaagccccctgcttccccagggtgtcccctcctccccttctgggatcagtcatctttcctcaaatggaccagttcggcctctcttagtttctccaactctgcatctcaacctttctcccttcactacacaataatgtccaggaggcaaagagcccacaaacctgggaacctccctttccagaagggaggttctggaatgactacaaatatttggttatgattttcttccctgccacgcctgttttcatgggcagtgctgagccccggtcctggcagagctcagaaccaggctctcatgagctggggcaagtggggcctagggaacctctgggttgaggaccttgcaccccactctgcagctgccctgctgatttggctcatgcaacctctcctcctgggctcaagcgatccttctacatcggtctcccaagtagctgggatttgggctaccacgtttggctaatttttgtatcttttagtacagatgggggtttcacctgtagcccaggctggtctcgaatcctgggctctagtgatctaccctcctcagcctcccaaagtgctgggattacaggtgtgagccactgcgcccggccttgtgccagcttttaaatatcaacaaggacaaattagagaacagtggaagagggtgagcagcatgatgaggtgatacagaaataatttcacatgaagaactgggcatgcctggcttttttttttttttaagctattctgggttggatgctgaggctcacacctgtacgcctgtaatcccagcactttgggaggccgaggtgggtggatcacctgaagtcaggagtttgagaccagcctggccaacatggtgaaaccctgtctctactaaaaatacaaaaaattagctggaattggtggcatgtgcctgtaattccagctactcgggcagctgaggcaggagaatcgcttgaacctgggaggcggaggttgcagtgagctgatatcgtgccattgcactccagcctgggcaacaagagtgaaactctgcctcaaaaaaaaaaaaaaaaagaaagaaagaaaagaaaatatatctatgcaccagagctcaacactaggttaggagcatttctgagatttggagctattcaaccatggaagttcctggcacatacatcaggtattcacaataccctttctcaggtgtttggtcactgctagtgagcctgcctggatcagtgtttcccaaatggcagtcatttgcatctttgcattttttttggggggggggttgtgggggtatataccataccagattttttaaaaattcacattaaaaatacatgtataaaatgtgtaaagtgcactaatctaaagtgcactggatgtattttttattgatgtacatacttttgttatccatcacccaggtcaaaatacagaatcagcaccacagagggttccctcctcctccttcccagccaataatcttctcctcctacctaaccaactgttcttacttcaatcactgtcaactagtattttacattcttgaactgcatataaagtgtctcaagtttcacttaacacttttcttgaaatacacttgttttttgccactttttatttgacctaagaagtaacattaatgaaacaatgatttgacgtgataggcatttccctcctaatgagcactaaaacacttaactatttgaaaaaagaagtttctccgtgtaccagctaatatattctcctcggccgccgttggtacacggaccacattttgtttctcaaagcaatccgatgatttctgaggtcctttgcagcttgaacacggaacgactgtggtgatcgagtagccaaaagttcacggaatgcactgtcacaattgtgattccgccatagcgccgtgcatccatccaacacttgtttaatacctatatttaatacctaataccttagactgtcctaggctgtggacacagaagactaaaccccacttcctgagttgaagtgggggaaatagaggagtaaatcatttcacgatgtgtggttaaatgctacagctcaggtaaccacgagcacacagagaaagggcagtttctagaaacagggcggagaggagaccgtgagtgggcatttcccagagcagtctctgccagccaccctgctgtgatcactttgccacagagcagccccggcggtcaacctcagcctcccttagcaacctgagcgccccgcccaggtgccttactattggtctcgtggagcgggatgggcagctctgccgtgcaatcccagctcgcagcccttgccccgcgtgtactcacgggaggactcgcagacgttactgccctcttgcgtgccccggccacccccgggcggcttgtagccggtgcgcggggtggctggggctacgtgcagagctgtcgcggagccggaacagcagcggtgaagcccctcggctcggccgagaccgccgtgcccattgctcgcctcggttgccgccgctttagccgcagccgctgctgccgccgccgggggagaggcagcctattgtctttctccgcggcgaaggtgaggagctgtctcggctcggcccgcgggggagccccgggagccgcacggtgagagcgcaacttagttggcggagttgggggaagttttgtgatttgaggaggggtcggggtgcggagcgcggcccgtcccctgcggccgctcggtggggcgggccccagaggagggtcgggggctgcgcggggcttcaggggcgggcggcacggatgggtagccgggcggcgcggggacctcagctttgcggacccctcctccctgcgcatcacccttctcccgcattgtctgcttggggctcggcgcgcctcccactccgcagcccaacttgggggccgtcgccgctttccggatggggggcgcgcccggcggcggatggccccgaacccttgccccgggtccccgggttggcgccgctggggcggactcactcctcccctggggcgggcggccgcggtgtggagtccgcgccgcgaacaagtgctgcgggcgcgagggagcggttccccggggccgacgcggacggtaaacctgtccggcggcgcccgcctgctggggcctctccgctgtttctcgcgggcgcggcccggctgaaactgcgaccgtcggaggcgagcggccctctgggacccgtgcagccggtccaccttgcagctatactttgagactaaacattttttttttttttttttgcaaaggcaaaccggtatgtgaagttgaaaaaagcaaaaaccctcaaattttccttctttcttcttcttttttttttttaaatcaagaaagggggtagataggtttgttttgttttggaaatagtttttatagcagagtgataccgtcacatttaatgatcctactgtgaattcaggaattcacgatgaaagttggattgagcggtattttggtgttcattctttgctgatactcattaatgaagttagttggagaatttattgcttcagtacagtaaaaaccagtgtgcctttttttttgttactactcccccctccccgcattgttttatttttcgaagaagcactttattcagtttttctaagccacgggattgcccagatgaggaccaacggtgcagttcttgaaaggtcattattggcaagtttgtgagggagctaagatgagttgagataaaccagtgttactgttcttgtattctgtcgtggactcttggggatttgcaggctgcattaagtacaagtctggtccagttttgggtgcacgtattccactgaatttggttcgtctggcttattatatgaacatgattctgtttcacttccccagatggaactagcttaaatgtctatcatttatagtgacaaatgatcaaaatggctagagtgtcatttattaacttcagttgtagtcctttaccttaccttctgctaaatgaaaaagaaaaatttgacaaatactgtgtgcgtcagtttgctctgagtgatttctcgtgctaagtgagtcctgtggagaagcgttcctgggcttttctggtttggtgggccttgtgttataaaaccaattttcttcacctgatgaagctaaagacaaattttcttcaggcacaggcattgcccttttaaactacagagccacttgtaggattcacaatactcactcaatggcttcccttcctggcagtgtggttttgtgtgtgtgtgtgattgtggggaaggaggctgacagaggttggaagggattgtcagggagggacatcatgtaagcaagtactaacaacataacgtgacgagggcaccagttgctttccttctgtgggcggtgatggcatgttatactgtaggtactattgttgtaggatttctcacagttcgtttgccttgactaaatggtaactgcacacatactatactataaatggactcctcctctagtcctttaactccttgagggctgtgatagaccttatttaactttgtaccctctttgccagtggttttaacatagtgcaggcccggtatgtgtttgaattgggtaaattacttttactgcctagtggtagctggtgtacacaggagagggccaccaactctggggacttgtccaaaatgacaattcacttgcagatctctgatgaaatttactttaaaaggacttctaaccttttttttaatctgtcggttattttttgaaaagaagtggggcttaactagtgctctaaggattttaacaagagattccgatttagaaatctgttcccccttttggtgaaattattattttttttagagtcagaatcttcactgttgcccagttgtctccccgggacccaagccgtcctcccacctcagcctcccacagtactggaattacaggcgtgagccaccccacccagctggtgaaattattaaaattgtagtgaaaactctgcctccattgtgaaattggaaaaaaattagaaattttagaaaaaagtacgccctttggagctaggtagagttcagatccccacatttccattgagtagttgcatagcctctcagagcttcagcttcctactccttaagggttagtaacatgctttgcagtgttgttaggaatcagtgaaactgtgtgagatacttaactgcagtatctaacatggagtaggtagctatttcctggtagctgtaatgataataattttgatacgtttttacatgacttaagcattctgaaaagtctgatgcttctgagtatggaggcttagctatttctttcataaagaaggggccctgagacttgtgagtcttatccaaatgcgtttcttcaaaggtgtcagatgaactgaaggataatggaaacaatagcaaatttatcttctcagtcacctgtgagtcttcctttgagagtgggacttgcagagtacttggtagggtagagctctttgtgactatgctatttaggaaatggtgagagatggattgttttcagtacatcagtcataagaggatatgagtgagttccaactttccttattttaccttagtcttgacaaataacaagtatggattatgtctgtatttctcagacttgtttaaggtagaactggactgggtgttaacagtgttagttcagcagagacatgagcaaatcactcacttccccttcaagataacactttaaaggtgccaccatttgcagaagaaagcagtgatttaaagcagctatactagcacagtttagaatacttacactagctgatggagtagatacattctagaaatatttacctgtagtgggagttgaacagtgagaacacatggacacagggagtggggaacatcacacactggggcctgttgggggttggggggctaggggagggatagcattaggagaaatacctagtgtagatgacgagttgatgggtgcagcaaaccaccatggcacgtgtgtacctatgcaacaaacctgcacgttctgcacatataccccagaacttaaagtataataataagaaagaaaaataaatatttacctgttaaggacatttctgtgtattttattccatctttccaatagttttcttatgaagagattatagttaacctttgaacttaacagattgagagggtaaacctttaaaaaatatatttggtcacacttacagactgagggtaaaaacattcctgacaaagctaggcgaagacacttggacttttttttttttttgagacggagtctcgctctgtcacccaggctggagtgcagtagcacgatcttggctcactgcaacctctgcttccccggttgaagcgaatcttctgcctctcccgagtagctgggactacaggcacacgccaccatgcctgactaatttttgtatttttagtagagacggggtttcaccatattgaccaggctggtcttgaactcctgacctcgtgatccacccacctcagcctcctaaagtgctgggattacaggcatgagccactgcacccggctgaaacttggacttttgatgtttccttcttttaaagttaacatctagcacttgaatagacttggttattactgatggggacaggcatccatttggaagtagcttccctctctctctctttcccaggttaggctgtcttattgctgtaaatggggagagaagagaaagccgtgggtggaagaaagtgtttcatggcctggtgcggtggctcatgcctgtaatcccagcactttgggaggccgaggcgggtggatcacttgagttcaggagttcaagaccagcctggccaacatggtgaaaccccgtttctactaaaaacagaaaaattagctgggcatggtggcgggcacctgtaatcccagctacttgggaggctgaggcaggagaatcacttgaacccaggagatggaggttgcagtgagccgagattgcaccacttcactccagcctggtcgacagagcgagaccttgtctcaaaaaaaaaaaaaaaaaaaaaaaaaagtgtcccactcagttgcccaggctgaaacgcagtggcaggatcactgctcactgcagccttgaaccaagcgattatcccacctcagcctcccaagtagctgggatcacatgcatgcaccgccatgcctggctaatttttttatttttgtagagacagggtctctctgtgttgcccagcctggtctcaaactccctggatgaagcaatcctcccaccatggtctcccaaagtgtagggcttacaggcgtgagagccaccatgcccagcctgctggggtttttgattgacattgcattgaagctggaaatcagttaggaggcaactgacattttaataatgagccatgaacatggtatatctatgtatttagaccttagatttttcgtcagtgttttgtagtttttagcaattggatcttgcttgcattttgtaatcttacacatttatttcatgtttgtggtactgttgtgaatgatacttctcaatttccagttggtgattgctagtatataggaagatgattttatgttatatgctgaccttggattctacaaccttgctaaactcatttttagtactagaagcttttttgtagatttttggaattttgtgcatagacagcaatgtcactggcaaataagggcagtttaatttctttgttttcactttgtatacttttatttccttttttttttttttgagacggagtttctctcttgttgcccaggctggagtgcaatggcgtgatctaggctcgctgcaacctctgcctcctgggttcaagcgattctcgtgcttcaccctccccagtagttggcattacaggcgcccgccaccacgcctggctaatttttgtatttttagtagaaatagggtttcaccatgttggccaggatggtctcaaactcctgacctcaggtgatctccctgcctcggcctcccaaaatgctgggattataggtgtgagccaccgcttccggcctaagaggacacagtttctttggcttattaagaggtatttggttagtgttagaccgggggttggtacattatagcttgctgactggatgtaccatgctgcctctttttataaatgaagttttattggaacacagccacacccattcatttacatattgtttaacagagaccatatgacctacagaccctaaaatatttaccactttgcgcttcgcaggcattttgctggctactgctgtggacaccaattttaatttaggtagataaacttttttgtagcttctgaggttttgcattaatttgctcaggcatataggttggtggaagtgctttctgttccttctcccaaaccaatcacacagccatataacttcatgcctgagtttctgtgtggtcctctatagtgagtgagtttttacatacttctttgcagcagcatgaatttcaaaaatctcaacgcttttgctcttgctaatctttgtaaactttgtacacccagtgctggtacattctgatgatagtgcccacactgcactctatgaagaaaagactgatgattgtttatattaaaatgcaggaagagaattgtagcggcaacttttgcttctctaatcagcagcatcataagagacttactatgtgtgggcaatgggggaaaacgttaatttatacattgagatagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatggagaacactttaaaaataataacaaacattattataaactaatatatgtgagagtacttagttgaaacaaaaaggagttttagtagacagtattatactacatttgaaaatcaaggagcagtttatgcaacgtaaaatgtttacaaactgcagcgcaatctactgtttgtgactgtcaaagtgtcatgaggaaagtgtctatacaatcacagagttatatttcctcacaaagttctttacgaagagtgaaatatgtttttatacctctcagtttcagttagaggcatattttgtgtaatatttatggcttaaaatggactaaaggtcctgttcttgccttgtctgaacttgccgcttttgcattctttgagttcagtttaaagacacttactttaactccattttaaaccctcgggctagaaatcgtaccactgttaattagccacgttatttggtctaacagtttttgtttatcattctgaaactgagcttatctaatacattgataaattatttcaaaggtatttttatagttcaaatcgcttcacttttaccctgacacgtataaatgactaggaatgaccttcagatagcgtttagcaactgtaaccaatctgacaataatgtgttcatcaggtacctgtggattaaatcacatactggcatatttaagctgaatgtcagtctgaaaaataaatgtactatattaattcaaatacgactctttgtgtaggtattttgtcatatgtttaagaaaaagctaaagagaatggaaatcctatgacaataactcaagtctttcttcaaagtgcatgcagtcttttgcagtacctcattcagccaagtatttgttctctacctcattcagtataaggcagcctttaatttgcttagaaggcaacattagaaggttagagttcagcaggaacatagaattttaaaatgtgacttcaactgaataaatttgaatttctgtagggagtaaagaatcaaaacacctatttaaagactgcaaaatatgataattatttttaaagtaattgattaaacctggtaggttttcccaaaatgaaaaacaatcagttctaaaaccaaagctgatttttagaaaatgtgaaaatgtaaatcaaccctatccataatagattctctaaaactttatcttacagtcactttcaaataactattcaaaaatgtaactgctatattaacgtcttaaaataatttaaaacattttaaaatatgaatactgtagtttaaaacaaagaatctaggggaaggaaaagtagacaaagaaatgccaattccagtccaaagctgtatttgccaagttttcttagaatgacttttaccgatttatgaattcttatacacagaatgcataatggaaatactgatttttgtctaaagtggcattattgactgctgctgtgatgctactgtaatgtaatacattattaaattgtttcaaggtgctgttttgcctaaaaattttgtgtgtcttgaaaactatagtattgggtattgagactctgcaaattctcggcatgcttggcatgaggtaatcggtttttattcttacaaaattgtaactatgtaagtgtgtttattaaaagaacacaaactaaaaaagttaacaggaattaaagttgtgggatgaaaaagttacaggataaaaaaatactgtggaaaagtggcaaaaaaaagttgtggaaaaaaagtaaaaaaaaagttttatgaaaagttattttaaaaagttatgaaaaattagttacaggatttaaaaaaagtcatgggataaaaataaaaataaataaaagcaggcccctgtcagcataagcctggagaagtgggtctggagtcttcacccccaccatgtccctacaacccctccccagtcagccctttaccattagggtagcaagacaagacccctgtctaatggagggagacaaacagaccctttaccaccttgaccaaggctgagtccttacatttctggatgatgatgtttgttatttaagagccagaggttggtggagttggtttgtttggaggaggtctgacggccttcttactctcaccaaagcaacttttccctcaggggggctcccatcttcttactcagagaggcagctgaggcgggacagtggagttaactgtagaccaggccagggcacaggctgctgggggtggccccccttcccccgtgtacatactgtagctgtgtaacattctgtattgtacctagcggaggttgcagctggcatatgaggaagaggttcttataattattcgcggctgggaaacttattcattgttagcataggagcgatgatgggggtggggatggcgtcatggctccctggtgatgggaccccttttttgttttgttttgtttttttgtttttgttttggttcgcttttgattttggaataaatggatttagccatactgctcggcctggcatgttcgtgtttccctcactgggtcctgcagtttttcccactcaatgaggagccccagagtgtctcagcatgtccagctgggctgtggggaatcttccaggcctgttacctgtatgctgcctggtgatacctggtggatttcacgaggactgccatggcgcctctggagtatagtccggccctgagagccaacaggttgagaagcctgatctagctgtggtcaggaagacagataccagtgcccaagggcactgacttccatccaccccacgtgtcttccattccgtccccctgcctccctctcctgtctgcaccgggtggcctgtctgtccctccagagtgccggctgccccacaggctccttccaggctgagttcagggccctgtgccctactggccagagccggcttcacagaataagagccagctaagctccagggactttccaggaaaagtgtcccttgaaaagggtgtgaccttttcactgctgccaacagcaccctaaaaatggcttggcctcttccctcccctgagctccatagagaacacagccagcagaggacacattctctgtcattcagaaatgggtttctcagccgagggacagcaggactggtagagactgtcaggccacacagctgcctgcacagcaccgccatgcttggccagaagggcgggagggatggcgggggctggctgtccataggccgcgcatgtcccggaagctcactggaggtggtgcactttggaggggcgatgtcaggagacagcttcctcttgctgggctacaagactccacaagcacagcacggggactgattcccagtgctagaggcgaggcagtcgaccacatgtatatgtgtatatatatatatgtgtgtgtgtgtgtgagtttgtgtatgtgtatatatatgataatttatagctatttatagaacagggcaggggcataccacagagggggcacaagttttcagcaacggtcacacctggatgtgtcagctcaccactacaacagactaagtcacagaagaagggggctggctttggggctgggggagccactgtcaagtcacaggacacccacccaggcaggcttggaaagggaggtctctgagaagaggaggaatctgtttagaggtcgaagtggggcctggggctccccggatgggatggacttgcctgacccaatcagctggcagttggagagaaagcagagagaaaacgggttagagaaaagccagagctggtgaggcaagtgcagagtatgggtgcgctgcagcagctgtggagggccggggaggggagggcgtaggtgtgggcatggcaaggttcctggaaaagaggggctggaagggaaaggggagggagatggagggagaagccagagcttcataggtagtgcctggggactgcggcggccctccccaccccacacacgctggcctctttcatggcacccaggcagtccacccatagttcagacgaatgctcagccccctcgggcttctctcttctctggtcaccctgtcttccaactcacggcccagggccacctcttgcttggggagccccacccaacagccaccaggcctgatagaaagggaacactgcttgaaccaaaaatggtgaagctataagggatggatgactggagtgagtgccagaggcccctctgggtggtccaaaatcccagggtcctctgaagggaccctggggaaggcagggagggcaggtagctggatgccactggccatagacttataagtctaagaggggagcctcaactggttggcgggcgtggggctgcaggttgcataggtgaggctgggcccttcctgctgggaaaagcagaagagggagagtccatggcaggagaggcaggtgggctcgctaggcggagctcagctgggccagcaggcactgtggtccccttggctgaatagcacaggcgacccctaggagcaacaggccaaggtgtgtgagcctgctggtcggcgatagtgattcagcgggggccagggaccctgccttcggtcacacactagcagctatggtggtacctgggagggagggaagggggctgtgtgtccccgcctggcctgtggagtgtggagtgtgttgtgggatgaccgtgtgtatgggactctcacctagataccactggattgccgacagatagatgaggtggggccctgactatcagccctgctttgcagtggatttggctctcagcactcccaggctgggagctggatacctgccctggcagcatgactgagactgcacgacaggtatggcatgcccaggatgatgttcctagggactggttcagtgtgtgggtcaggagcaagtcgacaggccctgctccttaccccttggaagggactgccaccaggggcagttctgactaaggcctgggaacccatgactcagagcgtgggtccccaggtcttgctgggccagcctggctgctgcagacagacaggaagcacgtctgacgctcctccaccctcggtcagcacagcggggctgggactcacgctagccttcccaggaacttgctttcctgcgtgaactctggcaggctgccctctctgtgcaaagccatagctggggcctgcttggggccctctccctctttcacctgctcagagtggcctggaacttggaggtgggcagtcggcgcctaggatgggcctgtgtcactagggcatgtgtccttgggccagttacttcctcttagggccttgggctcctcctctgagaatggggcgtgttggtgtgaaatgaggtgagcatgttgatttgaggagcagcaggacagacacctgcaggcagcccccctggccacattcccctccctcccttccaagtcctgggacagacgctcttcaccaaggggttcagcctctgatgctctttcttggtctcagtccctaaggagtaattttttttcttttcttttcttttctttgagacacagtctcctccctctgtcgcctaggctggagtgcaaaggcgtgatctcagttcactgcaacctctgcctcccaggttcaagcgattcttcttcctcagcctcccaagtagctgggattacaggtgcccaccactgcacccggctaatttttgtatttttagtagagatggggtttcaccacattggccaggctggtttcaaactcctgaccttaggtgatccgcccacctcagcctcccaaagtgctgggattacaggtgtgagccaccgcgcccagccaggagtgattttcagtggtgtcctctccatccccagcatacacccagccctgagtggctgcggctgccacatgcaggctccagggctacatttgcctttcgtccagggttgtcatacgctggagagtagaatgtgagaggtgacccctgtaggctgcagggtggcctctctgaaccttagtgtcccccacctgtagaaggggcgtaacaccttccagggggagggctgaggaggaaattgtcaacggctgagtctaaggctcacagccagaggccagggtcggatccagggctgggcctgggcctgggaggacagtgtccgccccttctccagcctcccgcccctggtcaggccaggaccctcttcaaagcaccttcatgcccatctgttccctgctgtgggcactactgtctggctccatgggactagattttatgggaggggaaggggctgtgggtaggcaggtgccaggtgctggaccatagatcagcatggtaggaacctgttgcttgggctggtggtgggaaaggggccaacccaaggcagtggcaattagcccagccctatctctgggcacagagatgaagggacacgtggggacacagtagggcaaaattggccagcctgctcttcccctctctgcccgctttttgcagaagagtcaacagatagaacagacagagccagggaggtgcccatgggggccccagtccccaccactccagggggcagtccctgcaagtgacaaggtgggctcaatccctgtggaacaggtctctgaggaccacagagtggggccccagggaaggctgggagcctgagctgaaggcaggcagcaagtaagggccaagctgtgcccctgcccagaagaccttcctgcccccagaaccccaccctctgcagacaggcctccctgggcagcagccccctggcttccgaggccttccgtgcctcaccagatgccatgctctcagggactcgtttgctacgctgccccctgcagatctgccccagaggagcaggtgaaaagccgcgcctgccgaggtgctgcagcggtggagttttgggcagaggggtcgggggaagagtttctcacttttaagattccccaaatccaagatgaagtcacactgtgctttagaatggtagatgctcatttatgtaaaatcataataaatgttacacaaactgttagaataaaaaaatacctttttcgagggggaggagctccccagcctgccgctgggtagtgagagggggttagcaccattagggcgtagggggcgggagctccgccacagcccgtggtgggcactgaggtctgtcggtcggtctgtgcatcctggcaccgtcagtggcgggtgacccgctgatggcctcgggagggggagccgtggctgggcggagagcacgagcggcagcactgggtgcggacggtgggcagctggcagcggcccagtaggcgcagtgtctcacagaacccgaaggacaggcggtcccgctcacagcctggagtggggggtcagagaggcatcagaaccagtggtttggggtatccagaacctggctccccaccccaaccacctcaaggaggctccagcagctccccaccaagcagagagccccagtttctggagcggctcccaaactggacttgcaggtctccaactgttggtgtctctgtcccacctactcacggccgaccccaggactcgagaacgggcgctgctgggctgaggtttctggaggaaaggtcctgagaccgcaccctgaccccctcacatgcctgttaaagagcctgcccagggcgacgccctgccatcccatctccatccttgctcacccctggtgttccccgacagatcctggcacagaactgcggtcccggggcctcctgccaacctgcagcggcctctgcccccgactcccgccaccgccccctgccccagtgcatctgtcctgccagacctccgtgaccacctccagccacaggggctgtacacagcctcgggttctgagtcacaggtcgcatctcccaggccagcctcccacttcccaggtgggccaggaagcctagagagagtgggccctacaggctgtcagcggaaaccagggactaagcccaggcccagtggggagggaggccggctgcaggctgtggttgtcagggctgaggcttggctgggccctcctgccccgtggttatcagagctattttgggaagtggcttgtctccagcctcctggccttgctcctgatgccactgccactgctgacagcccccacctgccgcctgggccctgcttactccagcagacctccctggggaggaagagcaggaggacagcagccagccctgtgccagggacatccctcaggcccggcagagggcacgaggcagcaggcaggctcctccaccccagctccaggcagagctccaaagtgcacatctgcaggcctgcatcctggtcgcccggggtgacctcagacaagctgcttcacctcttgggccttggttccctcctctgtcaaccccacctccacagcaaatggatgtggccatgctgtgtcactgcagcgaccgcacactctggagtttcctggctttcccccgtcccgccaactgtcccacagaccagcaaaacatcctgggaattccaggtctcaaagtccaagacaccttcccagctgcccctccactgttcactggtggcagaaaactcctcacttaggacagcttctagttcagccacctaaccagcccccatagcccactccctgcagcccattcatacccgcccctgggagaccttacaagcccagagcctcctgggccatctgtccttggttctaggcccccaggggcctcagttcctgttctctgctccatctggtcctcatcccctgggatcataaccaccccactccctgtggccagctctagccatgaaggcgagagatgtgatgccagcacccagctcaggcagcacacaggagtgctctgagatgctggctgggtgcgtgctgagggcaggcaggacagggtgggggcactgccacttggccttgaggtaatggggtttgtggcaggaaggccacccctgccagaggcagggtagcaaggcatggcagcgaggcatggcaggggccactctgagcccaaatgagggctgcccaggagccagcgcaggtagagaaggcgcattggataaggggagaaggcagactggggagactgcagggggccccgaatgccagtttgagggccgtggctgaggactctgtcctagggtcagggggcagacagccaatagcacaggggccgcagctcttcaggccacagctcctggattccttagactggcagggtcagccccaggccctctccctgaccttgcaatgggggatgacagtggctttgcgggaggggaaaaagccgccttccctgagcaccacctggatccccacgcagtgctgtgcccttcatgcccagacctcacttatgcaaggatggggcttggcagcccctttattcagcacatgaaggccctgagagggaaatggagcccaaggccacacagctggtgaggggagcccaggtgacactccagggccaccccatttcctgccctcagcactgctgagagcagctggggctgcaggaagtgtgtgagtgtgtgtgtgtgtgtgttggaggtggggggttgggatatccagaaccacctctagctcaggcccttccaccaggacccagctggccaggaaaccccccaccactgggattagcaggaccctggaagggaggcccttcctgtggttccattgctcactctaggcagtcctctggccagggaatggacaggctagggctggggaggggacagggactcacccaggcccagttttcacacagcttcagggacatccctggtctcactatgggaagactgagacccagaggggaaagagcttacccaggttcacacagcaaatcaggggccaaggccactccctctactcaccggaggtcagaaagctgcctgcgggatgttgtgtagctgggacttctcttgactgactcccagcacagccaagcctccagcatgggatcctgtggcatcaggattttcagtggctcctgagcccagactacagatggagccagccggtgccgtgggtgcaatggtttgaagacccaatttccccatcacccttcccgccccacctcacttcagcagagagcttggggtcgggggactcacggggaggctcgacgggctcacaatcctcggtgccacacagccgggagctcacaaggccaggcctcgtggccacactggtcactgtcttcctcgggtagccccgtctgggtgttgacacacttgaccagtgtgtgaccactggatgccaccaccacaggggcctgagcactggggggagcaggggaggaatgagtgtctccagggccagccctagcagtgggggcagggacacctcctctgggaagccgtccctgcgccctgtgcctgactggcctgcccttgctcccagccgccctctcagtgcctcctggaggacctgttcccattcctagagcccacttggtgctggaaccccactctcacttgtgggatcggctgctgcagagggaaggggcatgagaaccatgggacagcccttggggcggcagggcagtgagcccctcacacgggacatgactgagaggcctgggcaggggccccgggatggagccctgatgcagcagtgagcagagacgtgggcgagacaccgctgtgcccgagggacagggcagaggacctgccgcagcccatgggcaggaggggtggagacaatttcacagccggggcccagcccgccaggctttgttgttaacaggtgcaggtctgaaagccctaaacatgtgctgagtctgtgccagtgtcgtgctgtgcccggccctgtgctttgttgcgttcctccatttaatcctcctgaccctcctctcccaaagcgtcccaattttacagatgagaaaactgacccagcaaagcaaagcaacctgcccagagtcactcagcagccagtcggacagactcaaacgctggcccagctgactcccggacccagctcagggcccaaatctgagatttctgaacccctcagttccaaacaggcccagcagaaggtgtcctgcccatacgaggcccctcttctgcccccttctgccgctggcctttgctgggctccctgatctccccaagctcatcattcctgcctcagacttcacacctgctgtcccctcgatccctgtccttggcatcactgactcctccctcgggtctcaaccccagacccctcctcggaaggccttccctgacatcacagcacacatgccctttccttgtctgtttctccctgtcaggtgtgagcaccagcatggcagggctttgtccagtgactgctgcatgtgcaggggccacagacagcctggctcacagcacacactccacagctccttcacccaacccaggactgaccaggcgctaccaagcacttgctccctgctcccccccgcagcctggctcacctggccccagggccccaccacccactgtgtgcaggggtgggtgttgcagggccgggtggtgttgggtctcagtgcctcctcgcagaggtctggctctgggcaggtcaccagacgctgctgctcaccaccgccacaggcctcggagcactgggtgggcagggaaggagtcagggcacagccagggtctgagggtgtcccctccccccaactcaacgcccaggcctcacctccctccaggaagacatgtaccagctgaggcagggctgggccccgcagggccagtgcacaggcagcttggcaggtccaggctgacaatggaagggccacagtggccagagggcccatgtgtccacatgctgcatgtcccacactgaggaacctctgccacagctgtgggagcactggggaccgagagacttgtgtggacacatccccacgtgcaggcccacaggcgtgaccccgtgaggcgtgtggcaggaaaggcatcagacccacgccccagccgggggcaaatccctgaagagccccagcgagaggccaaggctggcaggccccaggcaaaaggtggcatggccaggggctgccatgggctgggacagacagagaaagggaggaacaagtccagatggggtcaaagatacagaggaaaggagacaggccaagccagacaaagatgagatgactcccaagagattcggaatccggtgcgatcaggcacatagacatgcagcctggagccctccccttccctgccgctctcggaacacaggccgtggggaaccagggctccaccccatgccctggggatgcctgtcctggctccatcctcatgcaccttactccagttgcctgagtgccaggtggcacagggccacaggtggcagcggcgggcaggctggggccggccagcggggtcgcagtcctcatcccggctggagctacagcacaccggcctccagagggcacccaggccacaggtggtggagcactgcggggcacagacccgtgaaagccaggcagagcccatcctcgccaggcctccacagccaggaaactacccacctaggctagcaagacctcagcaagacaggggccctcttctgggcctcagtttccttatttgcaaaataggctcctccacccacctcccaggaagaccatgagaatgaaaagtcaaatccccccagcaaccagccgtccctgctcacatgggacaaagggcctgtgtgccagtgtcattggtgcagaggttcgggggaggagaccctgtgggcacccctgaccagctatcctgaccagcctcgtcgcttcccagaggcaccagggaaggaaggctgggtcctggtaccagcagccaaatcgctgcctatccccgcgcaaaacaagccctgtgggcctcagcctgccccttcccaccccaaaattaggaatctgaacagaagcttgcttctcctgcagtgaccatctggggacccagggagggggcactagccagcttctttcatgcagctcagacgtctgcaggtcactgccaaaggagggtggagccactgagggcagagccaggtagcagtgggctgagtccagcctggaggagccagacagagcctcagggaagctgctgcctgctgggcaggactgggcctggtggccacacagggaccctccccactgcacagctgtctgagccagctccatcctggggcatgctgtgctgccagagtgtgcctgcccctgccttccctgaggccccctgtgctgcccaggaatgggccccaggtcccctcattcccctaatcctgggaacccccgccccaaggaaggcgagacagacggcgcctgcgtcccactctgctcattttcagatgaggaaatagtcaccaaggtcctgcgcaaactccctgcccgcccagcccacaccacttgcctcgctccagtttcccacttgtcagccggcgttcctgacaaccaacgggtccgtggggggccccgcttcagccaggctgggaggcagtggctgggtctcaggggctctgtggctgttggcggggctgtcccaagctggcatggacagcagcctagagctcaggggcacctcagggctgagggactcaggctgacccttgggtcctgggttcagggcaggctcaggcgtgtgcccgaggccagtcagggttgtggggaggaaggtcccccacactgccacagtctgcaggtcccatgagcctggtcctggggttgggaaggtggaagtccccggctgcaggggactgtccttgcccttcatctctggcaaaggggctatgggaggaggagggagagaagccaccctaacagtgggccacagttcactgtccacaggccccaggccaccctccagagctgactcccaggctactgtccctcctgtccacagctccgccacgtcaggactaggagaggagtgggtgctgctgaccgggtacaaagtgggcagcgtggggctgggtctcgggggcaggtggggtgctccgcagcccttgggtccctcatcatttgaaaacctcgttggtcctgtcctgccatggagagggcagctggctctggctgtccttgccaactgggaaatcattttggctctcaggggcggcaggcgtctgcaggccatcagtggaaaccctgggccagggcaggctggggagcccaagatctggggcccctatgggggtgtcttcctcaggcaggaaattgatcaaagggttcccaggggtctgctctgagggtgggggtggggagcggccggcctggctaggccaagggctcggggaccaaggtcccgttgccccttcctccttggctgcaggaggctctgtggcaggcacagggctacccgtggagggcgcagcaggacggctgtgtggtgggggcgtccgatcccctgtccccgccaggtctagatcaggctcctcagaaggcccgtaaggacagatcctcgtggaagctgatgaaattgtagtcgtagtagaagtcgtccacaaacacgggccccggcaggtccagctttggagcctcctcctcaatggcgttgcccatggtgcctggcttgggtgatgaggcgggtgaagggcgtggggccaggtggcgcgggatgaagtcagcctcgttgaagagctcgtggctggaggagccgctgcctgagccttcagggcccagtgtgtccaggggccaccaacagggtggcagagagcaggtgacttcgctggctggctgctgggcctcgtcacaggggacaccggtgtcactgatgcagaggacatttcggtgctgagtcccttcctcatatgtcactgagcactgcaggggaagccagggtgaggggcttagcctgggaggcaggctgccaggggacgctggggcaaggctgggtaacctgtccactgcctgatgtcagagtggcagagaccccagccagccctctctggcccttcccagctcaaggccatgactgtggccatgcttgccaggggcttcctgatccctgaggctttagagtcaggggctggaccctggaatgcccaggttccctcccacccacaaggtctccaggaaggctgtctgcctccctgtagctgaagaccaagggtggggctggaggcgggcaccttcccatcccacactcacctgagaccagttccccacagcctacgtggccggacagggcacatggtggttgcaaggggtttcagtagggggccggggaaggtgttcacaggcgggtggcttcagggcgctctgctcatccagccccacgctgcggatgcagagcacagcctggcaggagaggcccccaggcccgcaggagctggagcacagctgccactcacctgcccaccacctgctgagggcacacaggtgtcatcagtatggcatcagacaggtggcattgacaggctcaccagcagggagggccaggctgggtttccaggccctcggggtttgggcagtgccagaagccagtggatgattctccagagctccaagctcaggtaagtgtcctgccctcaaagtctggtgacaaggcacagcccctccactcctgccaccttcccctcagggaaactgagcatgacctgaggcctatttccacatccagggacccaaagaggaggaccataggtgtccaggctggcccaggctggggtgagaggtgaccgggggttggggcttcagccttgggaagagaatgaaagcccggctccctctgctcctccctggggcctctggggacccagatgtaggggcctgtggcagacccaggatgcctgggggtggggagttggtaggggatgggggcgggctcacctggcagggcagggctgctggctgcacttcctctggcagtcatcgggccggcccagggggtcacagtgctcctcgtccacgggccctgcctgccgctccgagcagtacacactctgcctctgcacacctaggggccatggcgttcagcctgggactggcacccaggtgcccaccgcccaagacccaaagacaccctctctgccagaaccctcccagaacagcgccttactgcccatgtcaggatgccttactgcccatgtcaggatgaaggcagacctccaccgtcgcctccttgctgtcctcctggttctcacccaccccctctcctatgtagcttcccctctgactgcccctggaggggtggcagagtgtggaggtttagtgggttgggtgcccagaccctctgcatcctagctgagatgcctgggcagctcatttggcctctctgaacctcagcgtcctcctctgtgaagtgggagcaacaatcctgcctcctccatgtcctggagggaggactgcatgtgttcttgcatgtgcaggctcagcccgtgcccggcacatcctaagagctcgatccatgccagctgctgctagcatgcaaacccagccgtggctcctgccaccttcccctcagggaaactgaatgtgacctgaggcctatttccacatccagggacccaaagaggaggaccataagtgtccagggtggcccaggctggagtgaggggtgaccggggtctggggcttcagccttgggaagagaatgaaagaccagctccctctgctccttcctgggattggcttgggtgatgaggcgggtgaagggcatggggccaggtggcgcaggatgaagtcagcctcactgaagagctcatggctagaggagccgctgcctgagccttcagggcccagtgtgtccagggaccactgacacacggtcccaccatccacacccttcccaatggatcagagaatgtctggacaagaaatggggcatcaatggacagcccctgctctccatccccacaccagccttggcactgctccagtcctttacattctctgccactgtccaacctggggactttgcacagccacgttcctcaccttggacactcacttccatactgcctgttgaggcccagctgcaggaccccgtctgctggtggctctgccttctctgctccaccccctgccccgtggtcccgagagtaagttgtccctcccctgagctgccagtcccacatccatccccctctttcctcaccaacagagtctgattttgttcaaggcagcagtgggacctgctgaaaacacaccccactgccgctcccttgcaactaggggggtctgggacacagtcctggctcaggagaaaaaggcacaagtccctcgctgggagtcagccctttcctctctccttcttgcctagaacactgcaagagccctggaagggaggacaccatctgtggcaagcaggagtggaggggaggctgctatggcaaggatggtgtggctgagggccagtcagctccaggtcccgccagcttggactgtgcacctgggacttcctgcctgagacaaagaacccctgtctcttccagccaccacagggcacttgcctctgcagacgctcctaagtggtccacctgcgaagcagccaatttgctgaaaggcaattccccaaatgtctagtgctgcaaatgtatttgttggttttcacgtttgtccaattaaagacacctgtattaggccaggcacagtggctcacgcctgtaatcccagcactatgggaggccaaggcgggcgaatcacctgaggtcagcagttcaagaccagcctggccaacatggtgaaaccccatctctaccactaataaaaaattagccaggcatggtggtgcgtgcctgtaaatcccagctactcgggaggctgaggaaggagaattgctggaacctgggaggcggaggctgcagtgagccaagatcgcgccactgcactccagcctgggcgacagagtgagactccatctcaaataaaataaaataaaacaaaataaaataaaataaagacagctgtattagataaaatgggtttcctagctttggaaggtaactgcccagttctccattttcactttgtcatcataatagcatttgaaggaatgctcaaacgtctgtatatcagattcccgattctgagaccctgaggatactgagtgtcaacgatgggaagactgagggggaaaggggaggactaagagacaaagggggagactgaggtgtggggagatcgaggaacagcagggcagaccgagcagggggaggaagaccaaggggcgtcgggggggactggggggctggggggagaccaaggaatggcgggggagaccgagccgggggaggaagactgaggggcgtggcgggggtactggagggccggagggaaactgagggatattggggggagaccgaggggtatgggggcagaccgaggggtatggggggagaccgaggggtatggggggagactgagaggcatggggggagactgaggagtatgggaggagacggaggggcagaggggagactgaggagcagtggggaggagacaaagagacagagaggggagactgaggagcatggggggagactgagggaaatatggggaggaagagtcggagttaatgaaattgccctacttttcataaatagttcagggaaataagtcagtgtggtgaggggcctgggctggtctccgggacgcagcagaaatgcaggcacaaaacctgccggagctgagcaaggacaaaatcaagggggagctgtgtccactggagggagaacgccaagagctgcagcacactgagcacacgccgcgagccagcacccacctgcctcatccatttaccctcccagtgggcctgggacatggggcggttgctagcctcatctcacagatggggaactgaggctcagagaagcaaacttctaaacccatggtggcccagcagtgagctgggagctgaagccggtgtccctgtccagagatgaagcccctgctggcggggctgtgcctgccccacttctcacctctgccacaggtgactgtacacttggtccagggcccacagtgccaggagaactcgggcggcgggacctcgccgtggccacctgcctccctgtggatggtgtactcgtagtgcaccccagggttgctctcctggaacagcagctgggtgggcaggcgggggcccgtgagcacgaggtgtcttctccatccacccagtcttaaaggagctgaccccagccacctctgtgaactgcagctacacagttgggccatcttaaagatggggaaaccgaggtagaggcctcagcaggagggtctggctcagagccaggctctgtgactaacccagggctcactcctccaggacgagacctaccatgggaggtgctgggcctggggactccgcctctgctccccacgcctgggcctcgggaggcaggcacctggatccagacaggctccttggtgggacccggggacgtgaggttctcccagttgcccctgcgtgcgtatgtgacggtggtccctgccacctggtagtccccgttctactggatggtccagccaccattgaggaagtacttctccgggtcctcgctctgcagtgccaggaagttggcagcctcagccacctcctggatgcggacctcacgtgtgctggctgggatcagccccacgtccacataccctgtcaggcaagggttgtgcctggggtgagaagcttgcttatccccacctgctcccctcacatctctccccacttgcctccgcctgctgatgccaaagatttcgccattagctttaaagtctgagctccccaaattgctcggatctgtcatgggtcaccaaaaccttgcggaggtgccacaaatcctgaccccgtggccatgccccgtcactcctctcttggggacctaaactggtctcatcataaggctggatccatcccctactctaagggccggctggcattctctttctaaaaaaaaccaaagtgcccaggcctttctcctgggacaccctcctcatccccacgcagcctgcttttattcattcacttccatcacacccatcacgtgccgggcactactctcagcacttcacatgtgtaagctcatgggtaatggccctatagcatggtactattgttaaccccattttacagatgagcaaagtgaggcagacagggagagtaacgtgcatgagcgtcctgctgcaatataagcagcctccagggccagtgctttatccaccacactgcactgcatctctgggatgaaatctaagcttctcagcctggcactcaaggccccatagctggccctgccttcccttcttgcctccagggctctggcgcaagctctttcctccatttggaatgcccattccatctcttctgagttttatgattcagctcaacttccgcctcctgcaggaaaccttccctgacttccccaggccaggaccttcttcttcagtgctcccacagccctctgggcctccctccactgcactgatcacaccagaaggttctgtcccccttcaggactgagcgcttcacctgcatgtcctcatcacctagcacacagtcagtacttcagcaacatgtgcaaaacagaccagaggtgagggcatggagctgggggtctcagaagattcaggaggagacgaccattctttgaaaggcccaggggccacacacaagtcggggtggccctgcctggggtctctgggacaggaagactccccatggggacaggtctctgcgtgtgggccaggggtcccctgactcctgcaagaatccaccccagcaagccctccctgcttagccatctctaggctgggtgggggccacgaggccaaggacaggggcccgggggagatggggaaggggccaccaggtgaagagcacacccctccccacagtggtcccaccccatacccaggccctcggcctcctcgaaggtcccactcacggtgtggcaggtggagccgttgccgtggcacacgccacagcggtcctccatagtgccagagtcaatctcaaagtcacagccccacgttctgcaacacacgaggaggggaggcccctggtgctggcggccagccctctgtggccccagccccgggggccagccagggtcaggagaagaaagctgggagtgggggtcgggaggcctctctctggccctgccccaccccagctgtgcctctgacccaggtgaacttctctacctccctgagcctcagtttcctcagatgtgagacagggagacccacccctcccttaaaggcatgtcatgagcatcacaagagacaagagaagggaagagttctgcaaagcctgcgggcaggcaggggatctgacacgccacgggctcctgagcagcgcgtgcagggaatttcaacgtcaaaggcactgggggttggcacctccctcctggtcctcctcggagcccaggccttgataccccagtggtttagagggcaagaagcaaggacaagtaggtggctggagacatgggtaaagaggagaggccatcgttgttattaaaaataagaatataaattgttaccaaacactgaggcctactcttcggggctcagagcccttcatgtcacctgtgccacctcatttaacccctctatcagggagcaaaccactgcctggggtcagccagccagcaagaggtcaagccactgcctggggtcagccagccagcaagaggtcaagccactgcctgggctccggtttcctggctggggcggtgctggtgcaggcatccaaggagacgcagtggggcgaggcctgactggggggggtccccagtgccaggaggcgtggtaggggctttgccttagaggtcatagagggtaggggctgggaagcccaatggtagagcatggggagggtggcccgaggaggaccaggagagaacctggggcccgccagtggggctgggggcaggcagtgctgggagagcctcttcctaaccaggcacaccttacagatgccattgatgcagaggtcccggctggctcggacctggtagcagggggtgccatcaaccacggcgtcccgcagcttcttggcaaagtactcattcgcgggccggcagtgcagctcacaggggttcactgggggcccaagtagaagagtcatcagcaacagctggagcgggagtatggaggccaccaggaagacccctccgtgacacacatccatggcaggctggaggctcccaagcagcacaaacatgctggaggctccggctgggctggtagctatctgcaaggctgcagattggggagctaggggcgagcagcagccccaggggacagtgggagtggcccaggcttggggtggagactgggtctcctgcttgcatcacagggtaaccttggacccacaccccgctcgccgccctctgagtctcaatgtttccatgggaggcagcactcaccgtcattgaccatgggcacccatgtgtgcagctggccctcgtagagcatagcgtcaaagtggctgcactggacgtggcggaaggaggggcggccagcggggcaggcctgcaggttgcagaggcggaagcgcttccgcttacccacacagtatctgcctttgtatctgggcctgtggggagaaccggggtggaccccagtgagggcccagtgagtgctactgcatggccacagcccagagcaagcagcttcctcctgcacccacaccccaagatccctgctgcccagctttgtgcacgctgcttccctcccttgggttgcccaccctgtggcccagacacaccctccctgtctgtagggacctgtggggaggtggcagcaggaagcctgagctctgcccccaacctgctgtgtgatcgtggacaagtcttcggccaccctctgggcctcagtttcctcatgtataaagtggggttggggctgcccctgcagagggctgttgagaagctgggacaagctgcaggcatgactggcactggctggagggactaatccgagtctccagcccatgacaccagcatcctaacgagcccttgagtcctcagccttcctcctggtggcagtacccccagcctgggtctaaaggaagcgcccagggccccagccagctgaaaggtatgatggagcacagctcctgaaatcctccacatttaggccagggtcgctggcctccactcagctcagacctggaggccaggaggcagggaggggcacaggccagtcttgggtaagcgcagggccctgggtggggccgactgtgaaccccatgcctgccccgggtggcctcctgaagtgaagatcagccgggtagtgcctcggtctacagtaccactggcctctgcttctcaccagatcttcacaccccctgcgcccccccatttagatggggaaacagagatccagagaggtgaagtcactcacctcaggccaccccttcagtgctgtcccatcctcccagctgctccatctcatctcaggcccttgttgtgcctctgaggccaccaagcccctcctgctgagtgcccactacagatgagctgcagggctgaggggctggcctgcataaactgcatttgcccctgactacaactttactggatgggcactgctattatacaggtggggaaacggaggcccagagaaggggtgaagaggggattcgaaccctgagccatctaaggtccagggcccatgctcttccccactgccctctcctgcctccttccagccagcagctgctttgccacgtggcctctgctgagtctctccagtctctgggcctcagtgtccccctttctgcaaaggggtcagcagtggggaccctgtcagccctcagaacactccttgaaagtgactcaaggtggcctggacactcagactgaccattatgaggacacttctaagagccaggggctggcacagagccaagctcctgcaatcggctgactgcctgggtccctctgtcccattgcccagggcaccctgggccccacactcacataggctgcatgcactgctgcttggctctctgtatgcccacgccacagctccgtgagcagatggaccaggcgctccagccagaccagccaccatccatggcctcgggctggaagcccacaggtatgcactccccattgagacaccactaccgagacagacggaggtagagccaccccacccccaagcctatcagtcatcctcaccctagtgagaacaaggtgtgtgagaatgctgcaaaaggcacagaggggaaggatggaaggtgagagaggccccctcgcaatcatcacaatcatctgtgacccaggccacatggaggcgctgagcagggagtaaaacagcccacgtgctgactcagctgaagacaccctggagaatcatggaatcaagccctggccccaatgcctccactttgcagacgggggcttgggctgcagagggcatggggctctctgtgagccggggctgactccagggcccggtcacagcaggaggtctggcctctcacacatccactgccgggactgggaacatcgcctaccttattctccccacaccggatgccgtccacggctgcatccagcttggagtgacaggtggtccccacagagcaccagagtgtgtggcagacattctgcgaggaggagggcatgggccatagcctcaccccctccccagtgccgccacccaccctgcccccctccctgtccccaagggtccctgggcacccctccacatggcaggggcccacagacccccagaggtcccttcttgtgtgtctgctcccaccttcctccccagaccacgtggtggtgtggggcgcccggggctgcactgctcagagtggtcctcagctgtccacacctctcccggcccagcgcctcctctggaaacactcctgttagaagatcacttcaggcgatcttcgccaggataaatagaccctccccacaggggttccttttccctcttatgagccagctccagagaggcgaagggacttgcccgaggggtcacagtcggtccatggttgacccagaattcagagctgggtctgtggccgcccatccctggcctctcccacaggccacttgacgtctcacagtgtcactcaggggcgtagcccagcccaggcgaggttgctcccaagctggcatccacaggctggtgaaagctgtcccctaagccctcctgtcgggtccccacacccccacacccacaccggccccactcacatccatgtcctcgcagaaggcagagtaggccccatactggaggtggcactggtggctcacatcatagaggaccccaggcagcactgatgggaagtcaatgatgtccttggcaggcgggtcatccaggcacaggctccacccatggctagagatgggacgggaggatggaggggggcgcagcctgtgagacccatcggagaagcctcggtggggccaggagaggaggagaggtgggagggggcacagagccctacaactgtaggaaactccagcctccccgctcggctcagccgatcctccacctgcagccagtagcacaggccctcccagccaatctcatctcacctcctgggcactccagctggctaaacaaccccaaccccaatcccaggcctctgcacacgctgccagggcccttccctcagaaggcctcctggaccgccaaaccctcatgtggccctgctctccgaccctgcagcctccgtgtctgagcccagaccctggagccaggcccgacaaggatccggagaatatcacatcacagttgacacaacagagcctccgacggccccacccaggcagagacctcgggtcatctgtggaagggcaaggtctggaaagcagcccctcccctgggagagagcctagggcatccgtgcctgtcccctgtttcccccactccccaacagggctggcctccagcctctgtcataccctatctactcctgccttcctccagctggcattccctggcagcggtggcggggaaactggcagacacgagcaggtgccatctgtgtccaccacacgctcctgctgctgcggtgtggcgaagacaaggctgcccagaccaccacgaggcagcgagcgtggagtccggggccctggggagggcggcccaggcccagctggcacctgcttctgcccctgcctcactctgtacagccctcaggcatgctactgcttctgggaccagtgaccagcctgctgtacctgctggaccttaggcggccactacaacggcttagcagcaggagtgccctggcatgctgaccagcccacccacagctcattgctgtcctggaggaaggtttggggccctctgtggggcagcagtggctggggagaattgagccatgcagacatgcggggctggggatgacccaggcagccacgacttgggcagaagcatggaaggaggcaggacccatgggacctggggcctctagccaggcaggggagatggggaggcaaaatccctccagttctccagtctgggtggactcagggtaggtggtgccaggccagatggctgggatgagcatacagtcctgattgggacaggcagggggtcgcacagggaagaagggcaaaggtgatggatcctggagtccagcagggagagaaagagacactccgagatgtggagaggctgggagaacacgaaagggtcaggaaacagggccaagagtgctgaagacaggtgtggagagaggctaggagggtggatcagaccatggaatcccgaagcccagatttcagaggagggggcctggcagctgggagacccagggtggggtgggtggtctgtgtggtctcctaagtcccctggccagtgacaggcccctgactctgcccagagctgcggagaagaaagccaaggtgaccagacttctactgagaaccctggaatcctcctggaatcactcagactgcccatcatggctggaaacagatcctctaacatgggcgttggcagatgagcagctgctggatgcagtcctagtgcccaagatgaccacgtgccagactggtccagggtgctgggggcataccctctcatttgctcctcacaacatcctgggcagactctaccatcatcttccctcatgcactcagggcccatacgtcacttgtcccgggtcgcgcaagagggacgtgatggccaggacctggagccaggcccaggctgcctgcaccaggctgtgtctactcactgggctacccccagtgcagggctcctcccattcaactgcgagcctggcctcaaatacttcaccccacatacaagttcaaaaccatggcagcgaggcctggcagggagaaaggagtgtcccaagttctcctgcggcttggggctccctgagcctccctgggcctgcacccggggcagagtgtcagccgggggtggtggggtcagctggccctgggctccctccttcccgccatcattccgtggctcgaggaggtagactgggggctcacccatcccagccagggggtcctctgacccaggggctgaggggtccaatgcgcctcatcccggcaccaacagtccctgggctgcagccgagcccttttgtttcctggctgccccagtgctgactcgctgcacatgtggctcctgcaggcctgctgctgggcagctgaagccgcaacaacctctcagcccaccctggatgttgggagaagttgggagcataaggtgaccctcacagaatccactgccagaatcaggcccaggtgctgtcttgggagtcagaaactcaaggtggccgtcagccagcccttccttcctctggcaggctgactgccaggttctctgcactgccgacacacccggatcccccaaaccatcagcccttcccctccacgcccctcctgaagctaactatagcagggctgggcagtcccacaagaggtcaaagcagacagtaggtgactccagtcagaagcttcactctcacctcaagactgcaaagagctgcccaccactgacaggagagacatgtgggcccgctcccctggccacccctgggatctggtcatggagtcactgcatggggtgtccatggggtgaagtgaaggaccccacatgttacctagcctgcctctctccctgtagaaatgctggctttgaggaaaccagggaccagggcctcccctcctccccacccaggtccaagttgacactggcgaaatgctgtgacctctccccaaggtcccataaagcacctgtcagcccagaaaggttcttagagttcttcaggtcaaccctcttggacaggccagtctaggttcttaaccaccaaacaaaactcttctctgcttccaatcccaccccccaccccagtaatccctcttccactggaggccagtatccttgctcttacatccctaatggacctggtcacatccctgcttaagccccacagtgagtggacttctagaaaaacatggcacattgagcagacagatttatcgctgcttccttccaagactccactataatgacagtagaggaaataaacaaggcataaatccataaggggtgatgatgagtaatgaaggatgtcaacaagattctggaagctgggaagcagatggccaggcagtagctgacttgctagagtgatgaaagctgagagtcagattcctgcaggggggaaccacccagaagcagaagcccgaaaaggctcaggaactgagtttgcagggactcctcagggccttacggccaggagggctgaagacagtagggctgaaagtctgtaagaaccgatcagaccctagatcccctccccaaccctgagtagccaagtgacggccacctgccacccagcagagggccagggatcactccctggggagggtgaaccaggaggctctggcccaggaacggtggacacacatgaaggcccaaggcagaaggacctacagagaaaaggggacaagcaaaagtctacacattgaagggtaagaaacacgccaagcccctttcccacttggatgctggaatgctgcagccagacatacactctcccaggaaaagtcgagaggattcctctcaggaaactgaatcactcagaaaaatgacctcagatagtgacattagaggatctccccaaaatagccccatctgaaccagtccttcagcagtgacttggaaaagtcctgcccaagtccacaaactgcccaattagtgtctctgcatctccttgctatatatgaaatacagccaatgcattttaagaaaacttttctttgagacagagtctctctcttttgcccaggctggagtacagtggcagaatcttggttcactgcagcctttccctcccgggttcaagcgattctcctgcctcagcctcctgagtagctgcaattacaggcatgagccaccatgcccagctaattttttgtattttttttagtagagacaggatttcaccatgttggtcaggctggtctcgaactcctgacctcaagagatctgcctgcctcggcctcccaaagtgctgggattacaggcgtgagccaccatgcctggccaagaaaactgttaacatgaaacaaatatatttttttaaataacccaaaggaaataaaaacatttcagggaacagaagaaaaaagtcaaatccgtgtaagtaataacctcacagagataagagaacacactgtacccacaaaacaggaataggatcaaaaggtgcacaggttgagtatctccaatcccaaaatccaaatgctccaaaatccaaaacttttgggcactaacatgatgctcagaggaaattctctttggagcacttcagattttggactttcagactggggattctgaactggtaagtataatggaaatactccaaaataataaaaaaaaaaaatccaaaatctaaaacacttctggtcccaagtatttcagatatgagacacgcaatgtgtatttagtgagtgagaaagttcaagaaattaaaagtacaatgaaaaaaatcaaaaatttaatagagggattgtaaagtagagtcagatacctcctagaaaatagagatggctaggcacggtggctaacgcttgtaatcccagaactatgggagactgagagaggattccaggagttcaagtccagcctaagcagcatggcaaaaccccatctctacagaaaaattaaaaaattagctgagtgtggtggcatacacctgtagtcccagctacttgggatgctgaggcaggaggatcatttgtgcctgggagctcgaggctgcagtgagccatgattgtggcactgcactccagcctgggcaacaaagcgagactcaaaaggaaggaaggaaggaaggaaggagggaaggaaggacggaaggaaggaaggaagggagggagggagggagggagggaggagggaaggagggagggagggagggagagaggaagggagtgaaagagagagaagggagagagggaggatagaaaagaaaagagaaagagatgaagaagtgtaaaatgtttaaaaataagaaagtgagagaatagctgaatattaagggttccagaaagagaaaatgtaagaaagttatcaaatcaataatacaccaacagttcaatcactgaagggcacaagtttctagattaaaacagtccaatgagtgctccctcaaattaaaatagaccaaggcatatatttaaaatttaaaatcaccaaaaagagagagagaaagagaaagagtcctaaaagcttccagattttttaaaaggtcacattcaaatccaaatggtatgggacctcttcagagcaatgttggaaactagaagacaacagaaaaatgccttcaacattctgaggaagagtcacttccaacccagaagttgatatcaaatcaaaatatcaatcagatgtgagggaagaataaagacactttgagacaggcaaaccatttacctccatgcgctctttctcagaaagctacttgaggatgtgctccaccaaaacaaattaaaaaaaaaaaaggtacctgcccataaaaaaaagtagcatgggatccgagaaacaggaccctccatgaatattttggggcaggcatagaaagcatccagtctaaactggaggacagagggaagttgggaggagggtccaggaaagaagggaacggctggattatctggtagagattacctttgggaaaactggattaagagacatcttataaaactgttaaaggatctggaaggcctggagaagcaatgaaaaccaagcaaataaaagcttgttcttacaaagaaatgccgtctagatggggcacagtggctcacgcctgtaatcctagcactttgggaggctaaggtggcgaatcacttgaggtcaggagtttgagaccaacctggccaacacagaaatcccgcctctactaaaaatacaaacatatgctgggcgtggtggcaggtgcctgtaatcccagctacttgggaggctgaggcatgagaatagcttgaacctgggaggtggaggctgcagtatgagccgagattgcaccactgtactccagccagggcaacagaatgagacactctcaaaataaaaaataaattaaaaaaaagaaatgccatcttattacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaattcgcaccacactggcccttcggcagctctagaaggccgtacctatctcctgactgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntctattgctctgtaacaaactgagcagcttaaaataacaaacattatctcagtttctgtgggtcagtattctgtccagtttaccttgggttcactggcttggcctctcaccaggcagtgaaggtgttggtggtggctgtgatcatcccaaggcaggatagggagagaatctgtctccaagctcaggttggcaggattcatctcagaggctgctggactgggcctccgtttctagatggctattggtcagaggctttttacaataccttgtcacgtgggcctctccatagggcacctcatcacatggcaactggcttccatcagagggagcaatggaaagagcaggagaagggtgaccaaggcaggcatcgtagtctccttgtagcctcacctcagaagcgatgttacttttgctgtattctctttgttagaagtgagtcactaggtccaggggtggaattttacaagggtgtgaatggcaggaggtgagggtgatcagggccatttagaggctgcctaccagtgttgaagaaaattgttgacttctatgagctgtagcagcagacagtgctatgcaaggagaatggctgtctcagaagtccagctcctcacatgggtttaaacgtgttgccttttccccctgatacattttgtttaaatccatggtcatcttgccatttagtggtgtggtttaattgcatatttgggttagtctgtatgtaaacatttaacataggtgtctctgggttaaacaggaatcctattcatcttcttcaccgatatggtctgtggactctgatgagccaaatctgacatcagttctggaacgtctagaagatactaaggagaacagttcggtaaggaaagaaaccaagctattttctcttttcctcatgaacattatatttagaaattaaatgttaagtgataatattatataaaaacatgattaataactataatcttagaggaattaaagtctgggtattttaagtcctccaaatcttatttactacctggtttctctttattatttcccacatgtataatcttagtttagattagcaattcgggatctctttttccctgaattctaaccattaagccaagcaagcattttgggtggagaccactagccaaggtgggaagtagaaagaagaccaaggtggaagtgaagggagagatggggagaatgacaccagaactagtggaggggattgccttttttctttcagggtctgtaagtctgcagtaaaagtcaaaggtattcaaaataggaagttttgttttggccttagaatataaggagcataactttccattttgcaaaactttagaaatctttttttcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggcctgtgaggatgaagctgtctgtgacagctaccacaaaggttactataggtggacaaatttcaaacaagtttatcaccactaccatccccaccataaaactgtctcaatcaagggcaacacaattcaatattagccaagacaacctctttacctgtcactgcttaagaaaaggatttttggtcttatttagaaataactttccgtacctatttttctccataaatccactgagaccaatgtgtggctctatcgcaagcaccagcaagcaaaactgcctgctagaaggttcagtttttgtatctttccaaatgtagaacacagctatcttcaaggatttcataattttttgaaaattgatgcacaaacttcttgaaagttcagagacacagcagctgtaattattctgaaggctggttacgggacacattaccttcatactttgctgtttaagaaatgtggggtggagaatcaagtaaactgatagaatttccatataaaattctaagtgctctgagaacaaaagaaacttaaaatacacacacacacacacacacacacacacacacacacggttttccctactaatcattttacaactaaacaaccaagttgctaaaccagagcccacaaaagcagagtcaaagttctaacacttggtaaaagaaaaatgcacacatacgcctgtgagctaaaaaaaaaatgcttaagtattcaaagacagcaattacagctactgagaacatcactgtaagcaaactgaggcagagaaaacaaacgtgctgatgaggatttgaaccacctaagctgcagaaacccactggatggtttcctaggttccgagttggcattatctttcagaacaatcttctagaagagatcacataacactgttacaaaggatctggagaaagggaccctggcttcatcactgtggctctccagtcatgctttacatttggcagtgactatctccattcaactcaattccctaaccctaaactagctgacatttatcaaatactgccctttaccaggtctaagtaagtttaactccccccacccccaccaaaaaaaaatcaagatactaagggatatactattcacaaaagggaaacctgtctcctcttcatatacctgttcctttcaaggaagggtataaaaatggggatgagggaggataaccactaggaatttgaccctatattataaattggtcagataaatgaaaataattcctctggactcaaagtgatatggctctgaaaacgggagaaacatcggggtcctttgtctcacgccagttaaacgacatggacacacaggagtggttttaaggaacagaaagtttaataggcaagaaagaagaaaggctccctgcggtacagaaaaaggggggtctgaacagagaaaaagccccgtgtgtggcagaacagtactcggttatattgggaggctggaggaggtggtgtctgatttgcacagggcccagggcattggtttgaccaggcaggtcattcatgtagcccgagaaaaacgtggccctcccaccctagccttttaatatgcaaatgtaggtcaccatgttgtcctgcacacatggggtcatctggaggtgtcaccttgaggtggtgactagaagaagagggtgggaatctccatgttgaatggacacagtttctaagcgctggcatttgcatatcaaagcttggcagcctgtagtcccagctactcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctttttaatcatagtaaaaatgagaaaaatgcaagatgaagttaacagcattgctttatttcccatgaaaagctgttataaagcattctcaaaataaactgttattcagccacaaatgacaccatcacttttttattcatagggcacagtatcgctgccaaagagctttcctctatatgctctcttgcagggcaaaaaatattatctatgttatacagaaacacagtaaaaaaagtgatttacttaaggtcccaactactaaataaaagctaaactactcacttcctcctagattcagagagagctccaacattttctaaaatttggtatcttgttgttggggtaggcactttttggcaataatgaatagacatttaattagccaatcaaaaaaacttattaggtacagtaagttcctcttcaaaggtttaacctgttcaacttccttgttctttgttcctaagaacaatttccctgtaccttctcacccctatttacctgcttagttatctgctcagttacctgccttgtaaacaactcttcccgtcagtcccaacctgtaactcacattccctctcccttccttattagggagaatattcgcgatagcaaatcaagtctgcttagattgtgtagtccgactccagcccatgtggaaatgacagagaggtagggactgcgttagggatataaactcctgctctatcctgctcggtgtgctcttgcattcgtgactaatgcaaacagcagtcttttgcagaagtaagttgtcttgctgagaaaactttttttcctgagtgctggttcttccttgcagcactgatcatttgtttcttttttctttcttttttttttttttttttttttttttgagacagagtttcgctctgttgcccagggtggagcacagtggcttgatctcagctcactgcaagctccacctcccaggttcacgccattctcctgcctcagcctcctgagtagctgggactacaggcacccaccattgcgcccagctaatttttttgtgtttttttttttttttaggagagacggcatttcaccatgttagccaggatggtctcgatctcctgacttcatgatccgcccacctcggcctcccaaagtgctgggattacaggggcgagccactgtgcccagcctgatcatttgtttctaacaatctgggggctcgtctggaattcccattctcctctgagaaaagggtctccagtcaccaatagtgaggagaagcatcccactgcctcactgaggtggcctcatggtgagggatcaggacccacccagtgtgatgaataaacccggactctcagcagtctggaaaggaacagaccaacaacttaagagaaaaggatcctcacataccatggtgaccaggtaactatgtgcacagaccaacgtaagaaacatcacaagagcgacaaagtattttcttggtggttgggatatcttggagattgaaagtgtgtgttgagactcacaattgagtgcaaagcaagtgttcagtccagatctgcagttctgtggtcaccttatacagcttaaggtagcccttctgtaaaggagtctgggtcaggggtttctactgaaacagccattgctaagaggaaaccaacgttcccatgagggaagcagccagagaaggatgaagcgaaaggagaaaagtgcaagaaacctccagcaggggggtngagttttggaaaggaaagggaaaggaaagggaaagggaaagggaaaggaaaggaaagggaaaggaaaggtaaaggaaaggaaagggaaaggaaaggaaagggaaagggaagggaaagggaagggaaagagaagggaaagggaagggaaggtaaggtaagggaagggaagggaagggaaggaaaagaaaggtgagaaatctccagtaggagaggttgagccttatacaaacctctcgtaactgggaagaaatttctagtaggggaaattgagcctcaccccaatcccttttcaagatgggaaatacctcaagtaatgcaggggagaaaaaggataaagctagcaacaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctggatttctccctccaacaggtggttttctgaggatctgcttattagtcttcttacatactaggcaactatctgtaacttgtcttgccaaaatataaattcctatacatctgtagaccccgaggactgcatcacacttagcttgaggtccctaatgagtcccttgatgcagatgggagagaatttccctcatgaggggtttggataacatttctctttggtctggtgacacccatttcccttctgaattttctttggctcctatttttattaatttttccttttcagcgggagaaaagatggggactgcagtcgagggaggaaggcaaggggctaagtgaaaaacaggcattttcagaggaaacggcagtgtgtttggctatttgatctgctaggttattccttccgctttgaaaagaaagacttttctaatgtcctggaacatggacaatagctattctggcagctgcaggttatctaatacttgggtgattaattctttgtggcccaggtcttggcctttgctattaataagatctcgttcagtccaaatttttccaaaggtgtgagctaccccaaaggcatacttggaatcagtataaatagtccgttcttggttttgcaagtgctttaaggcttgatttaatgcaaacaattcattcacatgtttgggcagaccaattatttggcaggcttcctgactctacttcttcaagtgcctccccatctactactgagtacctattacgcctttttccttcaattacttgggaagagccatctataaagaagccctgccccgttttgtaaggggtctctcttaaatcaggcctaacttttgtatgatcattaaatctaaacactcatgctcaggtctctttagatttggatctccagtcaggaaacctctgggttaagtgaattatcagtggttagtgttaaatcatctctttctaacaggatagcttcatactttaaaattctcaagtcagtaagccatcttcctgccttttaatttaagatggctctaacctgatggggcatgtttacaactaactttcccccaaaggttagttttctgctttctttagttaacaaggcggtagctgcaatggattgaaacattcaggccatccacaggttactggatctaaaacttttgataggagatccatgggttgctggtgacctccgtgttcttgggtaaggacccctaaagctacccccttatttatgttaacagaaaggtgaaatggcttttctagggaaggcaaagctaaaacagaggcagttataagcagatgttttagctcctcaacctggtggagttcttcagaagtccagaggagagggtcaggcttttcttgggtgatttttaggtagagaggctttatgacaagggcatatgagtcaatccataagcggcaatatccagctatccctaggaattttctgagttcttgtttagtcttaagcaaaggtatggatacaatcctttcaaccctctcaggccctatccttcgtttgccgttacttattaagtgtcctaggtatttaacttcaggctctatgaatcgaagctttctctttgaaacccatagcccctctccttacaaatggttaaggatatggacggagaaagcagataccttttctatagcctaaccggatattaataagtcatctacgtactggagcagacatatacattttggggtataaacttgttctaacacttgttctagaatttgaccaaagagattaggggaatctgtgaagccctggggtagaactgtctatcgatactgttgctgtcatccagaatggggatcttcccattcgaaagcaaaaatgtctcagctgtcctcatccaaggagcatgctcaaaaggcatcttttaaacctattactgtaaaccattgatgttcatatggaattttactgagaatggtttaaggattagggacaacaggatgggtagtctagactgtctggttgatggcccagaggtcttatgctagtcgacatgacctatctggtttcttcacaggcagtattggggtgttataaggggacatacagggttcaaggagcccatccttgatgaggctttcaattacaggtttcaggcctattctgccttctaaaggaataggatattgctttcttcttactatttctccaggggtttttaactttatatgtatagggggaatttggagttttccccaatttccttcccttgcccaaacatcaggatgaatgtatgtttcttctgcagtggtgagcaggtttaatgaagtgtagaatccttctgagccaatacgtaaacctatacctaattttaacattaagtttcttcctaatagattagttcctgcctctgaaattaacaaaaattcaacattagctgagcagtttttacatctaatttctgtttcttttaaaatttttagtttgattccctctccttttacccctgagactacaagctcctctgaggaccaggttatattgtgggggaaggtaacaaacagaggagcaggctgctcctgagtctactaaaaaggtcataagctcggatttgggttccacttctaaatttatcaagggctcttggtgggattcaaggtaaaagagacagagcccctaacccccctattcctcctcaaaggtcgtaagtgggacgacttctctttctgattttaatttgggacaatacctcttgaagtggcctactttctcacaattgaagcattgattctgtctcttctctctatttttgggtttctcggctttgtctccttatgttctttatatggcttaggaagtgggggcctaggatctttataggttttggctctcgggaggctttgtttgggagtgtgtgggtctctgggtaacagagagtaatactggtgtgttttatcctttggggccccctgttggaaggtggataacataattttcattttttctttttgcttctcctcatccctccttacacacactttctgagcttctctaagaagctcgttcgtgggatggtccttccaatttcctatcttttgtaatttccttgtgatatctggctgttagtaacaaaatgaagctttaacattcactgcctaagaggatcttctaaatctaggccagcatattttctcatttgttctttcaacctgtctaaaagttcgataggcccttcatctttcctttgttgtatgtcgaatgctcgagtaagattttgggttcggagtactgactcccgaatcccttttattatcatttccctaagttcttgcgtatcctcttcagtgggctgcgttattattgtcccagcaggggtcttggttggggaatttttgatccgctgcatgaatgttttggccaggagggtgttcatgttcccagggtaccatagcagctctacagatgatgcttctttcttcccctgagaaaaggatgcctaggatggacattaactcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntctcggctcatactgcagcctccacctcccaggttcaagctattctcatgcctcagcctcccaagtagctgggattacaggcacctgccaccacgcccagcatatgtttgtatttttagtagaggcgggatttctgtgttggccaggttggtctcaaactcctgacctcaagtgattcgccaccttagcctcccaaagtgctaggattacaggcgtgagccactgtgccccatctagacggcatttctttgtaagaacaagcttttatttgcttggttttcattgcttctccaggccttccagatcctttaacagttttataagatgtctcttaatccagttttcccaaaggtaatctctaccagataatccagccattcccttctttcctggaccctcctcccaacttccctctgtcctccagtttagactggatgctttctatgcctgccccaaaatattcatggagggtcctgtttctcggatcccatgctacttttttttatggggaggtaccttttttttttttaatttgttttggtggagcacatcctcaagtagctttctgagaaagagcgcatggaggtaaatggtttgcctgtctcaaagtgtctttattcttccctcacatctgattgatattttgatttgatatcaacttctgggttggaagtgactcttcctcagaatgttgaaggcatttttctgttgtcttctagtttccaacattgctctgaagaggtcccataccatttggatttgaatgtgaccttttaaaaaatctggaagcttttaggactctttctctttctctctctctttttggtgattttaaattttaaatatatgccttggtctattttaatttgagggagcactcattggactgttttaatctagaaacttgtgcccttcagtgattgaactgttggtgtattattgatttgataactttcttacattttctctttctggaacccttaatattcagctattctctcactttcttatttttaaacattttacacttcttcatctctttctcttttcttttctatcctccctctctcccttctctctctttcactcccttcctctctccctccctccctccctccttacatactcacaccctccctccctccctcccttccttccttccttcgacttctccagctcctttacttgctgctccaactgcagtgtgctcttgttctcgttgttctggacagaaagaagcaatcagtggccacccactaaaactggagaccccagaacttattgtctgcctcccatggcaccgggaagggtggaggcaggttagaaaaatatcccctctctcccacagccatcagagcagggctctggctcacagatgcctttagaagtaccatttcatgtgaaggctacaatgccccattttacaggtggggaaacaaaggccttgagggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncacagcctctcctcctgttcatgtagcctctcctcctgttcatgtagcctctcctcctgtacacgtagcctctcctcctgttcacgtagcctctcctcctgttcacgtagcctctcctcctgttcacacagcctctcctcctgttcacgtagcctctcctcctgttcacacagcctctcctcctgttcatgtcgcctctcctcctgttcatgtagcctctcctcctgttcacgtagcctctcctcctgtctcctgttcaggagactcaacatctgattgttttccacctcagcctggagctgtcttcccacactctctagctccttccttaggtggttggtctcatcttgtagctgctccacctttgatggccctgctgggggctctggggccaggggttcagctgagaaagcaagcagagaataagggcctctggattctcaaaaaaaaaaaaaaaaaatcctccctttggtgcacagctcctcctctcaggcttcccaaacttggcctcactgctaatgactcctcacacccggatggtagacaatcttccaagtcactttcagatagagagcactgtgggtggctgacaatgggcactcctccctctttactgatggggacactgaggctcatggagatgacaagacttgtcctcccctggcacagacctctttccctctgcctcaaagcccttccatccacccacctccctggggcattctaagtcacccccacagccctctaatgccagtccagctgccaggtcatgccagccccatcttacccgtctggtttttgagtttgaacaagctcctcccaagcttctgtaccagatgtatctcatgcttcttctcctccttagatgtgcgaacctgcccaaagcaaagggggaaaagggccctggagggaggggctggtgaacgtccagagacagagtttgagaaaggcccaccccccttctgccagtttgtgatttagaaacgtgcattcattcaacaaacatttactgagcatgtacaggccaggtacagttcttcatagcagagatataaaacagcaaaggacagacaggagcccttggccctgaggtttccattctaggggcctttaaatctctgactttcagagctaaccaagacctttgatactctctacctcctccagaaacacgagcataaagaggagagatggcttgtccagactcaaaaagcaaattagggactgaggcagggcagaaatatggacccctgacaaccagtcaggctagtgcttcccagagaggtgacaaccccagggcatgtgtggcaaggactagagcaggggtgtctggagaagagagagtcagcaaagagggcagtgcagaagacccatgctgcatgttctgtgctctggggtccctccaggtgagacctgggtgcccagctccccatttgcccttggcatcaggggcccctagctcctttcttcagggccccaagaggaaactggagtccaggattgaccagctgtaatcaggggaccccactggactcttaccagtgaattgatgttttcagtgagttgactgattattgcggagcttgaatccagggccactgctagttcttggtactggctctgaggtgcatgcagagagaaggagttggaggaagattgtggcgaggggtagagagaataatcattagggctggtgggggtgtgtgggctgcctcagctggcagaggggcaacaagcccctgctgtgggaggaggttggagggctggcctgcagggtcactgcacctcggcccagggcctcttacctccagatcctgcagggtagtagaggatgcacggccctccccgtagatacctgttgctgactgcaagagatgagagtgcacatggagatgttctgtcccccctcactgtctaagccctctgacttcctttcttcccccatcaactggcaaaagcttcttttctgcctatcttggacccttttccccataactcctttgtgccaacttctctcgtggttcttatctccccaccatcccaccctggggccctttcagtgactcctaaagggacagcctgatggcaagtggctcttctcattggcctggcttccccttgagactggggatgaggaaaatcaaacagcaacgaccatttcctcagtgtcctgggtgtttgcagcaggccatgtactaaggattcacataaaagcaacaataacgaatctcatttaaacttcacaaatggaagtcaaaaaataccacctctattatacagatgtgaaaagagaggcccaaagacctcaagcaacttgccctaaatcatatgctaatcaatccctaatcaattcttagcagacggagaggcaggattcaaatccagaattcttaaccagtacccaacagtccatctacaatcttaacaattaccctctactgccccttgggccccctgtccccaggagcctggcccgccgagactcacatccccaggtgagtggtaaccaccagaagtggctgtgtcagggctactgccattgactttctttttcctgttagctcctgctggaatgccagggctcttcctctgccaatatgcttttaactgtgggaaagaagagcagtaacactcatgagaatgatcagcccctacagccacatcctcctttacagttttgacaaaatacccttatataccatctgatgtaatgccaccaacaactgtacaaggtgttgtcacaatcagtgactgagagggattcatatcatggatagaaaaaaaaaaaaaagaaagatcaaaaaaggcaatactggaacttaaactcagtcctctgactccacgctctggggttttgccatgaatcagcagcttccagggaccaaaaccaggggcagaggtagaaaagcacacattaagcaggcaggaactgtaggccgtgtggtttagagtcatacatcctcacaggtctgctagcgtgaagaagcgtaccagtacctctcacactttcatatcaatgtgtcctcatggcagaaggcagcttttctattaaatctgggaatttatcagaaagaggacaacccaagcctcatttcagagcgaagtctggtatacgcttggaaacctatgtgtctgtcatccccaagtacattaatgcattttctcaagagaatcaagggaaaatgatgcttcagaaagatgtcccgcatttatcctgtggcactcaaagtaccccaggttgagacgatatgacgactatcaagctgtcaagttcagtttccccagatctattccacagaagatgagcaaatctcacttcagagnccactgactgaanggcagtctggtcccagaaccgtggagactcagaaaaaatgttaaagtctctctggaagtagaaagcctggaaaaaccaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttttcggatatctcgcctgtgggaattccagtcaggatgtgcgggggccactcaggtgcccagtgtgcgccctggcgatgtccagcgagaagcagaggcgcctgccggccttcccctaggcctaggccgagggggactccccagctaggatcttgcagatcacgctctgtgacggccaagacagcatacgcccactctgtgtacaggcctgggagctgtcagagggcatttcgctctttcccagcttcgggatactggactgcgaagcgggaaaatcccgtgacctcccacgttcacttcgacgttagggggaatgcttccgtacccgccgggctacagtacgccgcttttcacaccgctggggtgagagtgcgtgtctttacacatttcctggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncatcattgcattccactcctcccaggggaggggaccacatcagcgcgatgcccgagtcgctgctccacgatgggggagggaaacacacggtttcgacccaggtcctcagagacgccagcccaagaagcctagggaggtcgagcttggggcagcaggaggggagggcagagtctgcagtagggagccccgggagtcaccagcccaaagccacccagggatgactggtgagggcagggcctggggctgggggacccaggtcctgggagacgcaagcccaaagagcccagggaggttgggcttggggtggcaggaggtgagagctgattatggagcagggagccccaggagtcacctgcccaaagtcaccctggggtgattggcaagggcagggactgggctgcttgctgaaggggtggggctgactgactaggctttggttgggggagcccagaggggctggggttggggggccccatctggtatgcctcaggagtggtatggactctggcacaggtcttgtcatcggaggggatctgtggctgggttgggggccatgacctggtgtgttttacctttttcttggctgcggccaatttcccctgctgtgttttttctgacatcgcggggtggggagggaggcggggttggggccacatcagcgaaataccagtgagcactgctcaatgcctccagtcacctaccaggcagctgtgcaactgagccacaggtggcgtaaccagggcaccaatggaacgcagaataggggcgtggccttaatgctccaagcccattggtcagtgagaaagatgaaagggaaaggaggcgtggccaggcagcagcatgtccagagggacctgtggcatcataaggaaagctgcccatgcaaccgctgtccccgcccactcagagaaaggggaggggccgcccactctgggagaggggaagggctgggttttgctttaaaacttttaaaactgtaaaaaataaactttaaaaaatatatgtgtatatactttatatatatgtgtgtctgtgtgtgtgtatctatgtgttcctccagagctgtcttcattatgcagcttctgtgcaaagtctgtgattttggcctatatttttcatcttcaaatggagtacaagaattaccagtattaccttaactgagatatagatcctataaaaatggaaaatccatagcatgcttgatgattaatgaagccgactatagtatccgacattccaataagacaaaataatcacaacaatttctcttttttggaaaaatgtttgtcttattctcctacattattgttaagatttcttttaaaaacaagaaacatgtctaatatctttaaaaacacaaagcttttgggccgggtgcggtggctcacgcctgtaatgccatcactttgggaggccgaggtgggtggattgcctgaggtcaggagttcgagaccagcctggccaacatgatgaaaccctgtctctactaaaaatacaaaaactagccaggcgtggttgcgggtgcctgtaatcccagctatttgggaggctgaggcaggagaatcacttgaacccaggagatggaggttgcagtgagccaagctcacgccactgcactccagcctgggcgacagagcaagactccatctcaaaagaaataaaataaaatacaaaataagtaagaacacaaagctttcaatttaataaccacttaaagctctttactggtttaagagaattacaaggcccatttttctagaatcacctggcctctctaagccttgcaaatgaagctgaatttctcacttgatacttggctctcacttgcagtcatgaaaaccaagaatttgttatgtcactgtgtattgcttgttacctgaaatccacactaggctgggatcaagggttgaatctttcatgattttctccataacctgtgtgcttcttatcccacaccaaactaagctttttttctagagctctgcaatttacagttagtatatgagagcagttctcaaaaatgtagtctctggactagcagctccagcagcacctgggaacttcttataaatacacatcctccggccccaccctggacctggtgaatcagaaactctggagtagggctcagcaatctgtgctgcagtaatccctccaggtgttcaagaacctctggcatacagcaggtagaaaaatgtgtttccttctgtaggtccaaaaccagggatactatatgttttctctatatgaaacaatgacgtgcaattaaaagacataaatctccttcctgctcccaccttccagccaatgtgttttatttttatgagttaaataagaaaacaatcagagatttcgtctaaatcgcatatttacaggtatcagttctcatccagcctgatcttatccaatatcatttatattctcttacatgtgaagttttagagaaggatcttcacaatgtaagactcaggcacactagcagttctgtaataaaacaccaagtagatcagaatgtccaaacttactggagaagaaaagtggaatcattggctatattttcaaattgcaataaacaggatattaaagttttgaatttttttcaccttcatccttccacgttaatagaattaagccaaaatacttgtcttccaaagcctctagccaggcaaaattttactatattacttcttgcttttcaatggctataaagcagactcctggtaggcacatttggtatacctgcaaagatgaagaactaaacagttccatctgttcaatactgaaacaaaagtcctgcaaacctcggatggtgagtgtaatacttcagcactagcaccaaagcctcaaatatgaaaagataccaagaacaccactagcaaacaaaactaaactctcggctgggagctctagttcatgccgtaatcccagcactttggcaagcaaaggtgggaggattacttgaagtcaggaattcaagaccagccttggcagcatagtgaattcacacctctacagaaagtttttaaaattagctgggtgtggcagcacacttcctggggcagatgtgccattgctggaaacttctctatggagagtaccaagtacttctacctgtagcattttccctggctggaatcctgcaattatcacagtagcccgagatccaagaaggcagagcaggagcatcctgtcccctccccagcaggtgcaagggaggctggggggtgaggcacaagcccgtgggagggtgaggagcaggagggatgcatggtgagcctctgttgactgcttgctgcctcagctggaaggtcaggaccaaatgtctattacaggttaaattacagaagtatttcagattttggatttttttcagattttggaattcgaaaatctgaaatccaaaatgctccaatgagcatttcctttgaatctggccttcgaacatcatgtcggcactcaaacagttttggattttgaagcatttcagattttggattttcggatgagggatgctgtattatcttctgaatgaggccactcattcaggaaagcccagagcttggggacgtggagctgcagaccaaagaggtgatttctgtagtggctttcagtgcggaagggcctacaaagtggtttaaagcaagccacaaaataggaaacccaatatttagctaatggaactctgataaaacctgctcaagatgtctgtctctactaattcagatggagccaagccaaagcatcattattattttaaaaaggcaccaatccctctgcaaaagcactgaattatatcatgatacaatcatcaattgtaccatgaatcaccatcagcggtggtcttttagggatatgaagaaggggttttcacaatacatcgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnactgtgagaatcctacaacaatagtacctacagtataacatgccatcaccgcccacagaaggaaagcaactggtgccctcgtcacgttatgttgttagtacttgcttacatgatgtccctccctgacaatcccttccaacctctgtcagcctccttccccacaatcacacacacacacaaaaccacactgccaggaagggaagccattgagtgagtattgtgaatcctacaagtggctctgtagtttaaaagggcaatgcctgtgcctgaagaaaatttgtctttagcttcatcaggtgaagaaaattggttttataacacaaggcccaccaaaccagaaaagcccaggaacgcttctccacaggactcacttagcacgagaaatcactcagagcaaactgacgcacacagtatttgtcaaatttttctttttcatttagcagaaggtaaggtaaaggactacaactgaagttaataaatgacactctagccattttgatcatttgtcactataaatgatagacatttaagctagttccatctggggaagtgaaacagaatcatgttcatataataagccagacgaaccaaattcagtggaatacgtgcacccaaaactggaccagacttgtacttaatgcagcctgcaaatccccaagagtccacgacagaatacaagaacagtaacactggtttatctcaactcatcttagctccctcacaaacttgccaataatgacctttcaagaactgcaccgttggtcctcatctgggcaatcccgtggcttagaaaaactgaataaagtgcttcttcgaaaaataaaacaatgcggggaggggggagtagtaacaaaaaaaaaggcacactggtttttactgcactgaagcaataaattctccaactaacttcattaatgagtatcagcaaagaatgaacaccaaaataccgctcaatccaactttcatcgtgaattcttgaattcacagtaggatcattaaatgtgacggtatcactctgctataaaaactatttccaaaacaaaacaaacctatctaccccctttcttgatttaaaaaaaaaaaagaaggaaaattttgagggtttttgcttttttcaacttcacataccggtttgcctttgcaaaaaaaaaaaaaaaaaagtttagtctcaaagtatagctgcaaggtggaccggctgcacgggtcccagagggccgctcgcctccgacggtcgcagtttcagccgggccgcgcccgcgagaaacagcggagaggccccagcaggcgggcgccgccggacaggtttaccgtccgcgtcggccccggggaaccgctccctcgcgcccgcagcacttgttcgcggcgcggactccacaccgcggccgcccgccccaggggaggagtgagtccgccccagcggcgccaacccggggacccggggcaagggttcggggccatccgccgccgggcgcgccccccatccggaaagcggcgacggcccccaagttgggctgcggagtgggaggcgcgccgagccccaagcagacaatgcgggagaagggtgatgcgcagggaggaggggtccgcaaagctgaggtccccgcgccgcccggctacccatccgtgccgcccgcccctgaagccccgcgcagcccccgaccctcctctggggcccgccccaccgagcggccgcaggggacgggccgcgctccgcaccccgacccctcctcaaatcacaaaacttcccccaactccgccaactaagttgcgctctcaccgtgcggctcccgggggctcccccgcggggccgagcccgagacagctcctcacctttcgccgcggaaaaaaagacaataggctgcctctccccccggcggcggcagcatcggctgcggctaaagcggcgggcaaccgaagcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatcctacacaattcatttacttcatttgaatgttagagccacttatgtttatttgtgtttctaatttatagtttaaatttatttgtgtttctaatttataatttaaatttatttgtgtttctaatttatagtttaaatttatttgtgtttctaatttataatttaaatttatttgtaaaaagttaaatgagagtgggtctttctctcatgttcactctggcatcttttagcatttttttaatttgataattataggacgttagcatgcatatcgagtttgcccttatgtggtgggagttcaaacacacaaagacccactgtatgcacacaactgttcttgctggtttgggataggctgccatgcttttttaatgttagtacagcctgtatattcattacggaattcagataaaatttccttatgttctgctgttatgtttgatcgaatcctaatcacagtgagctcttcattagctcaatatgtggtttgccctcaagtgcgcggtctattactttgtaatatgccactgtgagtactgacatttacagttgtttaaaggtggagcactggaaacagcctttccccctttttctgtgtattggggatgggagtaataacattttggggaggtttttaaatctcccagaagaggaaagtggcctgctttggcaggtgtgtgcaggatagaatatgtttcatttgttccggtgccaagaatgagcgctgtactacggtagttcccttaggatttgtatgtgctctgggctcatgaagatactgcctcatgagctgtggcagttgtactcttttttgatgacctgaaaagggattatttctgaggaatgaaaggctcccatcatgactgtggatgtggaaaaccttttctagctgagagcatttatatctacaatacattttaaagtcagagttcatgttccctgttttaatcacatgactacatgtcccagtacacaaaagggcactggttggcgttctccttaatgtatttagtaaagatcagaagaaatcctttaagagtttaaatgcccctggaacaggcatatacaggctctagtcaagaatgaattcgagtgaaggaaagctgtgtgacacctggcattcctctgtgttcatggagcttatttgaggctagaagatggattttaccatctagacctctctggctaatagctagtcttcaaccatctgacataggaatttacttcttttccttgaatggagaacactttaaaaataataacaaacattattataaactaatatatgtgagagtacttagttgaaacaaaaaggagttttagtagacagtattatactacatttgaaaatcaaggagcagtttatgcaacgtaaaatgtttacaaactgcagcgcaatctactgtttgtgactgtcaaagtgtcatgaggaaagtgtctatacaatcacagagttatatttcctcacaaagttctttacaaagagtgaaatatgtttttatacctctcagtttcagttagaggcatattttgtgtaatatttatggcttaaaatggactaaaggtcctgttcttgccttgtctgaacttgccgcttttgcattctttgagttcagtttaaagacacttactttaactccattttaaaccctcaggctagaaatcgtaccactgttaattagccacgttatttggtctaacagtttttgtttatcattctgaaactgagcttatctaatacattgataaattatttcaaaggtatttttatagttcaaatcgcttcacttttaccctgacacgtataaatgactaggaatgaccttcagatagcgtttagcaactgtaaccaatctgacaataatgtgttcatcaggtacctgtggattaaatcacatactggcatatttaagctgaatgtcagtctgaaaaataaatgtactatattaactcaaataccactctctgtgtaggtattttgtcatatgtttaagaaaaagctaaagagaatggaaatcctatgacaataactcaagtctttcttcaaagtgcatgcagtctcttgcagtacctcattcagccaagtatttgttctcttcctcattcagtataaggcagctttcaatttgcttagaaggcaatattagaaggttagagttcagcagaaagagagaattttaaaatgtgagttcgactgaataaatttgaatttctgtaggaagtaaagaatcaaaatacctatttaaagactgcaatatatgataattatttttaaagtaatagattaaacctgataggttttcctgaaatgaaaaacaatcagttctaaaaccaaagctgatttttagaaaatgtgaaaatgtaaatcaaccctatccaaaatagattctctaaaactttatcttacagtcactttcaaataactattcaaaaatgtaactgttaaattaatgtcttaaaataatttaaaacattttaaaatacgaatactgtagcttaaaacaaagaatctaggggaaggaaaagtagagaaagaaatgccaattccagtccaaagctgtatttgccaagttttcttagaacaacttttaccgatttatgaattcttatacacagaatgcatgatggaaatactgatttttgtctaaagtggcattattgactgcttctgtgatgctactgtaatgtaataaattattagattatttcaaggtgctgttttgcctaaaaattttgtgtgtcttgaaaactatagtattaaaggtattgagactgtgcaaatgctgggcatgcttggcatgagataatcggtttttattcttacaaaattgtaaccatataagtgtgtttattaaaagaacacaaactaaaaaattacaggaattaaagttgtgggatgaaaaagttacgggataaaaaatactgtggaaaagttgtggcaaaaaaagatgtgggaaaaaagtaaaaaaaaaaagttttatgaaaagtttttttttaaagttctgaaaaagaagttacgggatttaaaaaaacatcatgggataaaaataaaaataaataaaagcaggcccctgtcagcataagcctggagaagtgggtctggagtcttcacccccaccatgtccctacaacccctccccagtcagccctttaccattagggtagcaagacaagacccctgtctaatggagggagacaaacagaccctttaccaccttgaccaaggctgagtccttacatttctggatgatgatgtttgttatttaagagccagaggttggtggagttggtttgtttggaggaggtctgacggcctccttactctcaccaaagcaacttttccctcaagggggctcccatcttcttactcagagaggcagctgaggcgggacagtggagttaactgtagacgaggcgagggcacaggctgctgggggtggccccccttcccccgtgtacatactgtagctgtgtaacattctgtattgtacctagcggaggttgcagctggcatatgaggaagaggttcttataattattcacggctgggaaacttattcattgttagcataggagcgatgatgggggtggggatggcgtcatggctccctggtgatgggaccccttttttgttttgttttgtttttttgtttttgttttggttcgcttttgattttggaataaatggatttagccatactgctcggcctggcatgttcctgtttccctcactgggtcctgcagtttttcccactcaatgaggagccccagagtgtctcagcatgtccagctgggctgtggggaatcttccaggcctgttacctgtatgctgcctggtgatacctggtggatttcacgaggactgccatggcgcctctggagtatagtccggccctgagagccaacaggttgagaagcctgatctagctgtggtcaggaagacagataccagtgcccaagggcactgacttccatccaccccacgtgtcttccattccgtccccctgcctccctctcctgtctgcaccgggtggcctgtctgtccctccagagtgccggctgccccacaggctccttccaggctgagttcagggccctgtgccctactggccagagccggcttcacagaataagagccagctaagctccagggactttccaggaaaagtgtcccttgaaaagggtgtgaccttttcactgctgccaacagcaccctaaaaatggcttggcctcttccctcccctgagctccatagagaacacagccagcagaggacacattctctgtcattcagaaatgggtttctcagccgagggacagcaggactggtagagactgtcaggccacacagctgcctgcacagcaccgccatgcttggccagaagggcgggagggatggcgggggctggctgtccataggccgcgcatgtcccggaagctcactggaggtggtgcactttggaggggcgatgtcaggagacagcttcctcttgctgggctacaagactccacaagcacagcacggggactgattcccagtgctagaggcgaggcagtcgaccacatgtatatgtgtatatatatatatgtgtgtgtgtgtgtgagtttgtgtatgtgtatatatatgataatttatagctatttatagaacagggcaggggcataccacagagggggcacaagttttcagcaacagtcacacctggatgtgtcagctcaccactacaacagactaagtcacagaagaagggggctggctttggggctgggggagccactgtcaagtcacaggacacccacccaggcaggcttggaaagggaggtctctgagaagaggaggaatctgtttagaggtcgaagtggggcctggggctccccggatgggatggacttgcctgacccaatcagctggcagttggagagaaagcagagagaaaacgggttagagaaaagccagagctggtgaggcaagtgcagagtatgggtgcgctgcagcagctgtggagggccggggaggggagggcgtaggtgtgggcatggcaaggttcctggaaaagaggggctggaagggaaaggggaggaagatggagggagaagccggagcttcataggtagtgcctggggactgcggcggccctccccaccccacacacgctggcctctttcatggcacccaggcagtccacccatagttcagacgaatgctcagccccctcgggcttctctcttctctggtcaccctgtcttccaactcacggcccagggccacctcttgcttggggagccccacccaacagccaccaggcctgatagaaagggaacactgcttgaaccaaaaatggtgaagctataagggatggatgactggagtgagtgccagaggcccctctgggtggtccaaaatcccagggtcctctgaagggaccctggggaaggcagggagggcaggtagctggatgccactggccatagacttataagtctaagaggggagcctcaactggttggcgggcgtggggctgcaggttgcataggtgaggctgggcccttcctgctgggaaaagcagaagagggagagtccatggcaggagaggcaggtgggctcgctaggcggagctcagctgggccagcaggcactgtggtccccttggctgaatagcacaggcgacccctaggagcaacaggccaaggtgtgtgagcctgctggtcggcgatagtgattcagcgggggccagggaccctgccttcggtcacacactagcagctatggtggtacctgggagggagggaagggggctgtgtgtccccgcctggcctgtggagtgtggagtgtgttgtgggatgaccgtgtgtatgggactctcacctagataccactggattgccgacagatagatgaggtggggccctgactatcagccctgctttgcagtggatttggctctcagcactcccaggctgggagctggatacctgccctggcagcatgactgagactgcacgacaggtatggcatgcccaggatgatgttcctagggactggttcagtgtgtgggtcaggagcaagtcgacaggccctgctccttaccccttggaagggactgccaccaggggcagttctgactaaggcctgggaacccatgactcagagcgtgggtccccaggtcttgctgggccagcctggctgctgcagacagacaggaagcacgtctgacgctcctccaccctcggtcagcacagcggggctgggactcacgctagccttcccagcaacttgctttcctgcgtgaactctggcaggctgccctctctgtgcaaagccatagctggggcctgcttggggccctctccctctttcacctgctcagagtggcctggaacttggaggtgggcagtcggcgcctaggatgggcctgtgtcactagggcatgtgtccttgggccagttacttcctcttagggccttgggctcctcctctgagaatggggcgtgttggtgtgaaatgaggtgagcatgttgatttgaggagcagcaggacagacacctgcaggcagcccccctggccacattcccctccctcccttccaagtcctgggacagacgctcttcaccaaggggttcagcctctgatgctctttcttggtctcagtccctaaggagtaattttttttcttttcttttcttttctttgagacacagtctcctccctctgtcgcctaggctggagtgcaaaggcgtgatctcagttcactgcaacctctgcctcccaggttcaagcgattcttcttcctcagcctcccaagtagctgggattacaggtgcccaccactgcacccggctaatttttgtatttttagtagagatggggtttcaccacattggccaggctggtttcaaactcctgaccttaggtgatccgcccacctcagcctcccaaagtgctgggattacaggtgtgagccaccgcgcccagccaggagtgattttcagtggtgtcctctccatccccagcatacacccagccctgagtggccgcggctgccacatgcaggctccagggctacatttgcctttcgtccagggttgtcatacgctggagagtagaatgtgagaggtgacccctgtaggctgcagggtggcccctctgaaccttagtgtcccccacctgtagaaggggcgtaacaccttccagggggagggctgaggaggaaattgtcaacggctgagtctaaggctcacagccagaggccaggatcggatccagggctgggcctgggcctgggaggacagtgtccgccccttctccagcctcccgcccctggtcaggccaggaccctcttcaaagcaccttcatgcccatctgttccctgctgtgggcactactgtctggctccatgggactagattttatgggaggggaaggggctgtgggtaggcaggtgccaggtgctggaccatagatcagcatggtaggaacctgttgcttgggctggtggtgggaaaggggccaacccaaggcagtggcaattagcccagccctatctctgggcacagagatgaagggacacgtggggacacagtagggcaaaattggccagcctgctcttcccctctctgcccgctttttgcagaagagtcaacagatagaacagacagagccagggaggtgcccatgggggccccagtccccaccactccagggggcagtccctgcaagtgacaaggtgggctcaatccctgtggaacaggtctctgaggaccacagagtggggccccagggaaggctgggagcctgagctgaaggcaggcagcaagtaagggccaagctgtgcccctgcccagaagaccttcctgcccccagaaccccaccctctgcagacaggcctccctgggcagcagccccccggcttccgaggccttccgtgcctcaccagatgccatgctctcagggactcgtttgctacgctgccccctgcagatctgccccagaggagcaggtgaaaagccgcgcctgccgaggtgctgcagcggtggagttttgggcagaggggtcgggggaagagtttctcacttttaagattccccaaatccaagatgaagtcacactgtgctttagaatggtagatgctcatttatgtaaaatcataataaatgttacacaaactgttagaataaaaaaatacctttttcgagggggaggagctccccagcctgccgctgggtagtgagagggggttagcaccattagggcgtaggggtcgggagctccgccacagcccgtggtgggcactgaggtctgtcggtcggtctgtgcatcctggcactgtcagtggcgggtgacccgctgatggcctcgggagggggagccgtggctgggcggagagcacgagcggcagcactgggtgcggacggtgggcagctggcagcggcccagtaggcgcagtgtctcacagaacccgaaggacaggcggtcccgctcacagcctggagtgggggggcagagaggcatcagaaccagtggtttggggtacccagaacctggctccccaccccaaccacctcaaggaggctccagcagctccccaccaagcagagagccccagtttctggagcggctcccaaactggacttgcaggtctccaactgttggtgtctctgtcccacctactcacggccgaccccaggactcgagaacgggcgctgctgggctgaggtttctggaggaaaggtcctgagaccgcaccctgaccccctcacatgcctgttaaagagcctgcccagggcgacgccctgccatcccatctccatccttgctcacccctggtgttccccgacagatcctggcacagaactgcggtcccggggcctcctgccaacctgcagcggcctctgcccccgactcccgccaccgccccctgccccagtgcatctgtcctgccaggcctccgtgaccacctccagccacaggggctgtacacagcctcgggttctgagtcacaggtcgcatctcccaggccagcctcccacttctcaggtgggccaggaagcctagagagagtgggccctacaggctgtcagcggaaaccagggactaagcccaggcccagtggggagggaggccggctgcaggctgtgcttgtcagggctgaggcttggctgggccctcctgccccgtggttatcagagctattttgggaagtggcttgtttccagcctcctggccttgctcctgatgccactgccactgctgacagcccccacctgccgcctgggccctgcttactccagcagacctccctggggaggaagagcaggaggacagcagccagccctgtgccagggacatccctcaggcccggcagagggcacgaggcagcaggcaggctcctccaccccagctccaggcagagctccaaagtgcacatctgcaggcctgcatcctggtcgcccggggtgacctcagacaagctgcttcacctcttgggccttggttccctcctctgtcaaccccacctccacagcaaatggatgtggccatgctgtgtcactgcagcgactgcacactctggagtttcccggctttccccctgtcccgccaactgtcccacagaccagcaaaacatcctgggaattccaggtctcaaagtccaagacaccttcccagctgcccctccactgttcactggtggcagaaaactcctcacttgggacagcttctagttcagccacctaaccagcccccatagcccactccctgcagcccactcatacccgcccctgggagaccttacaagcccagagcctcctgggccatctgtccttggttctaggcccccaggggcctcagttcctgttctctgctccatctggtcctcatcccctgggatcataaccaccccactccctgtggccagctctagccatgaaggcgagagatgtgatgccagcacccagctcaggcagcacacaggagtgctctgagatgctggctgggtgcgtgctgagggcaggcaggacagggtgggggcactgccacttggccttgaggtaatggggtttgtggcaggaaggccacccctgccagaggcagggtagcaaggcatggcagcgaggcatggcaggggccactctgagcccaaatgagggctgcccaggagccagcgcaggtagagaaggcgcattggataaggggagaaggcagactggggagactgcagggggccccgaatgccagtttgagggccgtggctgaggactctgtcctagggtcagggggcagacagccaatagcacaggggccgcagctcttcaggccacagctcctggattccttagactggcagggtcagccccaggccctctccctgaccttgcaatgggggatgacagtggctttgcgggaggggaaaaagccgccttccctgagcaccacctggatccccacgcagtgctgtgcccttcatgcccagacctcacttatgcaaggatggggcttggcagcccctttattcagcacatgaaggccctgagagggaaatggagcccaaggccacacagctggtgaggggagcccaggtgacactccagggccaccccatttcctgccctcagcactgctgagagcagctggggctgcaggaagtgtgtgagtgtgtgtgtgtgtgtgtgttggaggtggggggttgggatatccagaaccacctctagctcaggcccttccaccaggacccagctggccaggaaaccccccaccactgggattagcaggaccctggaagggaggcccttcctgtggttccattgctcactctaggcagtcctctggccagggaatggacaggctagggctggggaggggacagggactcacccaggcccagttttcacacagcttcagggacatccctggtctcactatgggaagactgagacccagaggggaaagagcttacccaggttcacacagcaaatcaggggccaaggccactctctctactcactggaggtcagaaagctgcctgcaggatgttgtgtagctgggacttctcttgactgactcccagcacagccaagcctccagcatgggatcctgtggcatcaggattttcagtggctcctgagcccagactacagatggagccagccggtgccgtgggtgcaatggtttgaagacccaatttccccatcacccttcccgccccacctcacttcagcagagagcttggggtcgggggactcacggggaggctcgacgggctcacaatcctcggtgccacacagccgggagctcacaaggccaggcctcgtggccacactggtcactgtcttcctcgggtagccccgtctgggtgttgacacacttgaccagtgtgtgaccactggatgccaccaccacaggggcctgagcactggggggagcaggggaggaatgagtgtctccagggccagccctagcagtgggggcagggacacctcctctgggaagccgtccctgcgccctgtgcctgactggcctgcccttgctcccagccgccctctcagtgcctcctggaggacctgttcccattcctagagcccacttggtgctggaaccccactctcacttgtgggatcggctgctgcagagggaaggggcatgagaaccatgggacagcccttggggcggcagggcagtgagcccctcacacgggacatgactgagaggcctgggcaggggccccgggatggagccctgatgcagcagtgagcagagacgtgggcgagacaccgctgtgcccgagggacagggcagaggacctgccgcagcccatgggcaggaggggtggagacaatttcacagccggggcccagcccgccaggctttgttgttaacaggtgcaggtctgaaagccctaaacatgtgctgagtctgtgccagtgtcgtgctgtgcccggccctgtgctttgttgcgttcctccatttaatcctcctgaccctcctctcccaaagcgtcccaattttacagatgagaaaactgacccagcaaagcaaagcaacctgcccagagtcactcagcagccagtcggacagactcaaacgctggcccagctgactcccggacccagctcagggcccaaatctgagatttctgaacccctcagttccaaacaggcccagcagaaggtgtcctgcccatacgaggcccctcttctgcccccttctgccgctggcctttgctgggctccctgatctccccaagctcatcattcctgcctcagacttcacacctgctgtcccctcgatccctgtccttggcatcactgactcctccctcgggtctcaaccccagacccctcctcggaaggccttccctgacatcacagcacacatgccctttccttgtctgtttctccctgtcaggtgtgagcaccagcatggcagggctttgtccagtgactgctgcatgtgcaggggccacagacagcctggctcacagcacacactccacagctccttcacccaacccaggactgaccaggcgctaccaagcacttgctccctgctcccccccgcagcctggctcacctggccccagggccccaccacccactgtgtgcaggggtgggtgttgcagggccgggtggtgttgggtctcagtgcctcctcgcagaggtctggctctgggcaggtcaccagacgctgctgctcaccaccgccacaggccttggagcactgggtgggcagggaaggagtcagggcacagccagggtctgagggtgtcccctccccccaactcaacgcccaggcctcacctccctccaggaagacatgtaccagctgaggcagggctgggccccgcagggccagtgcacaggcagcttggcaggtccaggctgacaatggaagggccacagtggccagaggtcccatgtgtccacatgctgcatgtcccacactgaggaacctctgccacagctgtgggagcactggggaccgagagacttgtgtggacacatccccacgtgcaggcccacaggcgtgaccccgtgaggcgtgtggcaggaaaggcatcagacccacgccccagccgggggcaaatccctgaagagccccagcgagaggccaaggctggcaggccccaggcaaaaggtggcatggccaggggctgccatgggctgggacagacagagaaagggaggaacaagtccagatggggtcaaagatacagaggaaaggagacaggccaagccagacaaagatgagatgactcccaagagattcggaatccggtgcgatcaggcacatagacatgcagcctggagccctccccttccctgccgctctcggaacacaggccgtggggaaccagggctccaccccatgccctggggatgcctgtcctggctccatcctcatgcaccttactccagttgcctgagtgccaggtggcacagggccacaggtggcagcggcgggcaggctggggccggccagcggggtcgcagtcctcatcccggctggagctacagcacaccggcctccagagggcacccaggccacaggtggtggagcactgcggggcacagacccgtgaaagccaggcagagcccatcctcgccaggcctccacagccaggaaactacccacctaggctagcaagacctcagcaagacaggggccctcttctgggcctcagtttccttatttgcaaaataggctcctccacccacctcccaggaagaccatgagaatgaaaagtcaaatccccccagcaaccagccgtccctgctcacatgggacaaagggcctgtgtgccagtgtcattggtgcagaggttcgggggaggagaccctgtgggcacccctgaccagctatcctgaccagcctcgtcgcttcccagaggcaccagggaaggaaggctgggtcctggtaccagcagccaaatcgctgcctatccccgcgcaaaacaagccctgtgggcctcagcctgccccttcccaccccaaaattaggaatctgaacagaagcttgcttctcctgcagtgaccatctggggacccagggagggggcactagccagcttctttcatgcagctcagacgtctgcaggtcactgccaaaggagggtggagccactgagggcagagccaggtagcagtgggctgagtccagcctggaggagccagacagagcctcagggaagctgctgcctgctgggcaggactgggcctggtggccacacagggaccctccccactgcacagctgtctgagccagctccatcctggggcatgctgtgctgccagagtgtgcctgcccctgccttccctgaggccccctgtgctgcccaggaatgggccccaggtcccctcattcccctaatcctgggaacccccgccccaaggaaggcgagacagatggcgcctgcgtcccactctgctcattttcagatgaggaaatagtcaccaaggtcctgcgcaaactccctgcccacccagcccacaccacttgcctcgctccagtttcccacttgtcagccggcgttcctgacaaccaacgggtccgtggggggccccgcttcagccaggctgggaggcagtggctgggtctcaggggctctgtggctgttggcggggctgtcccaagctggcatggacagcagcctagagctcaggggcacctcagggctgagggactcaggctgacccttgggtcctgggttcagggcaggctcaggcgtgtgcccgaggccagtcagggttgtggggaggaaggtcccccacactgccacagtctgcaggtcccataagcctggtcctggggttgggaaggagggagtccccggctgcaggggactgtccttgcccttcatctctggcaaaggggctatgggaggaggagggagagaagccaccctaacagtgggccacagttcactatccacaggccccaggccaccctccagagctgactcccaggctactgtccctcctgtccacagctccgccacgtcaggactaggagaggagtgggtgctgctgaccgggtacaaagtgggcagcgtggggctgggtctcgggggcaggtggggtgctccgcagcccttgggtccctcatcatttgaaaacctcgttggtcctgtcctgccatggagagggcagctggctctggctgtccttgccaactgggaaatcattttggctctcaggggcggcaggcgtctgcaggccatcagtggaaaccctgggccagggcaggctggggagcccaagatctggggcccctatgggggtgtcttcctcaggcaggaaattgatcaaagggttcccaggggtctgctctgagggtgggggtggggagcggccggcctggctaggccaagggctcggggaccaaggtcccgttgccccttcctccttggctgcaggaggctctgtggcaggcacagggctacccgtggagggcgcagcaggacggctgtgtggtgggggcgtccgatcccctgtccccgccaggtctagatcaggctcctcagaaggcccgtaaggacagatcctcgtggaagctgatgaaattgtagtcgtagtagaagtcgtccacaaacacgggccccggcaggtccagctttggagcctcctcctcaatggcgttgcccatggtgcctggcttgggtgatgaggcgggtgaagggcgtggggccaggtggcgcgggatgaagtcagcctcgttgaagagctcgtggctggaggagccgctgcctgagccttcagggcccagtgtgtccaggggccaccaacagggtggcagagagcaggtgacttcgctggctggctgctgggcctcgtcataggggacaccggtgtcactgatgcagaggacatttcggtgctgagtcccttcctcatatgtcactgagcactgcaggggaagccagggtgaggggcttagcctgggaggcaggctgccaggggacgctggggcaaggctgggtaacctgtccactgcctgatgtcagagtggcagagaccccagccagccctctctggcccttcccagctcaaggccatgactgtggccatgcttgccaggggcttcctgatccctgaggctttagagtcaggggctggaccctggaatgcccaggttccctcccacccacaaggtctccaggaaggctgtctgcctccctgtagctgaagaccaagggtggggctggaggcgggcaccttcccatcccacactcacctgagaccagttccccacagcctacgtggccggacagggcacatggtggttgcaaggggtttcagtagggggccggggaaggtgttcacaggcgggtggcttcagggcgctctgctcatccagccccacgctgcggatgcagagcacagcctggcaggagaggcccccaggcccgcaggagctggagcacagctgccactcacctgcccaccacctgctgagggcacacaggtgtcatcagtatggcatcagacaggtggcattgacaggctcaccagcagggagggccaggctgggtttccaggccctcggggtttgggcagtgccagaagccagtggatgattctccagagctccaagctcaggtaagtgtcctgccctcaaagtctggtgacaaggcacagcccctccactcctgccaccttcccctcagggaaactgagcatgacctgaggcctatttccacatccagggacccaaagaggaggaccataggtgtccaggctggcccaggctggggtgagaggtgaccgggggttggggcttcagccttgggaagagaatgaaagcccggctccctctgctcctccctggggcctctggggacccagatgtaggggcctgtggcagacccaggatgcctgggggtggggagttggtaggggatgggggcgggctcacctggcagggcagggctgctggctgcacttcctctggcagtcatcgggccggcccagggggtcacagtgctcctcgtccacgggccctgcctgccgctccgagcagtacacactctgcctctgcacacctaggggccatggcgttcagcctgggactggcacccaggtgcccaccgcccaagacccaaagacaccctctctgccagaaccctcccagaacagcgccttactgcccatgtcaggatgaaggcagacctccaccgtcgcctccttgctgtcctcctggttctcacccaccccctctcctatgtagcttcccctctgactgcccctggaggggtggcagagtgtggaggtttagtgggttgggtgcccagaccctctgcatcctagctgagatgcctgggcagctcatttggcctctctgaacctcagcgtcctcctctgtgaagtgggagcaacaatcctgcctcctccatgtcctggagggaggactgcatgtgttcttgcatgtgcaggctcggcccgtgcccggcacatcctaagagctcgatccatgccagctgctgctagcatgcaaacccagccgtggctcctgccaccttcccctcagggaaactgaatgtgacctgaggcctatttccacatccagggacccaaagaggaggaccataagtgtccagggtggcccaggctggagtgaggggtgaccggggtctggggcttcagccttgggaagagaatgaaagaccagctccctctgctccttcctgggattggcttgggtgatgaggcgggtgaagggcatggggccaggtggcgcaggatgaagtcagcctcactgaagagctcatggctagaggagccgctgcctgagccttcagggcccagtgtgtccagggaccactgacacacggtcccaccatccacacccttcccaatggatcagagaatgtctggacaagaaatggggcatcaatggacagcccctgctctccatccccacaccagccttggcactgctccagtcctttacattctctgccactgtccaacctggggactttgcacagccacgttcctcaccttggacactcacttccatactgcctgttgaggcccagctgcaggaccccgtctgctggtggctctgccttctctgctccaccccctgccccgtggtcccgagagtaagttgtccctcccctgagctgccagtcccacatccatccccctctttcctcaccaacagagtctgattttgttcaaggcagcagtgggacctgctgaaaacacaccccactgccgctcccttgcaactaggggggtctgggacacagtcctggctcaggagaaaaaggcacaagtccctcgctgggagtcagccctttcctctctccttcttgcctagaacactgcaagagccctggaagggaggacaccatctgtggcaagcaggagtggaggggaggctgctatggcaaggatggtgtggctgagggccagtcagctccaggtcccgccagcttggactgtgcacctgggacttcctgcctgagacaaagaacccctgtctcttccagccaccacagggcacttgcctctgcagacgctcctaagtggtccacctgcgaagcagccaatttgctgaaaggcaattccccaaatgtctagtgctgcaaatgtatttgttggttttcacgtttgtccaattaaagacacctgtattaggccaggcacagtggctcacgcctgtaatcccagcactatgggaggccaaggcgggcgaatcacctgaggtcagcagttcaagaccagcctggccaacatggtgaaaccccatctctaccactaataaaaaattagccaggcatggtggtgcgtgcctgtaaatcccagctactcgggaggctgaggaaggagaattgctggaacctgggaggcggaggctgcagtgagccaagatcgcgccactgcactccagcctgggcgacagagtgagactccatctcaaataaaataaaataaaacaaaataaaataaaataaagacagctgtattagataaaatgggtttcctagctttggaaggtaactgcccagttctccattttcactttgtcatcataatagcatttgaaggaatgctcaaacgtctgtatatcagattcccgattctgagaccctgaggatactgagtgtcaacgatgggaagactgagggggaaaggggaggactaagagacaaagggggagactgaggtgtggggagatcgaggaacagcagggcagaccgagcagggggaggaagaccaaggggcgtcgggggggactggggggctggggggagaccaaggaatggcgggggagaccgagccgggggaggaagactgaggggcgtggcgggggtactggagggccggagggaaactgagggatattggggggagaccgaggggtatgggggcagaccgaggggtatggggggagaccgaggggtatggggggagactgaggagtatgggaggagacggaggggcagaggggagactgaggagcagtggggaggagacaaagagacagagaggggagactgaggagcatggggggagactgagggaaatatggggaggaagagtcggagttaatgaaattgccctacttttcataaatagttcagggaaataagtcatgtggtgaggggcctgggctggtctccgggacgcagcagaaatgcaggcacaaaacctgccggagctgagcaaggacaaaatcaagggggagctgtgtccactggagggagaacgccaagagctgcagcacactgagcacacgccgcgagccagcacccacctgcctcatccatttaccctcccagtgggcctgggacatggggcggttgctagcctcatctcacagatggggaactgaggctcagagaagcaaacttctaaacccatggtggcccagcagtgagctgggagctgaagccggtgtccctgtccagagatgaagcccctgctggcggggctgtgcctgccccacttctcacctctgccacaggtgactgtacacttggtccagggcccacagtgccaggagaactcgggcggcaggacctcgccatggccacctgcctccctgtgaatggtgtactcgtagtgcaccccagggttgctctcctggaacagcagctgggtgggcaggcgggggcccgtgagcacgaggtgtcttctccatccacccagtcttaaaggagctgaccccagccacctctgtgaactgcagctacacagttgggccatcttaaagatggggaaaccgaggtagaggcctcagcaggagggtctggctcagagccaggctctgtgactaacccagggctcactcctccaggacgagacctaccatgggaggtgctgggcctggggactccgcctctgctccccacgcctgggcctcgggaggcaggcacctggatccagacaggctccttggtgggacccggggacgtgaggttctcccagttgcccctgcgtgcgtatgtgacggtggtccctgccacctggtagtccccgttctactggatggtccagccaccattgaggaagtacttctccgggtcctcgctctgcagtgccaggaagttggcagcctcagccacctcctggatgcggacctcacgtgtgctggctgggatcagccccacgtccacataccctgtcaggcaagggttgtgcctggggtgagaagcttgcttatccccacctgctcccctcacatctctccccacttgcctccgcctgctgatgccaaagatttcgccattagctttaaagtctgagctccccaaattgctcggatctgtcatgggtcaccaaaaccttgcggaggtgccacaaatcctgaccccgtggccatgccccgtcactcctctcttggggacctaaactggtctcatcataaggctggatccatcccctactctaagggccggctggcattctctttctaaaaaaaaccaaagtgcccaggcctttctcctgggacaccctcctcatccccacgcagcctgcttttattcattcacttccatcacacccatcacgtgccgggcactactctcagcacttcacatgtgtaagctcatgggtaacggccctatagcatggtactattgttaaccccattttacagatgagcaaagtgaggcagacagggagagtaacgtgcatgagcgtcctgctgcaatataagcagcctccagggccagtgctttatccaccacactgcactgcatctctgggatgaaatctaagcttctcagcctggcactcaaggccccatagctggccctgccttcccttcttgcctccagggctctggcgcaagctctttcctccatttggaatgcccattccatctcttctgagttttatgattcagctcaacttccgcctcctgcaggaaaccttccctgacttccccaggccaggaccttcttcctcagtgctcccacagccctctgggcctccctccactgcactgatcacaccagaaggttctgtcccccttcaggactgagcgcttcacctgcatgtcctcatcacctagcacacagtcagtacttcagcaacatgtgcaaaacagaccagaggtgagggcatggagctgggggtctcagaagattcaggaggagactaccattctttgaaaggcccaggggccacacacaagtcggggtggccctgcctggggtctctgggacaggaagactccccatggggacaggtctctgcgtgtgggccaggggtcccctgactcctgcaagaatccaccccagcaagccctccctgcttagccatctctaggctgggtgggggccacgaggccaaggacaggggcccgggggagatggggaaggggccaccaggtgaagagcacacccctccccacagtggtcccaccccatacccaggccctcggcctcctcgaaggtcccactcacggtgtggcaggtggagccgttgccgtggcacacgccacagcggtcctccatagtgccagagtcaatctcaaagtcacagccccacgttctgcaacacacgaggaggggaggcccctggtgctggcggccagccctctgtggccccagccccgggggccagccagggtcaggagaagaaagctgggagtgggggtcgggaggcctctctctggccctgccccaccccagctgtgcctctgacccaggtgaacttctctacctccctgagcctcagtttcctcagatgtgagacagggagacccacccctcccttaaaggcatgtcatgagcatcacaagagacaagagaagggaagagttctgcaaagcctgcgggcaggcaggggatctgacacgccacgggctcctgagcagcgcgtgcagggaatttcaacgtcaaaggcactgggggttggcacctccctcctggtcctcctcggagcccaggccttgataccccagtggtttagagggcaagaagcaaggacaagtaggtggctggagacatgggtaaagaggagaggccatcgttgttattaaaaataagaatataaattgttaccaaacactgaggcctactcttcagggctcagagcccttcatgtcacctgtgccacctcatttaacccctctatcagggagcaaaccactgcctggggtcagccagccagcaagaggtcaagccactgcctggggtcagccagccagcaagaggtcaagccactgcctgggctccgatttcctggctggggcggtgctggtgcaggcatccaaggagacgcagtggggcgaggcctgactggggggggtccccagtgccaggaggcgtggtaggggctttgccttagaggtcatagaggataggggctgggaagcccaatggtagagcatggggagggtggcccgaggaggaccaggagagaacctggggcccgccagtggggctgggggcaggcagtgctgggagagcctcttcctaaccaggcacaccttacagatgccattgatgcagaggtcccggctggctcggacctggtagcagggggtgccatcaaccacggcgtcccgcagcttcttggcaaagtactcattcgcgggccggcagtgcagctcacaggggttcactgggggcccaagtagaagagtcatcagcaacagctggagcgggagtatggaggccaccaggaagacccctccgtgacacacatccatggcaggctggaggctcccaagcagcacaaacatgctggaggctccggctgggctggtagctatctgcaaggctgcagactggggagctaggggcgagcagcagccccaggggacagtgggagtggcccaggcttggggtggagactgggtctcctgcttgcatcacagggtaaccttggacccacaccccgctcgccgccctctgagtctcaatgtttccatgggaggcagcactcaccgtcattgaccatgggcacccatgtgtgcagctggccctcgtagagcatagcgtcaaagtggctgcactggacgtggcggaaggaggggcggccagcggggcaggcctgcaggttgcagaggcggaagcgcttccgcttacccacacagtatctgcctttgtatctgggcctgtggggagaaccggggtggaccccagtgagggcccagtgagtgctactgcatggccacagcccagagcaagcagcttcctcctgcacccacaccccaagatccctgctgcccagctttgtgcacgctgcttccctcccttgggttgcccaccctgtggcccagacacaccctccctgtctgtagggacctgtggggaggtggcagcaggaagcctgagctctgcccccaacctgctgtgtgatcgtggacaagtcttcggccaccctctgggcctcagtttcctcatgtataaagtggggttggggctgcccctgcagagggctgttgagaagctgggacaagctgcaggcatgactggcactggctggagggactaatccgagtctccagcccatgacaccagcatcctaacgagcccttgagtcctcagccttcctcctggtggcagtacccccagcctgggtctaaaggaagcgcccagggccccagccagctgaaaggtatgatggagcacagctcctgaaatcctccacatttaggccagggtcgctggcctccactcagctcagacctggaggccaggaggcagggaggggcacaggccagtcttgggtaagcgcagggccctgggtggggccgactgtgaaccccatgcctgccccgggtggcctcctgaagtgaagatcagccgggtagtgcctcggtctacagtaccactggcctctgcttctcaccagatcttcacaccccctgcgcccccccatttagatggggaaacagagatccagagaggtgaagtcactcacctcaggccaccccttcagtgctgtcccatcctcccagctgctccatctcatctcaggcccttgttgtgtctctgaggccaccaagcccctcctgctgagtgcccactacagatgagctgcagggctgaggggctggcctgcataaactgcatttgcccctgactacaactttactggatgggcactgctattatacaggtggggaaacggaggcccagagaaggggtgaagaggggattcgaaccctgagccatctaaggtccagggcccatgctcttccccactgccctctcctgcctccttccagccagcagctgctttgccatgtggcctctgatgagtctctccagtctctgggcctcagtgtccccctttctgcaaaggggtcagcagtggggaccctgtcagccctcagaacactccttgaaagtgactcaaggtggcctggacactcagactgaccattatgaggacacttctaagagccaggggctggcacagagccaagctcctgcaatcggctgactgcctgggtccctctgtcccattgcccagggcaccctgggccccacactcacataggctgcatgcactgctgcttggctctctgtatgcccacgccacagctccgtgagcagatggaccaggcgctccagccagaccagccaccatccatggcctcgggctggaagcccacaggtatgcactccccattgagacaccactaccgagacagacggaggtagagccaccccacccccaagcctatcagtcatcctcaccctagtaagaacaaggtgtgtgagaatgctgcaaaaggcacagaggggaaggatggaaggtgagagaggccccctcgcaatcatcacaatcatctgtgacccaggccacatggaggcgctgagcagggagtaaaacagcccacgtgctgactcagctgaagacaccctggagaatcatggaatcaagccctggccccaatgcctccactttgcagacgggggcttgggctgcagagggcatggggctctctgtgagccggggctgactccagggcccggtcacagcaggaggtctggcctctcacacatccactgccgggactgggaacatcgcctaccttattctccccacaccggatgccgtccacggctgcatccagcttggagtgacaggtggtccccacagagcaccagagtgtgtggcagacattctgcgaggaggagggcatgggccatagcctcacctcctccccagtgccgccacccaccctgcccccctccctgtccccaagggtccctgggcacccctccacatggcaggggcccacagacccccagaggtcccttcttgtgtgtctgctcccaccttcctccccagaccacgtggtggtgtggggcgcccggggctgcactgctcagagtggtcctcagctgtccacacctctcccggcccagcgcctcctctggaaacactcctgttagaagatcacttcaggcgatcttcgccaggataaatagaccctccccacaggggttccttttccctcttatgagccagctccagagaggcgaagggacttgcccgaggggtcacagtcggtccatggttgacccagaattcagagctgggtctgtggccgcccatccctggcctctcccacaggccacttgacgtctcacagtgtcactcaggggcgtagcccagcccaggcgaggttgctcccaagctggcatccacaggctggtgaaagctgtcccctaagccctcctgtcgggtccccacacccccacacccacaccggccccactcacatccatgtcctcgcagaaggcagagtaggccccatactggaggtggcactggtggctcacatcatagaggaccccaggcagcactgatgggaagtcaatgatgtccttggcaggcgggtcatccaggcacaggctccacccatggctagagatgggacgggaggatggaggggggcgcagcctgtgagacccatcggagaagcctcggtgggaccaggagaggaggagaggtgggagggggcacagagccctacaactgtaggaaactccagcctccccgctcggctcagccgatcctccacctgcagccagtagcacaggccctcccagccaatctcatctcacctcctgggcactccagctggctaaacaaccccaaccccaatcccaggcctctgcacacgctgccagggcccttccctcagaaggcctcctggaccgccaaaccctcatgtggccctgctctccgaccctgcagcctccgtgtctgagcccagaccctggagccaggcccgacaaggatccggagaatatcacatcacagttgacacaacagagcctccgacggccccacccaggcagagacctcgggtcatctgtggaagggcaaggtctggaaagcagcccctcccctgggagagagcctagggcatccgtgcctgtcccctgtttcccccactccccaacagggctggcctccagcctctgtcataccctatctactcctgccttcctccagctggcattccctggcagcggtggcggggaaactggcagacacgagcaggtgccatctgtgtccaccacacgctcctgctgctgcggtgtggcgaagacaaggctgcccagaccaccacgaggcagcgagcgtggagtccggggccctggggagggcggcccaggcccagctggcacctgcttctgcccctgcctcactctgtacagccctcaggcatgctactgcttctgggaccagtgaccagcctgctgtacctgctggaccttaggcggccactacaacggcttagcagcaggagtgccctggcatgctgaccagcccacccacagctcattgctgtcctggaggaaggtttggggccctctgcggggcagcagtggctggggagaattgagccatgcagacatgcggggctggggatgacccaggcagccacgacttgggcagaagcatggaaggaggcaggacccatgggacctggggcctctagccaggcaggggagatggggaggcaaaatccctccagttctccagtctgggtggactcagggtaggtggtgccaggccagatggctgggatgagcatacagtcctgattgggacaggcagggggtcgcacagggaagaagggcaaaggtgatggatcctggagtccagcagggagagaaagagacactccgagatgtggagaggctgggagaacacgaaagggtcaggaaacagggccaagagtgctgaagacaggtgtggagagaggctaggagggtggatcagaccatggaatcccgaagcccagatttcagaggagggggcctggcagctgggagacccagggtggggtgggtggtctgtgtggtctcctaagtcccctggccagtgacaggcccctgactctgcccagagctgcggagaagaaagccaaggtgaccagacttctactgagaaccctggaatcctcctggaatcactcagactgcccatcatggctggaaacagatcctctaacatgggcgttggcagatgagcagctgctggatgcagtcctagtgcccaagatgaccacgtgccagactggtccagggtgctgggggcataccctctcatttgctcctcacaacatcctgggcagactctaccatcatcttccctcatgcactcagggcccatacgtcacttgtcccgggtcgcgcaagagggacgtgatggccaggacctggagccaggcccaggctgcctgcaccaggctgtgtctactcactgggctacccccagtgcagggctcctcccattcaactgcgagcctggcctcaaatacttcaccccacatacaagttcaaaaccatggcagcgaggcctggcagggagaaaggagtgtcccaagttctcctgcggcttggggctccctgagcctccctgggcctgcacccagggcagagtgtcagccgggggtggtggggtcagctggccctgggctccctccttcccgccatcattccgtggctcgaggaggtagactgggggctcacccatcccagccagggggtcctctgacccaggggctgaggggtccaatgcgcctcatcccggcaccaacagtccctgggctgcagccgagcccttttgtttcctggctgccccagtgctgactcgctgcacatgtggctcctgcaggcctgctgctgggcagctgaagccgcaacaacctctcagcccaccctggatgttgggagaagttgggagcataaggtgaccctcacagaatccactgccagaatcaggcccaggtgctgtcttgggagtcagaaactcaaggtggccgtcagccagcccttccttcctctggcaggctgactgccaggttctctgcactgccgacacacccggatcccccaaaccatcagcccttcccctccacgcccctccttaagctaactatagcagggctgggcagtcccacaagaggtcaaagcagacagtaggtgactccagtcagaagcttcactctcacctcaagactgcaaagagctgcccaccactgacaggagagacatgtgggcccgctcccctggccacccctgggatctggtcatggagtcactgcatggggtgtccatggggtgaagtgaaggaccccacatgttacctagcctgcctctctccctgtagaaatgctggctttgaggaaaccagggaccagggcctcccctcctccccacccaggtccaagttgacactggcgaaatgctgtgacctctccccaaggtcccataaagcacctgtcagcccagaaaggttcttagagttcttcaggtcaaccctcttggacaggccagtctaggttcttaaccaccaaacaaaactcttctctgcttccaatcccaccccccaccccagtaatccctcttccactggaggccagtatccttgctcttacatccctaatggacctggtcacatccctgcttaagccccacagtgagtggacttctagaaaaacatggcacattgagcagacagatttatcgctgcttccttccaagactccactataatgacagtagaggaaataaacaaggcataaatccataaggggtgatgatgagtaatgaaggatgtcaacaagattctggaagctgggaagcagatggccaggcagtagctgacttgctagagtgatgaaagctgagagtcagattcctgcaggggggaaccacccagaagcagaagcccgaaaaggctcaggaactgagtttgcagggactcctcagggccttagtgccaggagggctgaagacagtagggctgaaagtctgtaagaaccgatcagaccctagatcccctccccaaccctgagtagccaagtgacggccacctgccatccagcagagggccagggatcacttcctggagagggtgaaccaggaggctctggcccaggaacggtggacacacatgaaggcccaaggcagaaggacctacagagaaaaggggacaagcaaaagtctacacattgaagggtaagaaacacgccaagcccctttcccacttggatgctggaatgctgcagccagacatacactctcccaggaaaagtcgagaggattcctctcaggaaactgaatcactcagaaaaatgacctcagatagtgacattagaggatctccccaaaatagccccatctgaaccagtccttcagcagtgacttggaaaagtcctgcccaagtccacaaactgcccaattagtgtctctgcatctccttgctatatatgaaatacagccaatgcattttaagaaaacttttctttgagacagagtctctctcttttgcccaggctggagtacagtggcagaatcttggttcactgcagcctttccctcccgggttcaagcgattctcctgcctcagcctcctgagtagctgcaattacaggcatgagccaccatgcccagctaattttttgtattttttttagtagagacaggatttcaccatgttggtcaggctggtctcgaactcctgacctcaagagatctgcctgcctcggcctcccaaagtgctgggattacaggcgtgagccaccatgcctggccaagaaaactgttaacatgaaacaaatatatttttttaaataacccaaaggaaataaaaacatttcagggaacagaagaaaaaagtcaaatccgtgtaagtaataacctcacagagataagagaacacactgtacccacaaaacaggaataggatcaaaaggtgcacaggttgagtatctccaatcccaaaatccaaatgctccaaaatccaaaacttttgggcactaacatgatgctcagaggaaattctctttggagcacttcagattttggactttcagactggggattctgaactggtaagtataatggaaatactccaaaataataaaaaaaaaaaatccaaaatctaaaacacttctggtcccaagtatttcagatatgagacacgcaatgtgtatttagtgagtgagaaagttcaagaaattaaaagtacaatgaaaaaaatcaaaaatttaatagagggattgtaaagtaaagatgagtcagatacctcctagaaaatagagatggctaggcacggtggctaacgcttgtaatcccagaactatgggagactgagagaggattccaggagttcaagtccagcctaagcagcatggcaaaaccccatctctacagaaaaattaaaaaattagctgagtgtggtggcatacacctgtagtcccagctacttgggatgctgaggcaggaggatcatttgtgcctgggagctcgaggctgcagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagaggtgaattttcttatacacacattttaatgggctcgagcaaacatttttggactgaattcatagaagtagaatttctggaggaaaataatttttagggtttttaatagaaattttcaaatcattctccaggaaaagtgactcaggttatactcccaccaacaaggacagagctccagggtcccctttccatttgtcatctttcctgcctttatacagaaaatctcattgttttcatgacatttctttgatttcttgtgcttttgaatctttgtatatgccattggccatttttattcttgtgagaagtgccagtttctccattgcccattttcggttgaaaatcatttgtttttttttctcagtaattttaaagatttctttatagtctaaggatacaagccttttatctgtcattgaggtgacaaaactttctcccagtaagtaatttgtcatttcattttttcttcttttctttttcctttcctttccctttctttcttttccttgtttctttctttcttcttcttccttccttgctttccttttctttcttgctttccattcttactttcttttcttttccctccctccctccctctctttctttcctctttctttttctttctctctttttctttcttctttccctctctctctttcttcctttcctttctttctctttattccctccctccctccttcttcccttttttttcttgctttctttcactagccaagctccaaagtcacatttcacttaatttttatcctgccaaatttgaaagccttttaacttcgtgattttagtgtaaacaggagcaggagaaaatgtaattatctaagtctcgctgtgtcacccagactggagtgcagtgccataatcatagctactgcagccttgaactcctcgcctcaagcaattttcccacctcagcctgccaagtagctaggactacagctgtgtgccaccacacccagctaatgttcaaaaatttttgtggagatgtgaattctttatgctgcccaggctagtcttgaactcctgacttcaagtaatcctcccacctcggcttgccaaagtgctgggattacaggtgtcagctactgctcctgactgagagtttagttttgtttgctagtggtgttcttggtatcttttcatatttgaggttttgggctagtgctgaagtattacactcaccatccgaggtctacaggacttttggtttaatattgaacagatggaactgtttagttctgcatctttgcaggtatacagaatgtgcctaccaggaatctgctttatatccattgaaagcaagaaataatacagtaaaactttgcctggctagaggctttgaaagaatggcgtattctggtttaattctattactttggaagtataaaggtgaaaaaaattcaaaacttaaatttcctgttgaatgcaatttgaaaatatagccaatgattccacttttcttctctagtaaggttggacattctgatctacttggtgttttattatagaactgctagtgtgcgtgagtcttacattgtgaagatacttttttaaaacttgagatgtaagaggatgtaaacggttttgtaggagatcaggctggatgagaacggacacttgtaaacatactttttagactaaatctctgattgccgcttgtttttcttatggaactcatacaaataaaacacattggatggagggtgcgagtaggaaggagattcttgtcttttaattgcatgtcattgtttcataacaaggcagaacatatggtaaccctggctttggacctacagaaggaaacacatttttctacctgctgtatgccagaggttcttgaacacttggagggattactgcagcacagattgctgaaccctactccagagtttctgattcaccaggtccagggtggggcctgagaatttgcacttataaaaaggtctcaggtgctgctggtgctgctagtccatagactacattttgagaaccactcttgtctattaagtgtaaattgtagaactctagaaaaaagcttagttcagtctgggataagaagcacacaggttatggagaaaatcatgaaagattcaacccttgatcccagcctagtgtggatttcaggtaacaagcagtacacagtgacataacacaattcttggttttcatgattgcaagtcatagccaggtatcaagtgagaaattcagtttcatttgcaaggcctagagaggcctggtgattctagaaaaatgggccttgtatttgttttaaaccagtaaagagctttaagtgcttattaaattgtaagttttgtgttcctacttattttgtatcttattttattttattttatttcttttgagatggagtcttgctctgtcacccaggctggagtgcagtggcatgagcttggctcactgcaacctccatctcctgggttcaagtgattctcctgcctcagcctcccaaatagctgggattacaagcacccaccaccacacctggttagtttttgtatttttagtagagacagggtttcttcatgttggccaggctggtctcgaactcctgacctcaggtcatccacccacctcggcctcccaaagtgatggcattacaggggtgagccaccgcacctggcccaaaagctttgtgtttttaaagatattagacatgtttcttgtttttaaaagaaatcttaacaataatgtaggagaataagacaaacatttttccaaaaaagagaaattgttgtgattattctctgttattggaatgtcggatactatagtcagcttcattaatcatcaagaatgctatggattttccatttttatagggtctatatctcagttaaggtaatacttgtaattcttgtgctccatttgaagatgaaaaatataggccaaaatcatagactttgcatagaagctgcataatgaagacagctctggaggaacacatagatacacacagacacacatatataaagtatatacacatatattttttaaagtttatttttaacagttttaaagcttttaaagcaaaagccagcccctcccctctcccagagtgggcggcccctcccctctctctgagtgggcagggacagcggttgcatgggcagctttccttatgatgctacaggtccctctggacatgctgcgcctggccacgcctcctttccctttcatctttctcactgaccaatgggcttggaacattaaggccacgcccctattctgcgttccattggtgccctggttacgccacctgtggctcagttgcacagctgcctggtaggtgactggaggcattgagcagtgctcactggtatttcgctgatgtggccccaaccccacctccctccccaccccgcgatgtcagaaaaaacacaacaggggaaattggccgcagccaagaaaaaggtaaaacacaccaggtcatggcccccaacccagccacagatcccctccgatgacaagaccggtgccagagtccataccactcctgaggcataccagatggggccccccaaccccagcccctctgggctcccccaaccaaagcctagtcagtcagccccaccccttcagcaagcagcccagtccctgcccttgccaatcaccccagggtgactttgggcaggtgactcctggggctccctgctccataatcagccctcacctcctgccaccccaagcccaacctccctgggctctttgggcttgcgtctcccaggacctgggtcccccagccccaggccctgccctcaccagtcatccctgggtggctttgggctggtgactcccggggctccctactgcagactctgccctcccctcctgctgccccaagctcgacctccctaggcttcttgggctggcgtctctgaggacctgggtcgaaaccgtgtgtttccctcccccatcgtggagcagcgactcgggcatcgcgctgatgtggtcccctcccctgggaggagtggaatgcaatgatgtcacagtgcccctaggaactgtcattactgctgcaagaccagcctttgatcttacaacccagtcccctaagttttctcaccccatttctggttcctctggttgcagcacaaatttccagctggaaggggagtggagactatgggacctaggagcaagaggtttcaggctgccttactcccttaacatagacattgacagtgggaaaagcctacacttcccctgtgagctcaaaatgttcacagtatctctgggtggcaatgggagaatgggtttggtttggttttttcccaggcttctactttccagagagactttaacatttttttctgagttctccacggttctgggaccagactgcccttcagtcagtggcctctgaagtgagatttgctcatcttctgtggaatagatcttgggaaactgaacttgacagcttgaatcttcctcatatcgtctcaacctggggtactttgagtgccacaggataaatgcgggacatctttctgaagcatcattttcccttgattctcttgagaaaatgcattaatgtacttagggatgacagacacataggtttccaagcgtataccagacttcgctctgaaatgaggcttgggttgtcctctttctgataaattcccagatttaatagaaaagctgccttctgccatgaggacacattgatatgaaagtgtgagaggtactggtacgcttcttcacgctagcagacctgtgaggatgtatgactctaaaccacacggcctacagttcctgcctgcttaatgtgtgcttttctacctctgcccctggttttggtccctggaagctgctgattcatggcaaaaccccagagcttggagtcagaggactgagtttaagttccagtattgccttttttgatctttctttttttttttttctatccatgatatcagtccctctcagtcactaagtgattgtgacaacaccttgtacagttgttggtggcattacatcagatggtatataagggtattttgtcaaaactgtaaaggaggatgtggctgtaggggctgatcattctcatgagtgttaccgctcttctttcccacagttaaaagcatattggcagaggaagagccctggcattccagcaggagctaacaggaaaaagaaaatcaatggcagtagccctgacacattcatttctggtggttaccactcacctggggatgtgagtctcggcgggccaggctcctggggacagggagcccaaggggcagtagagggtaattgttaagattgtagatggactgttgggtactggttaagaattctggatttgaatcctgcctctccgtctgctaagaattgattagggattgattagcatatgatttagggcaagttgcttgaggtctttgggcctctcttttcacatctgtataatagaggtggtattttttgacttccatttgtgaagtttaaatgagattcgttattgttgcttttatgtgaatccttagtacatggcctgctgcaaacacccaggacaccgaggaaatggtcgttgctgtttgattttcctcatccccagtctcaaggggaagccaggccaatgagaagagccacttgccatcaggctgtccctttaggagtcactgaaagggccccagggtgggatggtggggagataagaaccacgagagaagttggcacaaaggagttatgggaaaaaggttccaagataggcagaaaagaagcttttgccagttgatgggggaagaaaggaagtcagagggcttagacagtgaggggggacagaacatctccatgtgcactctcatctcttggagtcagcaacaggtatctacggggagggccgtgcatcctctactaccctgcaggatctggaggtaagaggccctgggccgaggtgcagtgaccctgcaggccagccctccaacctcctcccacagcaggggcttgttgcccctctgccagctgaggcagcccacacacccccaccagccctaatgattattctctctacccctccccacaatcttcctccaactccttctctctgcatgcacctcagagccagtaccaagaactagcagtagccctggattcaagctccgcaataatcagtcaactcactgaaaacatcaattcactggtaagagtccagtggggtcccctgattacagctggtcaatcctggactccagtttcctcttggggccctgaagaaaggggctaggggcccctgatgccaagggcaaatggggagctgggcacccaggtctcacctggagggaccccagagcacagaacatgcagcatggctcttctgcactgccctctttgctgactctctcttctccagacacccctgctctagtccttgccacacatgccctggggttgtcacctctctgggaagcactagcctgactggttgtcagaggtccatattcctgccctgcctcagtccctaatttgctttttgagtctggacaagccatctctcctctttatgctcgtgtttctggaggaggtagagagtatcaaaggtctcggttagctctgaaagtcagagatttaaaggcccctagaatggaaagctcagggcgaagggctcctgtctgtcctttgctgttttatatctctgctatgaagaactgtacctggcctgtacatgctcagtaaatgtttgttgaatgaatgcacgtttctaaatcacaaactggcagaaggggggtgggcctttctcaaactctgtctctggacgttcaccagcccctccctccaggacccttttccccctttgctttgggtaggttcgcacatctaaggaggagaagaagcatgagatacatctggtacagaagcttgggaggagcttgttcaaactcaaaaaccagacgggtaagatggggctggcatgacctggcagctggactggcattagagggctgtgggggtgacttagaatgccccagggaggtgggtggatggaagggctttgaggcagagggaaagaggtctgtgccaggggaggacaagtcttgtcatctccatgagcctcagtgtccccatcagtaaagagggaggagtgcccattgtcagccacccacagtgctctctatctgaaagtgacttggaagattgtctaccatccgggtgtgaggagtcattagcagtgaggccaagtttgggaagcctgagaggaggagctgtgcaccaaagggaggattttttttttttttttgagaatccagaggcccttattctctgcttgctttctcagctgaacccctggccccacagcccccagcagggccatctaaggtggagcagctacaagatgagaccaaccacctaaggaaggagctagagagtgtgggaagacagctccaggctgaggtggaaaacaatcagatgttgagtctcctgaacaggagacaggaggagaggctacgtgaacaggaggagaggctacgtgaacaggaggagaggctgtgtgaacaggaggagaggctgtgtgaacaggaggagaggctacgtgaacaggaggagaggctgtgtgaacaggagaagctgccagggcaggagaggctgctggaagaggtggagaagctgttagaacaggagaggcggcaggaggagcaggagaggctgctggagagggagaggctgctggacgaggtggaggagctcctggagcaggagaggcttcggcaacaggatgagaggctgtggcagcaggagactctgcgggagctggagaggctgcgggagctggagaggctgcgggagctggagaggatgctggagctggggtgggaagccctgtacgagcagcgggccgagccacgcagcggcttcgaggagctggtgcgttgccccacctggggaggctgccctcttccctagccctcaaggcctttgtttccccacctgtaaaatggggcattgtagccttcacatgaaatggtacttctaaaggcatctgtgagccagagccctgctctgatggctgtgggagagaggggatatttttctaacctgcctccacccttcccggtgccatgggaggcagacactaagttctggggtctccagttttagtgggtggccactgattgcttctttctgtccagaacaacgagaacaagagcacactgcagttggagcagcaagtaaaggagctggagaagtcgggtgagctgaaagagactgtaacctccgacccatccaagaagatgtgggaggcgggcaccagcctctggggaggggaggtgccaggccacaggcagctgcagcctggggacaggtgaccccagcaccctccggggcagtcctatgactgtttcttgcttcctgccctctgacttttagaggtgggtagccctggggtcctcccaggtctggacatcatcatcccagctagaggcatggagccccccaatcacagaggaagagacagtggtataagaggctccttatgtcgggtgtggtggctcacgcctgcaatcccagcactttgggaggctgaggcaggacaatcacttgaggtcaggagtttgagaccaacatggccaacatggtgaaagctcatctctactaaaattaaaaataataataataattagccaggcctggtggtgcatgcctgtaatcccagctactcaggaggctgagacacgagaatcacttgagcccgggagatgaaggttgcagtgagctgagattgcaccactgcactgcagcctgggacacagagtgacactctctcaaaacaaaacaaaacagaaaaacaaaaaagactccttagattcaaactggattccggcctcggttccactggtcataattcaactactttgcatctctaagtctctgtttctttaacttcaaaaggaagttagccttttccttgcagaggtgctgaggattaaatgagataatacgtggaaacattaggcatgtagcacacttagcagatggtggttggctccgcctgcttttccaccagtctgtggcctacagtttacatgctgggaaaaaggacgtgagatttgatgctagggaaggaggcatggggttctaagcaagggagacagtctcttaggcctggagcaaggggccaggggcctgggcaggccacagagccccacagtgccctcgctaccctattaatgggccaggaatctggaagccagccaccacatgtcctcatgcccagggtcttccggcaggtggagctgaagagccaagaggctccgagtctgcagcagcagccagaccagtacctggagccccattcccacaaggagcttggatgtgcggacaagcagggtggtgagtagagccctcaggcggggtgggcaggcaggagcaggggaggctcgcactgtgcccagattcccaccccctccctctctctgaagatcttagtgagctgagcctcactgatagcatggaggctgcaccgggagaggacagggagggttctcccccatgacaaccccactgcacagcagatccagcagctgcttcctctaatgcaggactccccaggagcacccaggcttgagtggagaagctgttggtacaggagaggcggcaggaggagcaggagaggctgcatgccattcttttcgggctgccgagaacagggagctaaacatcaccatcatctaagagcgggtcaagaaattgaaaaaaaaaaaaacaaaacatttaaggggttaatatcctacacaattcatttacttcatttgaatgttagagccacttatgtttgtgtttctaatttatagtttaaatttatttgtgtttctaatttatagtttaaatttatttgtttctaatttatagtttaaatttatttgtgtttctaatttatagtttaaatttatttttgtttctaatttataatttaaatttatttgtaaaaagttaaatgagagtgggtctttctctcatgttcactctggcatcttttagcatttttttaatttgataattataggacgttagcatgcatatcgagtttgcccttatgtggtgggagttcaaacacacaaagacccactgtatgcacacaactgttcttgctggtttgggataggctgccatgcttttttaatgttagtacagcctgtatattcattacggaattcagataaaatttccttatgttctgctgttatgtttgatcgaatcctaatcacagtgagctcttcattagctcaatatgtggtttgccctctggaaacagcctttccccctttttctgtgtattggggatgggagtaataacattttggggaggtttttaaatctcccagaagaggaaagtggcctgctttggcaggtgtgtgcaggatagaatatgtttcatttgttccggtgccaagaatgagcgctgtactacggtagttcccttaggatttgtatgtgctctaggctcatgaagatactgcctcatgagctgtggcagttgtactcttttttgatgacctgaaaagggattatttctgaggaatgaaaggctcccatcatgactgtggatgtggaaaaccttttctagctgagagcatttatatctacaatacattttaaagtcagagttcatgttccctgttttaatcacatgactacatgtcccagtacacaaaagggcactggttggcgttctccttaatgtatttagtaaagatcagaagaaatcctttaagagtttaaatgcccctggaacaggcatatacaggctctagtcaagaatgaattcgagtgaaggaaagctgtgtgacacctggcattcctctgtgttcatggagcttatttgaggctagaagatggattttaccatctagacctctctggctaatagctagtcttcaaccatctgacataggaatttacttcttttccttgaatggagaacactttaaaaataataacaaacattattataaactaatatatgtgagagtacttagttgaaacaaaaaggagttttagtagacagtattatactacatttgaaaatcaaggagcagtttatgcaacgtaaaacgtttacaaactgcagcacaatctactgttcgtgaatgtcaaagtgtcatgaggaaagtgtctatacaatcacagagttatatttcctcacaaagttctttacaaagagtgaaatatgtttttatacctctcagtttcagttagaggcatattttgtgtaatatttatggcttaaaatggactaaaggtcctgttcttgccttgtctgaacttgccgcttttgcattctttgagttcagtttaaagacagttactttaagcccattttaaaccctcaggctagaaatcgtaccactgttaattagccacattatttggtctaacagtttttgtttatcattctgaaactgagcttacctaatacattgataaattatttcaaaggtatttttatagttcaaatcgcttcacttttaccctgacacgtataaatgactaggaatgaccttcagatagcgtttagcaactgtaaccaatctgacaataatgtgttcatcaggtacctgtggattaaatcacatactggcatatttaagctgaatgtcagtctgaaaaataaatgtactatattaactcaaataccactctctgtgtaggtattttgtcatatgtttaagaaaaagctaaagagaatggaaatcctatgacaataactatgacaataactatgacaagtctttcttcaaagtgcatgcagtcttttgcagtacctcattcagccaagtatttgttctctacctcattcagtataaggcagcctttaatttgcttagaaggcaacattagaaggttagagttcagcaggaacatagaattttaaaatgtgacttcaactgaataaatttgaatttctgtagggagtaaagaatcaaaacacctatttaaagactgcaaaatatgataattatttttaaagtaattgattaaacctggtaggttttcccaaaatgaaaaacaatcagttctaaaaccaaagctgatttttagaaaatgtgaaaatgtaaatcaaccctatccataacagattctctaaaactttatcttacagtcactttcaaataactattcaaaaatgtaactgctatattaacgtcttaaaataatttaaaacattttaaaatatgaatactgtagtttaaaacaaagaatctaggggaaggaaaagtagacaaagaaatgccaattccagtccaaagctgtatttgccaagttttcttagaatgacttttaccgatttatgaattcttatacacagaatgcataatggaaatactgatttttgtctaaagtggcattattgactgctgctgtgatgctactataatgtaatacattattaaattgtttcaaggtgctgttttgcctaaaaattttgtgtgtcttgaaaactatagtactgggtattgagaccctgcaaattctcggcatgcttggcatgaggtaatcggtttttattcttacaaaattgtaactatgtaagtgtgtttattaaaagaacacaaactaaaaaagttaacaggaattaaagttgtgggatgaaaaagttacaggataaaaaaatactgtggaaaagtggcaaaaaaaagttgtggaaaaaaagtaaaaaaaaagttttatgaaaagttattttaaaaagttatgaaaaattagttacaggatttaaaaaaagtcatgggataaaaataaaaataaataaaagcaggcccctgtcagcataagcctggagaagtgggtctggagtcttcacccccaccatgtccctacaacccctccccagtcagccctttaccattagggtagcaagacaagacccttgtctaatggagggagacaaacagaccctttaccaccttgaccaaggctgagtccttacatttctggatgatgatgtttgttatttaagagccagaggttggtggagttggtttgtttggaggaggtctgacggccttcttactctcaccaaagcaacttttccctcaggggggctcccatcttcttactcagagaggcagctgaggcgggacagtggagttaactgtagaccaggccagggcacaggctgctggggttggccccccttcccccgtgtacatactgtagctgtgtaacattctgtattgtacctagcggaggttgcagctggcatatgaggaagaggttcttataattattcgcggctgggaaacttatttattgctagcataggagcgaggaaggaggcggggatggggtcatggctccctggtgatgggactcctgtttttttttttttttttgcttttgattttggaataaatggatttagccatactgctcggcctggtatgttcccatttccctcactgggtcctgcagtttgtcccactgaatgaggagccccagagtgtctcagcatgtccagctgggctgttggggaccttccaggcctgttacctgtatgctgcctggtgacacctggtggattttatggggactgccatggcgcctacggagtacactctggccctgacagccaactggttgagaagcctgatctagctgtggcagggaagacagataccagtgcccaagggcactgacttccatccaccccacgtgtcttccattccgtccccctgcctccctctcctgtctgcaccgggtggcctgtctgtccctccagagtgccggctgccccgcaggttccctccaggctgagttcagggccctgcccctagtggccagagctggcttcacagggtaagagccagctaagctccagggactttccaggaaaagtgtcccttgaaaagggtgtgaccttttcactgctcccaacaacaccctaaaaatggcttggccttttccatcccctgagctccatagagaacacagccagcagaggacacattctctgtcatccagaaatgggtttctcagtcaagggacagcaggactggtagagactgtcaggccacacagctgcctgcacagcaccgccatgcttggccagaagggcgggagggatggcgggggctggctgtccacaggccgcgcatgtcccggaagctcactggaggtggtgcactttggaggggcgatgtcaggagacagcttcctcttgctggtctacaagactccacaagcacagcacggggactgattcccagtgctagaggtgaggcagttggccacgtgtatatatgtatatgtgtgtgtgtgtgtgtgtgtgtgtgtgagagagagaatttatagctatttatagaacagggcaggggcataccacagagggggcacaagtttcagcaatggtcacacctggacgtgtcagctcaccgctacaacagactaagtcacagaagaagggggctggctttggagctgggggagccactgtcaagtcacaggacacccgcccaggcaggcttggaaagggaggtctctgagaagagggatctgtttagaggtcgaagtggggcctggggctctcaggatgggatggacttgcctgacccgatcagctggcagttggagagaaagcagagagaaaacgggttagagaaaagccagagctggtgaggcaagtgcagagtatgggtgcgctgcagcagctgtggagggccggggaggggagggcgtaggtgtgggcatggcaaggttcctggaaaagaggggctggaagggaaaggggaggaagatggagggagaagccggagcttcataggtagtgcctggggactgcggcggccctccctaccccacacacgctggcctgtctcatggaacccaggcaatccacccatccacccacagttcagaccaatgccacctccctcgggcttccctcttctgtggtccccatgtcttccaacccactggcccagggccacctcttgcttggagagccccatccaacagccaccagacctgatagagaaggaacactgattgaaccaaaatggtggagctataagggatggctggctggagtgaatgccagaggcccctctgggccatcagaaagcccagggtcctctgagggaccctggggaaggcagggagggcaggtagccggatgccattggccatagacttctaattctaacaggggagcctcaactggttggcggggggctgcaggttacataggtgaggctgggcccttcctgctgggaaaagcagaagagggagactccgcggcaggaaagggaagtgagctctctaggtggagctcagctgggccagcagcactattggctgaatagcacaggcgacccctagaagcaacaggccaaggtgcgtgagcctgctggccagcagtagtgcttcagcaggggccagggaccctgccttcagtcgcacgctagcagctatcatggtacctgggagggagggaagggggctgtgtgtccttccatggcctatgaagtgtgttgtgggatgaccgcgtgtataggactctcaggcttttatcctagatcaccactggattgctgacagatagaggacgtgggaccgtgactatcacccctaatctgcagtggatttggctcttggcactcccaggctgggagctggatacctgccctggcagcatgactcagactgcatgacaggtacggcgtgtccaggatgatgtgcccaggcctctggccgcctgagtccagccccccacacaaccccctccaagctcccagcccctacaccataaaccatgagctctgtgccctctctgatggttccacatctgccaccttgggcatggagcctgttgtaagagcccccaggctcagccatggagaccttgagcagtggcactgagtcccgtggctcacagggagcaaagtgagacagccagcagcacaaggacagaaagaggaaagagcaagtctgcagctccagaagggaggggcagggagcctggctctgaggctccaggtatgccccctgtgtggagctggggcagcggggcaggcagaccattcatgcagcaggcagtgaggcatgtacctaccatggctgatgctcctcaggggccactgatagtgattctgaaagacagcttcaaatcacatggcaggtcacatgcatgggtggggcaggcctgggggtgggggacacacacacgcacatgccggagtgtgcacacacatgctgtgaggccccacggcccacatgcacacgctaacacacatgcccacaaacaacacgcatacgtcgccctccccgccacctcccaatgcccagcaccctcaccggccggcacgtgccacatggatctggggcgtgcagccacacggcacactgaagcacatgcgtgggcagagtcacaacacagatgctcacctgcacacagaggcatttgcaccagctccctgcacactcgtgcctggcgtgctcagaggaccacccatgctgctcacggagacagggcttgctcactaatgtccggctgtcatttctccacctcagagccttccatggctccctactgcctacagcgttgaatcccaacaagtcatactctttggactttgaaggttctccaccctgtgccccaccctccccacagagctcttcctcattctgtctctgttccctgctttggccagtggctatccgcgatgtgacccacactacacctctgcccacactgcagctctttacccagttaccctccagttcctcaccatgtatgcctacctcagtcatgccccagactgcattgaagccaggctgccttgaagaagctctcccagactgcccttttccccaaggcagggtcatgatttaccaaaggtttcgtgtgtgttagcaagactggagtcggagcaggcatcaaactttacatcccatatgtcacacctcaccatagatctgggtgccaaatagcctgaagagtctgaactcacgctggaagttagcaaagtgctcctacagccgcatctgcagttaacatagtatccctatggccactgtctcccttgatccccacagccatcctaggagaaaggcagaacgtcatttgctagaagggatgctgaggctctgggagggaaagggacttgcctaaagccccagggtgaagcagcatctctggactctcatagacagcctagagctgccagcattcccttaggatctgtgccctcaggcctggcttaattttttcctctgcaaagagccatctgtagggccagaggctggcaaagcctgactcattactggatgccagttcctttgcctgactttcagtgatttctaccttaccctggggttttatgttgcttgtctcaacactgtcacttctcattcctccacaagttgaattgctcactccagccacttgaagcatgctcttcttaacacagttagctctaggcacatggttggtgctaaaaaggaaaaaaaaaagaagagcattatgtcaatttcattgattaacaaaagcgatggctccactgcaaagcaaagttgatactcctgggcctctgagttcaagagccttttagacaaatggctctgagctaaaacatgatcatgcatgcatatgcatctgtcttggtctgatgagataatctggatacttgcttgttatccttgagcattttcctgcctcattaatgtatgtgtagccaccacaataataatcatagctaataatggctacagctgagggctttcctgaaccaggcagtggttttaaaaactttaacccctaaagctgaggactttcctaagctagatagtggctttgaaaactttaaagttttcacatagactgtcattgaataatttctgtttttcagatcaagaaactgagacttactatcatatttgggattaagctaaaaaaaaaaaaaaaagaaaagaaacagaggctgaacgctgtcaagtatttcacagccagcaggaaatcggaacttgaacccaggcagtctagccctgggatcctttccccttacccattatccagtgttggctacacaaaactaatgagtacatattttcaactatagtttaagtgggtgacatatttttcactatattttatgtaggtgactttcagtttgggggtattctacttacacaatctattgagctggatattaactgagagcaaacagaaactaatgaactctgaaaaacataaaacatgagcaacatgacgtcactgcaagagacaaaacagcacatagccttcttgtgactgtattttgctgacagtccatgagctgatagcctgaactcagcagtgctgttcccttgggagacacacacacacacacacacacacacacacacacacacacgagttggtggttttctgccccccacccccaccccaacacacacacgagttggtggttgtgctgcccggagcctccagtccgcgagtgtgaagaacggaccagatgggtccagcagtgctgggtcaaggcgaggagggggcagccggaagcgcgcgcatgctctggactcctgcagccgccgaaacgggtgcgcagggggcgcgcgggttgaggggagaggggcgacgggtgtgaggggcgagagggacgggagcggggtaggggcagccctttcccaggcggtagcggggactgtggtgctgttgcccttttaagctgcggcttgacaggagcagcgtctcctgtcggtggagtctgttacaaggggagcagccgcccaggccgccacacagctccccgcagaggcctcggtgccccttgccattttccagccctactccgaatagagttgaggcatcagggagaggcggagctgggagagcgccgccgagaggtcccgcgggtggttgcggccgtgacagcggctcccgacgggctcaccttccgcgcccctcccgccagaggtgagagtaaaatgtccgtgtgagggttcaaggccaagctgaggttgttggcctctatcttccacaagaaccaggagccgccgccgcagctcacgctccactgcaacatcacggtgaggcgcccagtggcggcctcacggggcagggcgagggcggagaggaggcgcccagagtcccgggacaaaggggagcctgcccgggagaggccccggttccccaggcggggcgagcgcgcccctttctcccgcgtctggcccgccccgctgtgtgaggcttgcgtgggaggagggggagggcgcgtctctctggctccttgccgcggggctggcttgggggctgccggcacctctcgccccagtcgctgcgccctgaggtgggagcccgcgtcgcccgcagaccttttggggcccatgatcgccctcagtcagctagcctgctcccctggaccgcgacggggcgtggcagggcggctcccgctgttgtttgagcccagtgagggaaggggaaaggcctttaagattttcggttttttggccgggcgcagtgctcattcctgtaatcccagcactatgggagactgaggcagctggatctcctgaggtcaggagttctagaccagcctggccaacatggtaaaaccctgtctctactaaaaatacaaaaattagccgggcatggtggcaggcgcttcttgagatggagtctcactctgtcgcccaggctggagtgcagtggagcgatctcggcatactgcagcctccatctcttgacagtctgtcggttcaagcgattctcctgcctcagcctcccgagcagctgggattacgggcgcccgccaccacgcctggctaagttttgtgttgtttagtagagatggggtttcatcatgttggccaggctggtctcgaactcctgacctcaaatgacccatctctgcctcccagagttctgggattacaggcctgagccaccgcgcccagatccaaggcccttaagcttaaatgcctcgttcttcagtcaggttttccttgttcccgcatgttcagccaatcgtgtttaaggagaaactaacaatgaaaacggactcgttgatggaggaaaagttggaatgcagcctctggtgctgtttgagcgatccctctaccccgggtcgctgctgtgttctggaaaggcgcattgtaccctggatgcagcaggtaagagtcctgtccaggtgctctgcccgcttttcctttcaggcttctgtatcagctgtttttcccctgtagaatgtgcccctgacagccaccccctaaccctacccaatttgtctttacgtgtctgaccatcaaggctcttctgggtcatatttaattcatgctgatatttccccttcctcccctctttagtcctatttttgctttggttatgttatgctatattctgtaaggctttaaaaaaatttttatggtggcaggggagaatgttttataattatgctttgtgctttttatcttccactcaataaatgcttggtaaatatttgttttattgaatgtatgaccctattctagctatattgtgcttgaacaaaaaccttaactgcctagtaagttaactgctaagaatttgtcagaagtgcagacataacatcaagaacttgtcatggatagtgcaaaaacgtcacttaagggcttggtggaagcctgtaaattgacttcctatgaaagagagtgtaagaagtgaaaatgtaaagcatgactggagagccagagtgatgaagccagggtccctttctccagatcctttgtaacagtgttatgtgatctcttctagaagatcgttctgaaagataatgccaactcggaacctaggaaaccatccagtgggtttctgcagcttaggtgtttcaaatcctcatcagcacgtttgttttctctgcctcagtttgcttacaatgatgttctcagtagctacaattgctgtctttgaatacgtaagcatttttttttaggtgacagggatatatgtgcatttttattttaccaagtgttagaattttgactctgcttttgtgggctctgggttagctacttggttgttgtaaaatgattagcagggaaagctgtgtgtgtgtgtgtatgtgtgtgtgttataagtttcttttgttgtcagaggacttagaattttattttatatggtaattctgtcaatttactttattctccaccccacatttattgaacagcaaattatgaaagtaatgtgtcccataagcagccttcagaagaattacaactgctgtatatctgaaattcttttttttattttttattttgagatggagtctcactctatcacccaagctggagtacagtggtgcaatcttggctcactggaacctctgctgcccaggttcaagcaattctcctgcctcagcctcctgagtggctgggattacaggcacctgccaccacacctggctaatttttgtagctttagtagagacaggtttcaccatgttggccaggctggtcttgaattcctgacctcgtgatctgcctgcctcagcctcccaaagtgctgggattacaggtgtgagctaccgcacctggctgaactttcaaggagaagtttgtgcatcagttttcaaaaaattatgatatcaaaagatagctgtgccctacatttggaaagatacaaaaactgaacatactggcaggcagttttgcttgctggtgcttgagatagaggcacacattggtctcagtggaattatggagaaaaatagataaagttatttctaaataagaccaaaaaatccttttcttaagcagtgacaggtaaagaggttgtcttggctaaccttgaattgtgttgcccttgattgagacagttttatggtgggatggtagtggtgataaacttgctggaaatttgtctgcttatagtaacctttgtggtagctgtcacagacaacttcatcctcacaggccttgaaattagtataaaactaacagaatggaggagaaacaaaggatctgaataattagatgcttagataattgttctgtgttttcattactggtgaaaaagagcagtattagaagcacttacacattctatagaaggaacactgcctgaatttatattgcgatttttgagcaccattaactgtataaaaacaggcatattgtaggtaatattttaaagacaaacagaaaatttatcttttcaagatggatctaaaacttatcaaaattacaaaatttaaaacgtgattgaaaaatattaatgcataggtttaaatattggtcattttaaatgtctttcaaaatagattgtctcttaaatattcaactgaacaaactttgaacatgttgtagagtttgtgccgaaggttaaatttcctggggtgatggatattttgtaatatggaaaacaaaaccttcttattttaagaaatttagaaaacttttaggcaaaactagaaaatattacctatgtaattctaccactcagaaggtgccactgtcagaaatttgtatctttccagtcatctgctcacctcttttctcctgtgcttgtgtatgtttcctctcccttaaaaatcagatatttgtttgtaatctgctttttcactcaacagtattgtagatccatgttataacttactcctctacattgccttcagttattgtgtgctttctgttggatgactttaccatgtagtcagtcatgttttctggtactgaatacatacgggtatgtgtgtgtgtgcgtgcgcgtgtgtgtgcgtatttttttgtaacttaactaatgctttagacatcagtaggtagacgtaaatccttgaaaccttccacgtggtgactttcagttctcattgctgaatttgtttccagagatggaagaaattatattgtatgggaactttttttttcttttttctttttttttttttttgagatgaagtcttgttcttgtcacccaggctggagtgcaatggcgtgatctcactgcaacctccacctcctgggttcaagcaattctcctgcctcagcctcccgagtagctgagattacaggcgcatgccaccatgcctggctaatttttgtatttttagtagaaacggagtttcaccatgttggccaggctggtcttgaactcctgacctcaggtgatttgcccacttcagcctcccaaagtgttgggaatacaggtgtgagccgctgtgcccagcctttttttcatctcagtaccagcttttatttatcagattggtaaaaatgttagaaagtgtgcaatgaaatgggcattcttacagtcatggcaaaaaatataattatctttgactttctagaaagtagtttggctttctagaaacttgtttgaattctccctgtttaggcaggatgaattctcactaccccaaggtggccaaccttgtccctgtgattccatctctcccagaaagagaggtctagtctcagggaaaacccagatttgtttggcttagcccatctgacagctaatcactggaaatggggtaggctggtagaatgctttggtcaggttttgtgttgagagagaggtggaaagatgggagggaggtagcaaaacttgcctcagtggaactatgtaagttaatatagaatggcaaagggatgtttcttccaaggaagaaattctagagaaggaagaaagtggaggggaaggcagcagttctccaagttttggggtcaggattcctttacactcttaaaaatacattgaggtcccaaggagctttggtttatgtagggtatatctattggtatttatcactagaaattaaatcagaaatatttaaaatattgtttaaaagctcaccacatattgttataaatgcttttatgaaaagaaaatttctaaacccaaagtagtacagtcttacatcttttgcaaattattttgatgtttgatatgtcatttgcatgatgtttgatatgtcattagcaaattgatatgtcagtttgcttctgcattcaatttattgtgtgatattttcttgaaaaaatgtgaacaaaggccaatctcatacagataaccattttagatcattgtggatatatatatatttttcgagatgaggtcttgccctgttgcccaggctggaaggtagtggtatgatcatagctcactgcagcctcagtctccagggactcaggtgatcctcccacctcagcctccagagtagctgggactacaggtgtgtaccaccatacttggctaactttttgtattttttgtagagacagggttttgccatgttgcctaggcttcttttttgatactccatcaaatcttggtttttcttgaactttggatcttccacccttgcatgatattacaacatcgtgcattggtcacttataaaacagtggttcactaagatcttctacatgttgatacatttgtacagtatcaaaatacattcatcagtaccaccatcaatctcatcagaatacttttggaaagcgatggtgggcataagttttctaaaattctaattttttgttcaaaagcttgaattttattagtaattttgttattgaattttattatagcctgtctgttgttttccttgaaatgacagaatctcatgttttgagaaaatatctgccagaaatgcgagttaaaataacattttttgtcagtcagcctttcaagtaaaaatggtattccattaaagtggttaattcacttcatgacttagccactcaagggtttttcctcaggcagcctgtaggaatgctcatgtatacttcccatttcatcacttgaaatattaaaaagatatattcaatgatttagatatagtaaaatattcactgcttcatcatagacattcttttttttttttttaattttcgagacagggccttgttctgtcacccaggctggagtgcagtagcgtgatcacagctcactgcagcctcaactttctgggttcagtcaatcctcctgcctcagccttccaagacgctgggactacaggcatgcagccactgtgttcagctaatttttgtattttttgtaaagatgaggtttcaccaggttgcccaggcaggtcttgaactcccgggctcaagggatccccctgcctggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgaagtattttttcaggtatttcagcaaaaattaaatacctaggaataaacttagatgtgcaggacttttatcaaggacaggacaaaattttgctgagtggaatgaaagatttgcattctatgttcctggatgagcagatttcatgttataaatatgttagttatcaccatgtcttcatattaatttgtaaatgtaatttctgctgggcacagtggctcatacctgtaatccaaacagtttgggaagctgaggcgggtagatgacaattagctgggtgtctgtggcacacacttgtatttccaactacttctgaggctgaggtgggaggagcacttgagcctgggaggcagaggttgcagtgagccgagatcatgcctctgaactccagcctaggtgacagagtgagaccctgtctcaaaaaaaaaaaaaaaaaaaaaaaaaaactagaaaagtgtgtgtgtatatatatatatttcatattttataaatatttatatatataaattgtatatatacattttatattttatatatagtgtgtgtgtattatatatatacacacacacacacaaatttcagtacaaattctggcagatttatttttgacacttgacaaaacgactctaaaatttgtttagaagaataagtaataaaaattaataaagtatagacgctttcaaccagatagtaaataaaatattgtggactatccctgggccggacagataaaggcaatggaagtttagaaccagagtcatgcaaacgagaatttagtataaggaaaaggtggtattttaacttaatactgaaaagatagattattctgtaaatggttttaggagaactatttgaggaagtctgagtcttaactccaatttttgtcaaaataagttagttggtttaaacacatctattcttaaaaattagaacagaagaatattggtttgaagatattttaagagttaaggctgaggctgggcacagtggttcacgcctgtaatcccagcactttgcgaggccaaggtgggaggattgcttgagcccaggagtttgagatcagcctgggcaacatagcaagactctttctctctctctctctctcgatatagatatacatataaatatacgtatacaaatagaaaaaaaaaagagttaagttttatatggagagccatgaagataagaggtaaaaattaaaggcttgatggacacatgtttacatctccatcaagggggttgatgggaaagaatgatagacatagctccattactgctacctccttttaggaagttgcttctgaacatctaaagatatcagttttataatagaaatgagttatttttcagtgtctaaaacaccacatgagatacatacatacatgcatacatacataaatatgttcataaagttaaatgaaataggatataaaattgggcctagtgtttaaaaggtaaatatatttacatgaaggagaaaacaactcacctcccactcttagagcctctgccagtttatcatagcctagtttcttgagagaataagctacatgtcttcaccttttttcactgagctcattatactctggattctgccttcatcgttgcactaaaatttatctcctagttgtcaaatccagtggctcccctcttagtccccaaattgacccctctgcagtattttgatactgttgattgttcctttgttgaaacattcctccattcttaatgtccaccaataaagagttggttaaataaaaattatagtgtaccgttttataatattctgttgttctgttgtggaccaaaaaatgcagccagtctttccataagagcacgtgcaaacttctaagatatattaagtaaaaaagtaaggcataaaatattgtgtataatctgacccctttagtacacagtgtaaaaacatctgtgtctgtgcttctttatacttacttttttctcccctggtgaatacaggaaactgtgaatagtacaacacaattaaaaaaaaaaaaaactgtgtgtctgctgcaccaggacctgtgataattgggtataaaagacaaaaaagacatgtccctgtcctctgggaagggacatgataatcaaatgagacttctgtcggattcttttctcctgttttgatcttatcaccctttcttggtctcctccgatctcttcttccttgtcctacttcttctcttctcattctgtgctttctctgagtaatctttgactcccattacttaagtcatgacctgtgttccagggactcctaaatttgtattcatctccagagtttcaaacccatatatctgtctgtatatcatatatttagggaatctcacttggagtgacatgggtgttcaaaatgatgatatttaaattttcacgtatccatctcctagcactctatctagtcacatatgcctaaacctgggaactgtcttaatattcttttatatacacctgttctgacctcccccccaaactagtaaatttctaagacctgtccttctgaatgtctcttacaattttccctgtgatctcagtttcttcctcccatccctcaaatgctttgtgtgtgtgtgtgtggtgggggaagagagtaaaattgaaatttgtggaaaacgtactagcctgtctgtctgtctttcgaggtgaagtctccctcttgtccccctggctggagtgcaatggcacaatcttggcttactgcaacttccatctcctgggttcaagcaattctcctgcctcagcctcctgagtagctgggattacaggcacctgccaccatgcccagctaatttttgtgtttttagtagagatggggtttcatcatgttggccaggctggtctcgaactcctgacctcaggtgatccacccgccttggcctcccaaattgctgggattacaggtgtgagccaccatgcctggccactaccctgtcttgttgcttggtatgactccactaccctgctgcctctctccccgtacagcagcataatttaggaatcagagagactgaggaggatatatattatttaggtgcaccggcccagtcagattaacatctaaaggactgagccctgaacaaagagtcaggttaccttttaagcattttgtgtcggtcattatgccgacaaggtgtccgcactaagttcagtatcagtatggtgacctcctgggaacaggtcatcggcttgcctaaggatgggagaactggcccaggtcagaaagggagcaggtcagaattcctgcaccaatcggtagtgggactgtgcctgggcaatatagcaagatcttggttcttaaaattcaaaataaagaacagctcattcccctctggggaggggctggctcaaggttacacagtgagtgtgggggcagaggcgggcccactgtacctcccttgttgggttgtctgaggacccctctggccaccccccacaggagatggaggaggacatctggacagtgagcaggaggcgcttcggcccatgccgaacatcccaggggacctggagagccgggaggccatggtgagcctgactttccctgcccctactttgccaccttcctctgtggtccctccgaaacccccttatgttcttggtttccccgccttctgacttctgtggactttctctgcttctgggagccagtggtcagacaccatttcacctgtgaccaacaggtgcactctgtgaggcccgaaaggaaggggctatgctccatctgcctgccccagttgttatgtgtatacccctacaagaatactcacctcttgtcttcaggtggcatttttcaactccgctggagccaatgcccaggaggaacaaagggtgtgctgccagcccctggctcacccagtggcctcgtcccagaaaaagccagaggtagcggccccagccccagagagtgggggtgagtctgtgtttggggagacccaccgggccctgcagggggccatggagaagctgcaggtgagtaggtcctggcatcggccaacaaggggggcgggggggcaggacaaggcaggtgactcctgacatgtgaccccattattttggctccacagcgactttatggaaggagaaggtggacctgaaggagcgggtagagaaactagagcttcaattcatccacctctcaggacagacagacaccatagggagtgagaggctagggcaccgctggggggagctgccaggccgtccgaggggccccagcatctgagccatgtcctcctgcaggaaagtacatcagccagggggcagtgtcagagacgcagcactgggagaggaggacatcgtcaggctggcccaggaccaggaggagatgaaggtagggtgtgcaacatctcggtgggggagggtgggggtgggtgtgaacgtgcgtgctggcaccggcatggcagctaacaccccttcctccaggtgaacctgcaggagctgcggggcaggtgttgcagcttgtgggagaccacaaggaggggcatggcaaattctgaccattgcccagaaccctgctgatgagcccactctaggagccccaatagcccaggagcttgggtgtgctgacgagcagggtggtgagtagagccctcaggcggggtgggcaggcaggagcaggggaggctcacactgtgctcagattcccaccccccctccctctctctgaagatctttgtgaggtgagcctcactgatagcgtggaggctgcaccaggagaggacagggagggttctccccacgacaaccccactgcacagcagatccagcagctgcttcctgtaatgcaggactccccaggagcacccaggcatgggcagcaacccctgcatgccattctttttgggctcccaagaacagggagataaacaccaccatcatctgagagccgggaaggggaaggcgtaggtgtgggcgtggcaaggttcctggaaaagaggggctggaagggaaaggggaggaagatggagagagaagctagagcttcataggtagtgcctgggggctgtggcggtcctccccaccccacacacactggcctctctcatggcacccaggcagtccacccacagttcagaccaatgctcaactcccccggcttccctcttctgtggtcaccccatcttccaacccactggcccagggccacctcttgcttggggagccccacccaacagccaccaagcctgacagaaggaacactgcttgaaccaaaatggtgaagctgtaagggatggcgggctggagtgagcgccagaggcccctctctgggcagtcagaaagcccagggtccactgaagggaccctggggaaggcagggagggcaggtagctagatgccactgcccatagacttataagtctaagaggggaacctcaactggttggcggggggctgcaggttgcataggtgaggctgggcccttcctgctgggaaaagcagaagagggagactccgtggcaggaaaggcaggtgggctcgctaggcggagctcagctgggccagcaagcactgtggtctccttggctgaatagcacaggtgacccctaggagcaacaggccaaggtccgtgagcctgctggctggcagtagtgcttcagtagtgctggccagggacccagccttcagtcacatgctagcagctgtgatggtacctgggagggagggaagggggctgtgtgtccttgcatggcctatgaagtgtgttgtgggataaccgtgtgtataggactctcaggcttttatcctagatcaccactggattgctgacagatagaggacgtgggaccgtgactatcacccctaatctgcagtggatttggctctcggcactcccaggctgggagctggatacctgccctggcagcatgactcagactgcatgacaggtacggcgtgcccaggatgatgtgcccaggcctctggccgcctgagtccagccccccacacaaccccctccaagctcccagcccctacaccataaaccatgagctctgtgccctctctgatggttccacatctgccaccttcggcatggagcctgttgtaagagcccccaggctcagccatggagaccttgagcagtggcactgagtcctgtggctggcagggagggaagtgagacagccagcagcacaaggacagaaagaggaaagagcaagtctgcagctctagaagggaggggcaggcagcctggctctgaggctccaggtatgccccctgtgtggagctggggcagcggggcgggcagaccattcatgcagcaggcagtgaggcatgtacctaccatggctgatgctcctcaggggccactgatagtgattctgaaagacagcatcaaatcacatggcaggtcccatgcatgggtggggcaggcctgggggtggcagacacacgcacatgccagattgtgcacacacatgctgtgaggccccacggcccgcatgcacactctaacacatgcccacaaacaacacgcatacgtcgccctctccgccacctcccggtgcccaacaccctcaccagccggcacgtgccgcatggatctggggcgtgcagccactcggcacactgaagcacatgcgtgggcagagtcacaacacagatgctcacctgcacacagaggcatttgcaccagctccctgcacactcgtgcctggcgtgctcagaggaccacccatcctgctcagggagacagggcttgctcactaatgtccggctgtcatttctccacctaagagccttccatggctccctactgcctacagcgttgaatcccaacaagtcatactctttggactttgaaggttctccaccctgtgccccaccctccccacagagctcttcctcattctgtctctgttccctgctttggccagtggctatcctcaatgtgacccacactacacctctgcccacactgcagctctttacccagttaccctccagttcctcacaacgtatgcctatctcagtcatgccccggactgcattgaagccagactgcccttttccccaaggcagggtcatgatttgccaaaggtttcgtgtgtgtgttagcaagactggagtcagagcaggcatcaaactttacatcccatatgtcacacctcaccatagacctgggtgccaaatagcctgaagagtctgaactcacgttggcagttagcaaagtgctcctacagccgcatctgcggttaacatagcatccctatggccactgtctcccttgatccccacagccatcctaggagaaaggcagaatgtcataatttgctaaaagggatgctgaggctctgggagggaaagggacttgcctaaagccccagggtgaagcagcatctctggactcccagtccagtgatcttgcccaatactttgctgcttgcctatacccctctaacttggtcaacagcacatcacagggcaagccccaatccctgcttcatttttatatatgggcgctggtcccacagccccactctccagccatttggaaacaaaaacagatgctattgttcttccttagagaacgtggccagtggagacggcacactggaaatcagagtgaatgttcttgaaagagggtcacgggtcaacaaggcccagccaaaggatgcagtagaaccattttccttagaaatctttgggagtgaagtaggcttcagccactcccatccctgccctcgcagctaccactaccccattagtttagacagggtcgggcggggaggggtgtggagaagaaatgagcttgcctgtggcccccaggctccctctgtcctagctcaggtctgggtgccattctttacactcgtgtgctcgctcacgcacacatcacacaccttgctggtcacacagtcacagactcgcctctgctcctgtggtccagtggccggacaccccctgggatggctcaaaggagtcaggacttggaagtggggacatcagggtagctgaaggaaatccacacacccagagcatctcggagttcagactctcagacctgaagtaggcgcccccgggactgggctaggagttggacggaatggaggatggaggacagcgagaagaaaggaagagaaatgcaaagtgtgggcagccgccaagagtgaaaatagagggaagtgtcatgcaagtgctggacagaaggcggcaggtgggacgagccccacagccccctcctcaaaaacgaccacctccaggactcagtgatccctggggggcaggctctgccagccctcggccacacgtggctccggcacccatggtcccagtgccttggatggagacggccagttctggcggccagatgtggtgctctggaatccagtcccatttccttcctggccacgcctgtccagcggcctcttcagccgcattcagcccctacttacctggggaccccggctggggcacgagagtaccaggggggtagggcccaaagggatcaggggaagcctctggcctggagggtatggggcacgcttccccaagggcggacccggcaggaggaagcccaggagctgggtcctgccgcccaggagctgggccctgccacccaggccgggctagggacatggcagggcctgggcatcctgacgctggacttgggcgacctgggaggcacagggaggggagagatgggcgaccccgccccagcgcagtgccggccacaccccaaggcggttgccagagcttaagccccgcccccagcagcgagaacatcccagctccacaccccccccccgcagccagtgctccttgtcaagctccccccgtcactccaggtgggagccaccccggtgagggggtgtgccacttgcccccagggcactcctctgggcatcccgggtgggggattttggggccgtggggggcagtctttggtacctgtgttcgtcagggatgctctgacaaccaggtgtcgtccacgggcgggggcatgggcatggtgacagtggtcctgttgatgtcaccgatgatgctgagcgcctccttcagcgcgtggtgcatgtgcagcatctcgtcgtgctgctgtgcctgctctgccaactcctccatcagtgtgttctggttcccacatgagtacatattggccagcggctccgagatgatgaactccggggtctgagagtgggcaaacagggaagaaggttgggacctggtgcctgtgccgccctggctgccttgctgggcccttctgggactgtgcgctggacttggagccccttggagtatggcttttcacacgggcttctataccgcttcgactggaagatccacctccccactgccttttctcactcagatggggacaccgaggtccagaggaaaagacacctgtcaaatgtcacagatctgggaggggacttaagacttatcatgccaagaggacacctgtctactcagtttttttttggtggggcggggggcggtgatagggtctcgctctgtcaccaggctggagtacagtgatgactgctcactgcagcctccacctcctgggctcaaagtgatcctccaacgtcagcctctcgagtagctaggactacaggcacatgccaccaccaagcccagctatttttaaaatttttgtgtggagacaaggtctcactatgtggcccaggctggtctcgaactcctgggctcaagtgatcctcctgcctcggcctccaggagtgggagttggagttgatgcctggatacaggagctctgtgggtgggagtgagacaaaacacagggtcctgagctctggggaccaagcaatgtcctctggtgaaaaaaatcctggacttgctggcagaagatttgcctcttactcgccatgtgctctgaatacatttacctgccctctgggagcttcagttttcttatctgaaaaatgaggacacctgaccccttccctgcccagttcagtgttgtgggacagggttgctgtcaagacaatacccagtcctgccctcctccctgagtgggccaggtagcccatgtagcctcttcccagctttcctgggtggcactgccagcctggtgcccattcaatctagtccttcatcttgctggagcatggggaagctctgagtaacatgggactatagagtgcaagagggttgctgatggtctgggtcctgtgccctcctcattcctgggcattcttgacaaaggctcccagcaactgagggtacgcagcagctgtagacaccagcctgatgaatatctcattgtgggaagggcaccatagcaggagtggagctccagggaaatacagaaccgaggtctgggaggtgctgatgtgagaggcccaagaaacctcggctttgcacttgctgagtaccatctgcacctctcaggagggagagcgccaggctcaggaggtccttgccgaagcaagggagcttgaaaagggggctggggtgggctctgccattttcaagggctgacagggatcccctctggaggtacttggggcagtgctgcgtgccgtggctcctgagtgacagagtcagctctgcgccccacaagaccgctccctgccgagaactcactgtgatcatgtgctgggtccagatgctcacgcagcctcctgatgggagcatcaggtgtgctgcctgcccagggcggcccacaagagtctgccctgccctgccctgctctgctatggaacaactcccattctgcctttggggagaggtgttcatttaaaccatgagtgggctggcccccatggcacagttaccacagagagtctgccactacccatggctgagagctctagttcttctctgaagccaccaggacagatgaacagtggcttcccccttttggccgactcagctgcctttcatcagctcatctgctcctaggatccactcttcctctggctggcacctgatctgagcccgaggctcacacctctgcccacaggccccagcagctgcttcacctccgactccatcccccaccaagcactgcccctcaccagctgctggggtgccactagtgcccctacatggttctccctctccagacccttgggtccagctctagcttccttcgggaagccacaccccaagaccccagccctgctctggggccctgtatccccgacttcctgcattcttctccctccttctgggaacatgaacttgccctgccagcctgatgactcctagagggcaggacaccaggtcctggaccatggcaggcctgggagtgtctgctgccggtgatgctggagctggtgcccatgtccacatgatgtccatggcacagtggccacctgaggctgggcgcatctgagtggtggctgcagagtggggcccttacctctgcctgagtgaagttcaccaggtcctcccctgtgctgtcatgctgggcgtggaagagccggcctagctggaggccccgcaccacatggtagagcaggagctgggggtcggtgcctgctggctctgaggctctggctgctgagtggctggacggactctgccagaggcaaaaggggccatcagcctttgtgatccaggccgaggcctgtggctgcagagaggcagtgtgaccctggcatgccaccctcagctctgccccagccccccgcacccaggaacgcccacaatcagcacacccacctgggcagtcagtgtccggctgccctccagcgagtgaagcacttgcttctgggccgtcactcagaagctaagtgtctggaggaagtatgttcaccgtcagagaggccaaagtggatgcctccgtccagggcccctggggacaagggtgttgggtccagctggcctgaactggctccccacctcagggtgcccccgtgggcagcagaaacctggggctcggccctcagcacccacctctgtgtgagaacagcacgagcccaccatccagctgggtctgcatgaagctgcgcacctcagtgcccggcaccgcccactgcactacccacccattgctgggctgcttaatggtgtacaccaggtccttgggcccagagtaaccatccatgctcctcagagcctctgtagggatgggcacggtggccccctcccacatctggggacacaggcctgtgaaggttctgccctgccacacttacccaccccttcctccccggccctgggctgccaccagggctccaaccccactgaggctcaggccctcaggtggcatcaaggctggcgctgctgcggctcccctgcacaaatggcctccctgcattcaccttccctgtcaccccagggaaggccaccctccaggcccagcatccctgctcttcatctgtcctagtcctgtgtgtccctcaagaccagcttgtgtacccaacccaggaaggccctagctcttaccgtcaccaagttctcacccccagaaacccccagcgctgaccaacagtgctccttaatctagctcactggtggggcagcagtctcctttcagaccctccatgtgtgcctggcaggggctgggcacaggtgggaacagtgattttagaaacgagcactccttccagctaagggaggggtgggaggcgcagagagctgaagcctgatggttggcactgtcctgcagcacagaagcagtgctgggatgggcccaggtgcttccagagcagttacgggccctcctcgtgttgggcaaagggggccccttttcaggcctcccactagcaagcagaacaggcacccgttcctgaggtcctggtaccactcttgctgggtcaattacttgtgggcagtgctgcagtgggactcacatgcccagaaaacagccctctggcattcctgggcttcctcccctggccgcagggagccctcaggccgagccttggcaagaggggccatactgtgggaggcagggccccatcactgggctcccagaacaaacacgggtagatggcaccacctggtggccgcactgccacacagccatcccagcctgtggttccagggtgctgtgtcccactcttctgtggcgtccgcaccatgaggccaccccctacaggcacatcctagaccaccaaagccccccggtgccccatgtcagagacagcccaagtcagccctcttgcggaaccttcagtggcttctgctgactggggaggacgcgccccagaagctggggttcaaagccctgccacgtgggcttagtaaagccatgccctttctgttccaccagaactacttttgcaatcatggagaagttccatcccatctctgggcctcaacttccacctttgccaaatgggggccctgctctgctgtggacaaggggcaggagtttgggaagccaagctgaggcctccacttgctggggtgaaggtgggaagcttaacggtcccaccctgacgccagcccttaagggcttgtaagtgattctttcaggtgttctggtcctaagccacaggagaaggaacagcagagccacccatggctgctcagaagtctgcctaccgtacttgcaaatgtccaataacaaaacctcccacctgtgttctatttcagcacaatctcacatctctccttccaacaactgcgtgaggcacacagtagtgtcctcattttgcagaggaggaaactgaggctcagagggggggagatctgtgccgggaagtaggggacattggcctctttctcaaagcagacatggggggtggtcccaggaatatgctcacctgcaggcctgagtttgtatgaggtcgggggttggccattgacaggcaggatggtgacagtgaaggccacaggatggctctggcggtccatctcagaggcattagccatcaggacaaaaccgtcagtgtcttgctcccatcgtgcaggtactggatcagatgctcttccacctaggggcaggcccagggctggcagtcaggccccagcagtacccttcatgttctgcctttgggtgcaggaagagactgacccttttagggcctcagcttccattggtggaaaatggggaccataagttctggttcccagaggagttgtgaggaagaaaggggatattttattttattttgagacagagtctctcgctctgttgcccaggctggagtgcagtggtgtgatctcggctcactgcaacctctgcctcccagattcaagcgattctcctgcctcagcctcctgagtagctgggactacaggtgcgggccaccacacccggctaattttttgtatttttagtagaaacagggtttcaccgtgttagccaggatggtcttgatctcctgacctcctgatctgcccacctcggcctcccaaagtcctggaattacaggcatgagccacagcgcccagcccgagatacagcatctaaagcataggtctttctgaaatgtgactccctgtctcctctctgtataacccctggactgggagtccccggggctccctccactctgcccccagagctgggctgcagcccctgggcctctctcacagccgtacctctctccagcagaaggtgctgagggtcctggcttgaggcccatcctccttctgcagggccccatgccggggtggctccagcacctgcaggccaaggcccgggagagtggggaagtaggacctggcaacgcggagcagtggaggggccagggtgcagctgcgactgtgccccctctactgctgaagttttgtgcccccagtggggatgacagcaggcagcacctccagctccacgtgacgtcctcaaggggagcacccaggccgaggccacatccagcgagaaggcatggctccgggcctcagggcgggagtgcaggtagaggatcctgcctgtgtccactgcctcttgggagaagctctgcacggggtccaggctgggtggctcatctgccaagatgccacgcagcaccatcaccaggtagccggcactcggtgggctcttcactgagaaaacgatgtctgctggcggcactgcctcctgggctacctggttaacagaggtcatgaggactcacaagggaatgcagaggggtctcagaggggcccactgtggccctaagcagccagaacagccttgatcttgctccacttatttccccagataccactgctcatttagtgacacacacacatgtgggttcacacacacagcagccagacatgcagctggtcacattttttgtttttttgagacagggtctcactctgtcacccaggctggagtgctgtggtgtgatcacagctccctgcagcctcaacgtcctaggctcaagggctcagcctcccaagtagctgggaccacagtcatgtgccaccatgcctggctaatttttaaatgttttgtgtagagatggggtttcactgggttgccccagctggtcacatgttaatacccaccccacacatggttacggggtgtcggtcaacagcttgagatgcactccctcagggaggtgcataatcacatgtccccagactcagtgacacagacatatgagttcatcagatgctgacgcagtcacacaggtacaggtacacatgcgtgtgtgcacacgcacacaggccccctgctcaggatctgttcaggcctgtggctggtttgctggcagcatcctccccaacccctgctattaccacccaggaccatcagagggtgccctgccccaccccaccccacccctcctagaggcacaggcacccccagcacaggccctacagagctcacaccccaaaggccacatgggctccctcacctgatgggccatccacaagaggctaaactgcctccaaactcacattcctgttttgtgccttcggccggaatgttccttttgcgtggaataccactccccattctctgctcctaatggcctgtactcttcagagcccggcccaaacactgcctcctcccatgaggccttcctgatgccagatctgctggctcaccatgggccccaagctccagatgcagaccagaagggtctccgaaataagcagtgtggaagagtaaggctgagagcgggcaaggactggcctgaggtcacagggcatgtcagatctctggaaggcccgtggctgctctgtggggttcctgggtgagcagaagcccttgacagaccctcctggtcctggtctgggctctgagaagagagcggggtacacaggggtctgagaggcagcggcctgtctccacggccagcaatcccaaaagttcaggacccgtgatgccctcccagggaactgactgcaatgcagattctcgggctccacttcagagattctgtagggctgggtggcgtccaggaatctgcatgctcagccatgccatggacatgagtggacaccagctctagaggcacacaccactcccaggaggatgggtgtacagcaagctccccagaaactcttgggaacacaacatatatgggagcacatctgaggcacgtgcacacacacaagctgggaccaccacaggtacagcccaagtcacatgtgttcccggcatggaggctgggaggaaggccctctacctggtccacaccccgctcaccacctccagctcctcacctccagctggtcccttctgatctcagctgcctctccctggaagatgtagatctccttgtgctaggccagcttcagtggggctactgggccctctagggcaatggtcacttgtagggtggcatctgtgtgcactggtcccacatccattgagaaggccagggtgttgcgggagctgaggctgccattgtggccatagaaaacagccccaaccagcaggtcctgctgagagaaggctgtggctggctgagtggcttggagcaactgtccccagtgagggctgtctgtgacgtggtagtgggcctcatccctactgcagatgttgaggttggtgcccaggtggagctcggccatgttgatggtaccctggcctccttgaggaaccatgaggccggagccattggccacacagaggtaaggctccaaggcctgcacctccagcaccgtgatggcctggtgctgcccatcggacacctgcagcgggatccagccgtggtcagcctgagtgtgtgaacaggactcgcctcttcctgaggcccctcctggatgaagcggcagatgggctgcatgggctcatccgtggccatgatactgccagagaggaggtcctggtgggtcagcaccagctgggcctcagcaaagcccgaatcagcattgctgaaggccatgttgtctgtagtcagcagccgccacctaccccaggccacgtggaagacgcagctgatggtctgcataggggcgtggtcattcacaggctggatggccactcagaagacaccccatacctcctcccaggccacgtcaccactgctctggtcctgatggcagcaggaaatgggatatcatcttctgtgatctcggagtcatcatgctgctagaccagctggccatgcatcaggtctccattggtgaaggatgtcaccatagtgatcttgtcctgtgtcccacgccaagtcaacctcccatggcggggctgctccatgacctcatagaggtacctggcactgttgagactcttgatgaagagctggtcagcagagaggacacacccaccaccctcgggcaccacgaggacaggcatgtctgggtcaccgccaatatggatggagaaggtacagagtggggagaaatatggtggagctgtgacatggaaacagaaggtgtcctccactgccactgaggcacgtgccatggccccataggtcacctctgcagcctgtacgtcatcctgggtgaagccctgaccgtctgacagcatcgtgccctgtagttgaaagttgcctttcctgggagcctgaaccacctcacagtggaaggttggggggcttgggcctgcctcctccagggtggcctccaggtgggctgtggtgagggcctcctgctgggtgttctgagtgtgcagtggctccagctgcagcatccacacagtggctctctggatggtcactaggaaggacagattgctcaggatttcccagctcacctgcacctgcagatccaggttctccacggtgtcctcggtgtagtgctgtgggtcagtgctcaggtacctcacgtggccctgctccacatcctgctggtggaacgcctgtgtgacccaccactcagcatcctccaccccaccagccccctgcttctgcagctccctgaacggcaggcctccggtgacacggaacagcacggtcacatcctgccccacggcgctggtctccaccaacaggttggtaggcaagatgggcatggcagagccctgggccagatgcagccctgtgctgcggtggatttgtatggccagctggacagccaccaccttcagcatggccggggggctggcctgcagtccattgctgacccggaatgtcaagtcctgtgtagggccaccacagtggacatagactaggctgccggcctccaactcccagcaggagaactcagtcaccggctccccaggctggtctcggtgctccacagggaggccagagggggtgccaaggagctggaaggcgaggccctcacaggcagagtccaggtcataggcctggagaacctcaggccccagaggcttctgtgtgtgttccaggatcaccataaggctgccatgtgggaagatgatgtggggtgggtcattgacagggttgacctggatgggcaggaggtctgtttggcccctccgcaggcatgagggcatgggcaaccaagccatcactgacacctccagcaccagctggtcagaggtgtcctcagggccatcgtggatgaagcgggccttgcagttcaccacgtccaggagggtgaacatttttcatgcctgggcacccaggacatccagctcgagctcgctgtagtgtgcccctcaggtcacgctgaacagcacctgggatttacgcagttcagcctccatcagtgccagcatgggctgcacatgccaccactcaagccaggctgtgccaccctcggtcaccaccactgcgctgatagcagctggatgaaattggcaaagacaggaggtagccctggctcaggcacgcatggctcagctagctccacggacagccaagccttgggagccagggtggagaaagcttcataatggccataggcattgtctacctcctccagtctgcagccagccaccatgttgtgcgtcagcaaggcttcccacagcccctgcctctagccattgacactgaggtcttccatgcagccagcccagcagggaggcattggcagcccctggtgtcaggcctgagcggtgttcctggaggtgatgagaggcctctgcaaccagctccccaagaaggagactgtcacgtggctccaggtagctgaggactcctcagttcgtgtggggtactggtccatggagatttctagctggtgaatgttgatgtggatgctgaccttgtggggctgtgcgtcagtcacaggcacactgttgaggagcaatacagtaccctggcccttctcaaccatggaccacaggtggccctcaaatatgtccacatggatgaagtccccatgccagcctgctgcctggaaggccaagggtgcctgccagctctgtgtggtgagtgtaaactccagggttccttcaccctgagtgccccaggcaggcaaggcagccagagagtgggacccagagaagcccagggccacatcatcattggcagaaaactcttcagcacagccctcatgcttattgggggtcagaggctggaggagtctgcggccattgagagcggctgcatggaggcaacccctcaggggatggctggttcccctcaggtacggcaggccaagtctcccagtgctcccaacaaagagcccataggggacttctaggggggctcccaggactacagaggaggcattcagaaacccattgactgacaatgtgggccagtcctctgagacagtcagaactgtggtgtgggggacggagccactcagtagaatttctgctggggtctgcagcctcagctcctcctggcccaggacaagcctgacctgaggagagacggggaatgggagatggggggcagcactttgaatccatcatttcccttataaaagcacagtgggttccccacagggggccccagagcagaaaacctaggacaagggcctctggtgccactcctcttgccttcctgccatctctttattcatcctccaaacactcaccaaaggaaactctgggccaggcctggatgggctctggggaccctggtgtgaatcagatgtggtccttgcccacaaggaactgacatatagcaagatgctcttctagaaacccaacctgtatttttaaattctcctcctctttccttgagtgaaaagcaccagaaatattgtcttggaatctagatttcacccctggaataatgggtaactgagaatccgttgatcagtccccctaagtttggcaaagtttctcgaggtcactgaaggaagccaggctaactgttcagggacagggagcccaggcagatgctctgtgttctgggaaaaaaaaaaaaaaaaaagctgcctgacctgtggtggaggaatatctcaaggagagatgaaggacatagttctgtcaccatgacattgacacaagaaatggctctggtatggtgctcccagatgctagaataggtgatggcagagtatgggaactgcagaggcagaacactaagaaccatgatcttggagtcctggtatggtgcatctctgtagggatgtggcatcactacctgcagagctcaacagccatcagcaccagactgcaccacataggtgttcaacagtgacaccttgtggcaatgagcagcaatgacagcagcagactgaccaagccctagtcctcttcccactggggtgtggaaagagatggctgccccaaatttgttaatttgttttttttttccttctaaaatagagatggggtctcattgtgtggctcaggccagtcttgaactcctaggctcaagtgatctttccaccttggtctcccaaagtggtgggattataggcataagccactgcacccagcctgccccaaatttggactaagaccctgggttcttaaactcttcctggtatggggtaagactcaagtaggagccacaagactccttgataataaagcttgtggtgtcttgaaggatgaaatggaaaaatgaagctgaggcagtactggtgctgttactctcatggacagacagtggtgctgcagataaattggtgcagtgccaccaggatgcgcaggggtcatgggggcccaggagggggtctcgccgaggaggaggggatgcccacactgaaacttcaaggagagactagagttcggcaggtacagggaatgggtgggtcacacacctggcaggaggagtgtgatgaccaaaggcctggcagcaagtgaccataagatggccaggaactgaaagcagttcagtgcagtcagagcacaaagggccagtgagggcttgtggtgggaaacatggttggaaggagccggtgggcagagccagttcatgaaggatttaccatttctgagctgctgctgcccatcccacagtggagaacttgagaccccaagaaaagtgacttacacaaggtcaacagccagctggggttcactcaaagctagacaaggaatctcgccccaatcccagggggacgtcactcacctgcaggtgtccagagtagagctgcagcaggaggtggtcagctgggcctgctgccaggagaaggagggcttcgggttgggacatggagaactgcagctgcaggtctatgtcagtcagagccatggccacagtcacctccgggtggttctaaccaaagaaggaagctgtgtgagagagggagctgtggtcaaggctcagattcttgcctggaggaggcgaggtgctgcagggagggatgggtgggttgcagaaaggggtccgtgctggtgcaccctcatggttctgccatacggtgctgcctctgagcactgcccagatcccagcatttccttggtcctggcaccagaaggcacagcctcaccttgtgtccagcccagaccttgacttggcaggaggtcagacccagaaattcccagcaactcaggtctcctccttggaggttcctggagccagaggcctctgccagctctgactcacctcccctgggccccagaggagtctccctcccaggtctggctccccgacctggcccaaagggaaacatcactggcctgatcacctggcttggtggtcacagccctgaggaatggagtttctggagaatcaccaccaggccagatcgatccctgctcagattccttctcctaagtgcccttgtgcttgggctcctgtgcagcacctgccgtgccatgccccacctccatgggttggctggggccacggctgggatctgggggtgatgtcagtgcagcccacctatccctgcttctccctcaggccattcttccagctgccattgagggtgggggcaggagcttattggcctgagtttgccaaggagtaaaggctctcaggccagatggggaccatatgcagtgtcaaaccaaagtgggcccacacttcctccactaccctgctgttgcttcctgctagagagctattcacagtccccgctgagcagtcagatccggccccattgtttccaccgtggccaaggaaccagggatgagaacagctcagctcccaacctctccaggccaccactcagtctgaggctgaagacagggcctagaaggggctgagggtctgctgagcaggccaaagagggcctccccaggcagaaggccatgtctgggcttgcctgggattagtggttcttatgcagggcctgttctgtcccacactgggactcctcctcttttgagttgctgcttcctccaggcagtttccccaaattagcctccctgacttccaacccgatgccataatttctggtctatgccttttgcggtgataagagccaaatataactttaactttgcctgcagatgtccagggctggggggcagacaaacacaggttaaaaactgtgattcatccctgttgggtttccctcaaaccccaagaacaagcacaggctgatggccttgatggggtgattcagcaccgacctcacatgcactggtccctagccagcctgagccagctgccatctgctcgaggaagtagcttcagccattggaggagttggaggtttgtataccctcagggcagccagtcccacctggagggatatccaggaaagatcccgtaagagcccctcgggttgagttaaatcccctctagttatcccctcctcctgccagcactgctggcaacaccagcaccttggctgggaagctaagggaatcaagcaagccccgcagaccatctgcacgggggtggcccagcagtctcagcaggcacagcacagcttggtgccagcaagagacagaccagggaactgcaggtggcggccagctactggggtgccttatctgcaaagacattgattcctaagagcaaaacacagcacactaaagtgagggaggccatagcacaaggggtgggggcacatggccctgcaggatggagccaccacagtcaccggctggaacggctcacagcagctgccaggagccaactgttgaattttcaggaattttgagaggcaggtgatactgcccacagtgggaatatttataccaggaaaagaggcaaatactgaaaatcagggttccctctccccaacaaagccctttgcgaaacatttacctacccagcacccacggggaagggggcacatctccctgtgcctacccacctgtgttaatcagggttccctagagggacagaactaataggagatatagacagatatagatatagatatagatatagatatagatatagatatagataatagatatagatatagatatagataatagatatagatatagatagatatataaaggggagtttatgaagtattaacttacacaatcacaaggtcccacaataggctgtctgcaagtttgaggagcaaggagagccaatccgagtctcaaaactgaagaacctggagtccgatgttagagggcaggaagtgtccagcatgggagaaagatgtaggctgggaagctaggccaatcttaccttttcatgtttttctgcctgctttatattcgctagcagctgattagaaagatggtacccaccagtattaaaggtgggtctgccttccccagcccactgactcaaatgtttatctccttttacaatgccctcacagacacttccagtaggtcaatactttgcagccttcaacccaatcaagttgacactcagtattaactgtcacaccacccttgcactaaaggtatacatacacccactagggcatggtcaaggtcagagatctgggccagacaggaactgaagtagatggttggccctaaccactgaaccacctgcctgcggcctcctcccatcagaagagagtagagcctgtttggccagagtggaatggtggcaggaagcagaggtactttccgggagcgctggggtctgaatgggtccattgaggctgggccctgctgcttcctgtagggctgagtgggagaggctcacagaggctgccttgtgcagctggagcgcatagccagggaggcccccactccaacagaggcctctgaggccttgctggccggggctttggaaactctgacagcgctgcttccctcacctcctgatctcctttttctgcccctcttacacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaagcccttagagacctttttgtactatccatgacaagctcttgatgttatctctgcacttttgacaaattcttagcagttaacttacaaggcagttaagatttttgttcaagcacaatatagctagaataggctcatacattcaataaaacaaatatttaccaagcatttattgagtggaagataaaaagcacaaagcataattataaaatattttcccctgccaccataaaaaaattaaacaggcttacagaatacagtgtaagaaaacatgaccaaagcaaaaatagtaaggactaaagaagggaggaaggggaaatatcaacatggactgaatatgacccagaagagccttgatggatggtcagacatgtaaaggcaaattggttagggttaaggggtggaggtcagggcacgttctatagggaaacggcagctgatacagaagcctgaaaggaaaagcgggcagggcacctggacaggactcttcaggaacgagcacgcacgtgcgtgaaaaacaacttagtgaggtaccgttcacccaaacattagagaaaccgcgtaaaaatgcttcttggtaagcatgaagaaggcagggctcggcctgtagaagaactcaataaacatttgaactgtctaaagagtaaaagttaatgaataggccaaactcactcctttctttgttttaagagctacaactttagagaataacaaatcacaaacccagtagacaggtcctggcatttgaaatccaaccccatttttcccttaatctttcccctctgagcaaatggtatcgacatgaacaagccatgttgatttgatcaagacactcatccatggttaaaagagtctttactttcaagagatacaaacagaaatatttacatgggctaatttactgggcaacaagagagaaactctgtctcaaaaaaaaaaaaggaaataaaagtatacaaagtgaaaacaaagaaattaaactgcccttatttgccagtgacattactgtctatgcacaaaattccaaaaatctacaaaaaagcttctagtactaaaaatgagtttagcaaggttgtagaatccaaggtcagcatataacataaaatcaccttcctatatactagcaatcaccaactggaaattgagaagtatcattcacaacagtaccacaaacatgaaataaatgtgtaagattacaaaatacaagcaagatccaactgctaaaaactacaaaacactgacgaaaaatctaagaaggtctaaataaatagatataccatgttcatggctcattattaaaatgtcagttgcctcctaactgatttccagtttcaatgcaatgtcaatcaaaaaccccagcaggctctcacgcctgtaagccctacactttgggagaccatggtgggaggattgcttcatcccgggagtttgagaccaggctgggcaacatagagagaccctgtctctacaaaaataaaaaaattagccaggcatggcggtgcatgcatgtgatcccagctacttgggaggctgaggtgggataatcgcttggttcaaggctgcagtgagcagtgatcctgccactgcgtttcagcctgggcaactgagtgggacacttttttttttttttttttttttgagacaaggtctcgctctgtcgaccaggctggagtgaagtggtgcaatctcggctcactgcaacctccatctcctgggttcaagtgattctcctgcctcagcctcccaagtagctgggattacaggtgcccgccaccatgcccagctaatttttctgtttttagtagaaacggggtttcaccatgttggccaggctggtcttgaactcctgaactcaagtgatccacccgcctcggcctcccaaagtgctgggattacaggcatgagccaccgcaccaggccatgaaacactttcttccacccacggctttctcttctctccccatttacagcagtaagacagcctaacctgggaaagagagagagagggaagctacttccaaatggatgcctgtccccatcagtaataaccaagtctattcaagtgctagatgttaactttaaaagaaggaaacatcaaaagtccaagtttcagccgggtgcagtggctcatgcctgtaatcccagcactttaggaggctgaggcgggtggatcacgaggtcaggagttcaagaccagcctggtcaatatggtgaaaccccgtctctactaaaaataaaaaattagtcaggcatggtggcgtgtgcctgtagtcccagctactcgggagaggcagaagattcgcttcaaccggggaagcagaggttgcagtgagccaagatcgtgctactgcactccagcctgggtgacagagcgagactccgtctcaaaaaaaaaaaaaagtccaagtgtcttcgcctagctttgtcaggaatgtttttaccctcagtctgtaagtgtgaccaaatatattttttaaaggtttaccctcaatctgttaagttcaaaggtttactataatctcttcataagaaaactattggaaagatggaataaaatacacagaaatgtccttaacaggtaaatatttatttttctttcttattattatactttaagttctggggtatatgtgcagaacgtgcaggtttgttgcataggtacacacgtgccatggtggtttgctgcacccatcaactcgtcatctacactaggtatttctcctaatgctatccctcccctagccccccaacccccaacaggccccagtgtgtgatgttcccccctccctgtgtccgtgtgttctcactgttcaactcccactacaggtaaatatttctagaatgtatctactccatcagctagtgtaagtattctaaactgtgctagtatagctgctttaaatcactgctttcttctgcaaatggtggcacctttaaagtgttatcttgaaggggaagtgagtgatttgctcatgtctctactgaactaacactgttaacacccagtccagttctaccttaaacaagtcggagaaatacagacataatccatacttgttatttgtcaagactaaggtaaaataaggaaagttggaactcactcatatcctcttatgactgatgtactgaaaacaatccatctctcaccatttcctaaatagcatagtcacaaagagctctaccctaccaagtactctgcaagtcccactctcaaaggaagactcacaggtgactgagaagataaatttgctattgtttccattatccttcagttcatctgacacctttgaagaaatgcatttggataagactcacaagtctcagggccccttctttatgaaagaaatagctaagcctccatactcagaagcatcagacttttcagaatgcttaagtcatgtaaaaacgtatcaaaattattatcattacagctaccaggaaatagctacctactccatgttagatactgcagttaagtatctcacacagtttcactgattcctaacaacactgcaaagcatgttactaacccttaaggagtaggaagctgaagctctgagaggctatgcaactactcaatggaaatgtggggatgtgaactctacctagctccaaagggcgtacttttttctaaaatttctaatttttttccaatttcacaatggaggcagagttttcactacaattttaataatttcaccagctgggtggggtggctcacgcctgtaattccagtactgtgggaggctgaggtgggaagacggcttgggtcccggggagacaactgggcaacagtgaagattctgactctaaaaaaaataagaatttcaccaaaagggggaacagatttctaaatcggaatctcttgttaaaatccttagagcactagttaagccccacttcttttcaaaaaataaccgacagattaaaaaaaaggttagaaatccttttaaagtaaatttcatcagagatctgcaagtgaattgtcattttggacaagtccccagagttggtggccctctcctgtgtacaccagctaccactaggcagtaaaagtaatttacccaattcaaacacataccgtgcctgcactatgttaagaccactggcaaagagggtacaaagttaaataaggtctatcacagccctcaaggagttaaaggactagaggaggagtccatttatagtatagtatgtgtgcagttaccatttagtcaaggcaaacgaactgtgagaaatcctacaacaatagtacctacagtataacatgccatcaccgcccacagaaggaaagcaactggtgccctcgtcacgttatgttgttagtacttgcttacatgatgtccctccctgacaatcccttccaacctctgtcagcctccttccccacaatcacacacacacacaaaaccacactgccaggaagggaagccattgagtgagtattgtgaatcctacaagtggctctgtagtttaaaagggcaatgcctgtgcctgaagaaaatttgtctttagcttcatcaggtgaagaaaattggttttataacacaaggcccaccaaaccagaaaagcccaggaacgcttctccacaggactcacttagcacgagaaatcactcagagcaaaatgacgcacacagtatttgtcaaatttttctttttcatttagcagaaggtaaggtaaaggactacaactgaagttaataaatgacactctagccattttgatcatttgtcactataaatgatagacatttaagctagttccatctggggaagtgaaacagaatcatgttcatataataagccagacgaaccaaattcagtggaatacgtgcacccaaaactggaccagacttgtacttaatgcagcctgcaaatccccaagagtccacgacagaatacaagaacagtaacactggtttatctcaactcatcttagctccctcacaaacttgccaataatgacctttcaagaactgcaccgttggtcctcatctgggcaatcccgtggcttagaaaaactgaataaagtgcttcttcgaaaaataaaacaatgcggggaggggggagtagtaacaaaaaaaaaggcacactggtttttactgtactgaagcaataaattctccaactaacttcattaatgagtatcagcaaagaatgaacaccaaaataccgctcaatccaactttcatcgtgaattcttgaattcacagtaggatcattaaatgtgacggtatcactctgctataaaaactatttccaaaacaaaacaaacctatctaccccctttcttgatttaaaaaaaaaaaaaagaagaaagaaggaaaatttgagggtttttgcttttttcaacttcacataccggtttgcctttgcaaaaaaaaaaaaaaaaaatgtttagtctcaaagtatagctgcaaggtggaccggctgcacgggtcccagagggccgctcgcctccgacggtcgcagtttcagccgggccgcgcccgcgagaaacagcggagaggccccagcaggcgggcgccgccggacaggtttaccgtccgcgtcggccccggggaaccgctccctcgcgcccgcagcacttgttcgcggcgcggactccacaccgcggccgcccgccccaggggaggagtgagtccgccccagcggcgccaacccggggacccggggcaagggttcggggccatccgccgccgggcgcgccccccatccggaaagcggcgacggcccccaagttgggctgcggagtgggaggcgcgccgagccccaagcagacaatgcgggagaagggtgatgcgcagggaggaggggtccgcaaagctgaggtccccgcgccgcccggctacccatccgtgccgcccgcccctgaagccccgcgcagcccccgaccctcctctggggcccgccccaccgagcggccgcaggggacgggccgcgctccgcaccccgacccctcctcaaatcacaaaacttcccccaactccgccaactaagttgcgctctcaccgtgcggctcccggggctcccccgcgggccgagccgagacagctcctcaccttcgccgcggagaaagacaataggctgcctctcccccggcggcggcagcagcggctgcggctaaagcggcggcaaccgaggcgagcaatgggcacggcggtctcggccgagccgaggggcttcaccgctgctgttccggctccgcgacagctctgcacgtagccccagccaccccgcgcaccggctacaagccgcccgggggtggccggggcacgcaagagggcagtaacgtctgcgagtcctcccgtgagtacacgcggagcaagggctgcgagctgggattgcacggcagagctgcccatcccgctccacgagaccaatagtaaggcacctgggcggggcgctcaggttgctaagggaggctgaggttgaccgccggggctgctctgtggcaaagtgatcacagcagggtggctggcagagactgctctgggaaatgcccactcacggtctcctctccgccctgtttctagaaactgccctttctctgtgtgctcgtggttacctgagctgtagcatttaaccacacatcgtgaaatgatttactcctctatttcccccacttcaactcaggaagtggggtttagtcttgtgtgtccacagcctaggacagtctaaggtattaggtattaaatataggtattaaacaagtgttggatggatgcacggcgctatggcggaatcacaattgtgacagtgcattccgtgaacttttggctactcgatcaccacagtcgttccgtgttcaagctgcaaaggacctcagaaatcatcggattgctttgagaaacaaaatgtggtccgtgtaccaacggcggccgaggagaatatattagctggtacacggagaaacttcttttttcaaatagttaagtgttttagtgctcattaggagggaaatgcctatcacgtcaaatcattgtttcattaatgttacttcttaggtcaaataaaaagtggcaaaaaacaagtgtatttcaagaaaagtgttaagtgaaacttgagacactttatatgcagttcaagaatgtaaaatactagttgacagtgattgaagtaagaacagttggttaggtaggaggagaagattattggctgggaaggaggaggagggaaccctctgtggtgctgattctgtattttgacctgggtgatggataacaaaagtatgtacatcaataaaaaatacatccagtgcactttagattagtgcactttacacattttatacatgtatttttaatgtcaattttttaaaaatctggtatggtatatacccccacaacccccccccccaaaaaaatgcaaagatgcaaatgactgccatttgggaaacactgatccaggcaggctcactagcagtgaccaaacacctgagaaagggtattgtgaatacctgatgtatgtgccaggaacttccatggttgaatagctccaaatctcagaaatgctcctaacctagtgttgagctctggtgcatagatatattttcttttctttctttcttttttttttttttttttgaggcagagtttcactcttgttgcccaggctggagtgcaatggcacgatatcagctcactgcaacctccgcctcccaggttcaagcgattctcctgcctcagctgcccgagtagctggaattacaggcacatgccaccaattccagctaattttttgtatttttagtagagacagggtttcaccatgttggccaggctggtctcaaactcctgacttcaggtgatccacccacctcggcctcccaaagtgctgggattacaggcttacaggtgtgagcctcagcatccaacccagaatagcttaaaaaaaaaaaaaagccaggcatgcccagttcttcatgtgaaattatttctgtatcacctcatcatgctgctcaccctcttccactgttctctaatttgtccttgttgatatttaaaagctggcacaaggccgggcgcagtggctcacacctgtaatcccagcactttgggaggctgaggagggtagatcactagagcccaggagttcgagaccagcctgggctacaggtgaaacccccatctgtactaaaagatacaaaaattagccaaacgtggtagcccaaatcccagctacttgggagaccgatgtagaaggatcgcttgagcccaggaggagaggttgcatgagccaaatcagcagggcagctgcagagtggggtgcaaggtcctcaacccagaggttccctaggccccacttgccccagctcatgagagcctggttctgagctctgccaggaccggggctcagcactgcccatgaaaacaggcgtggcagggaagaaaatcataaccaaatatttgtagtcattccagaacctcccttctggaaagggaggttcccaggtttgtgggctctttgcctcctggacattattgtgtagtgaagggagaaaggttgagatgcagagttggagaaactaagagaggccgaactggtccatttgaggaaagatgactgatcccagaaggggaggaggggacaccctggggaagcagggggcttcccagatggtccaagaaggggagggcgggatatagaaagtcagagcatggttttgagttttggagacaacaagagaaaagagggagggatttggacaactatggagaggactgggctgtggagagaaatgtttagagatttggaagatggtgtgtcatgcgatgtattgtgaaaaccccttcttcatatccctaaaagaccaccgctgatggtgattcatggtacaattgatgattgtatcatgatataattcagtgcttttgcagagggattggtgcctttttaaaataataatgatgctttggcttggctccatctgaattagtagagacagacatcttgagcaggttttatcagagttccattagctaaatattgggtttcctattttgtggcttgctttaaaccactttgtaggcccttccgcactgaaagccactacagaaatcacctctttggtctgcagctccacgtccccaagctctgggctttcctgaatgagtggcctcattcagaagataatacagcatccctcatccgaaaatccaaaatctgaaatgcttcaaaatccaaaactgtttgagtgccgacatgatgttcgaaggccagattcaaaggaaatgctcattggagcattttggatttcagattttcgaattccaaaatctgaaaaaaatccaaaatctgaaatacttctgtaatttaacctgtaatagacatttggtcctgaccttccagctgaggcagcaagcagtcaacagaggctcaccatgcatccctcctgctcctcaccctcccacgggcttgtgcctcaccccccagcctcccttgcacctgctggggaggggacaggatgctcctgctctgccttcttggatctcgggctactgtgataattgcaggattccagccagggaaaatgctacaggtagaagtacttggtactctccatagagaagtttccagcaatggcacatctgccccaggaagtgtgctgccacacccagctaattttaaaaactttctgtagaggtgtgaattcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngatcccacatatggcgtgttgtgtgtctatggagtgtcgtgtgtgtgtatggtgtgtagcgtgtggcgggactatatggagtatgtgtatggtgtgttgtgtgtgttgtgtgtgtatggtgtgtggcgtgtgtgtgactgcccctactcaggtccctatgtgaagttatgagcagggcacggcctgggcctggacctccctcctgcgtgtggatctgatgggagcagcggtggggaggactgcagctggtcgggctgcctagggctccccttcctctgcctcgtgtccttcccgctcgcccatcccttcgaccactcacagtttcactaagccctgtctgcggagcccagggcctgctcaccctggagtggcgcaggggaaacaggaggatctgggggcacaggagtgggcgaggggctgagtctgggggtgaggggagcagggcccggcgaccaggcggtgggcacggagtctggggtgagctcgagctgcgaaggtggagaggctgggccaggggacccgcgtgggcagcagcatggaccggggcgtcagagtgcaagatgtgagacctatgtgcgcgcggggcggcggcagccggtcaaggggcagcaggaaatcagacctcaaaggtggccggggacagattccaaggacccttgcttgaaggctggtcactgtttcctttgggcctccaggagtgttaggtcgaggactggagaggggaggcagttctctccgcgcgccccctgtgctccccagacgccctttgcactgaaagccaagggccggaggctggagcgcagcggcccgggcagaagccctgcccagacggcgccggacctgggcccggactctgcgagcagcccagccctcacttggacaaaggtggaaacggaagccttctgggagggatgcgtattcccgcgaatccactacacttctctcgggatgcttttccttcttcaggccaggctagcaacgcaaacctcgactccagagaggccggtgtgcgtccaggggccaccccttcacaggccgcgcctgcacccagcgtctgttctcactgccggcctcgcgggcagccagtgggtccccgggtgagatggtgcgggcagcgctcccggaacgatcccgggcccctccttccccccgggctcttgcctgcgcctcttccacacaatttgcgatttccgtggcgtcagatggctgttctttgtcacctgcttgtaagagctggtcccatgatgtcaagcctcttc

SEQ ID NO: 735 - DNA, 691550 bp, Homo sapiens
  misc_feature (12664)..(12763): n is a, c, g, or t
  misc_feature (31773)..(32778): n is a, c, g, or t
  misc_feature (56221)..(56320): n is a, c, g, or t
  misc_feature (86122)..(136121): n is a, c, g, or t
  misc_feature (145293)..(145419): n is a, c, g, or t
  misc_feature (146936)..(147035): n is a, c, g, or t
  misc_feature (148716)..(148815): n is a, c, g, or t
  misc_feature (150516)..(150615): n is a, c, g, or t
  misc_feature (251273)..(251274): n is a, c, g, or t
  misc_feature (251288)..(251912): n is a, c, g, or t
  misc_feature (260826)..(260925): n is a, c, g, or t
  misc_feature (274962)..(275061): n is a, c, g, or t
  misc_feature (275597)..(275597): n is a, c, g, or t
  misc_feature (281352)..(281451): n is a, c, g, or t
  misc_feature (298664)..(298763): n is a, c, g, or t
  misc_feature (304942)..(354941): n is a, c, g, or t
  misc_feature (355893)..(355992): n is a, c, g, or t
  misc_feature (356976)..(357075): n is a, c, g, or t
  misc_feature (358228)..(358327): n is a, c, g, or t
  misc_feature (359748)..(359847): n is a, c, g, or t
  misc_feature (360794)..(360893): n is a, c, g, or t
  misc_feature (362393)..(362492): n is a, c, g, or t
  misc_feature (363898)..(363997): n is a, c, g, or t
  misc_feature (365776)..(365875): n is a, c, g, or t
  misc_feature (367989)..(368088): n is a, c, g, or t
  misc_feature (369701)..(369800): n is a, c, g, or t
  misc_feature (372033)..(372132): n is a, c, g, or t
  misc_feature (376157)..(376256): n is a, c, g, or t
  misc_feature (383108)..(383207): n is a, c, g, or t
  misc_feature (391127)..(391226): n is a, c, g, or t
  misc_feature (404351)..(404450): n is a, c, g, or t
  misc_feature (417010)..(417109): n is a, c, g, or t
  misc_feature (429522)..(429621): n is a, c, g, or t
  misc_feature (442967)..(443066): n is a, c, g, or t
  misc_feature (474456)..(524455): n is a, c, g, or t
  misc_feature (524516)..(524615): n is a, c, g, or t
  misc_feature (525965)..(526064): n is a, c, g, or t
  misc_feature (527800)..(527899): n is a, c, g, or t
  misc_feature (529611)..(529611): n is a, c, g, or t
  misc_feature (529960)..(530059): n is a, c, g, or t
  misc_feature (533550)..(533649): n is a, c, g, or t
  misc_feature (535102)..(535201): n is a, c, g, or t
  misc_feature (538525)..(538525): n is a, c, g, or t
  misc_feature (538538)..(538538): n is a, c, g, or t
  misc_feature (538618)..(538717): n is a, c, g, or t
  misc_feature (539114)..(539213): n is a, c, g, or t
  misc_feature (543095)..(543194): n is a, c, g, or t
  misc_feature (545114)..(545213): n is a, c, g, or t
  misc_feature (576465)..(576564): n is a, c, g, or t
  misc_feature (601651)..(601750): n is a, c, g, or t
  misc_feature (626564)..(626663): n is a, c, g, or t
  misc_feature (636320)..(686319): n is a, c, g, or t
aggaaaaactttctttcaaaaaaaaaaaagttgtaaattaaaaacccttcccattccgcttttattgatttcccccaaaaaactctgttgtatgagctgaaccagaggcaaacactgtttgccagaagactcacagatccccgtattaataaggcctttatccaatggagtcctccttctatgaaatgttgaggcatttgcttcctgttcataaatttctttttccttccgtgcttctttttttgtatcctgtaattgataaacagaaattgtttacaagtgatctcattaccaggtgtgaaggcacacaggctggctgagccctgaccccagtgccaagctatcccagcctctgtggctgccacacccatccacccacaggcccccacctgccctgttggaaaccccaactcatttgtgcagtttcaaacagtgtcttctttttacagatccaaggtctaggctgcctctgctgatgctctccagcctccttctgtgaagtccctaaaatccttaaccctgctaatggctcacacaaaacccaatgtgatcggctccacacacgcagcatccagctgctctgtaaggacaagaaggagctagaattctcacacacaaaagtcctggttcaaatgcaaatggcaaagccactttgggaaactatgaacacacactaaccccaggacctaacaaattccactccaagtgtttatccaaagggagaacatatgttcactgaagtacttgttcacagcacaattgtggcagctctacacggccaaaaaccagaaagcctgggcgcggtggctcacgcttgtaatcccaacactttgggaggccaaggtggggggatcactggagcccaggagttgaagaccagccttgcaacacagtgaaaccttgtctctacaaaaaaatcaaaaaactagccggacatggtgacatgtatgtggtccctgcaacacaggaggctgaggtgggaggatcatttgagcctaggagtacaaggctgcagtgagccaacatcaggtcactgtatacagcctgggtgacagagcaagaccctgtctcaaaaaaaaaaaaaaaaaaaaaaaaagaaaacaaaaaccaaaaacaattacatgtccttcaataggaaaatgaactaacaaacagtactacacctataaaatggaaaacttcccaataataaaaacgaagtcgcaatacacacaacagtgagcgaatctgaaaatcattctccaaggcaaagcaggaaagagtgcatactatacagttatattgctgcgacactcagagcaggaaaaatgaatctaatctcagggcaggggagtatcctggctgcaagtgccaaggagcacagggatctttccgggtgacgggaatggtctacatgaggaacaggttacctgttaacttcactgaaacagacaacatgcagtattttatcacaattaaatcatctcagtaatttttaaaattagcacaaaaaagaattttaatttaaaaaaatacttggatataagtttagtgttttactgttttcagttattcttcacatgtgtgagtgtggtatttccgatctcagcccaccaccaggtcacgtgtgcctccaaggccatacctggatctctgcagtaatggctgcgtgtaaggctgactccaaccctccagcagccatcaagctgcccaccagaagatcaatcaccaatcgatgacctggacttatgctcacttcattgcctgaaactgaaatagaaagtgtgtgccaatttgagtgaaacgccatcccctcccagcaccctgacccatggcctctcctgttccttccccgagcccacctccgcagggcaggagagcagagtgcccgggcctgcttctcagcggtgggcaacagcatggaccagccgctctgcagcatggcctgggaggccgactgctcggtgctcagcacgtctgcgctgcttgccagggtcaccaccgtctgcttcaggctgttcaggaagacgtccacacctattaaggggggggctggtactaaacacagtgacagctcaggtgacatgccctgcacagagcccagtacaaaggaagggccaacaaagcaagccactattttcgttgttcttttctggtattgatttaaaagtgcatgtttcaagcttggttctgtgctgacaaggaagtcggcgcgcactgatctgagtcttctccacaaacaagtggcctcccacacctgtctcatctgactcgctgctgttaccaccaaacacacagacaccagagaaaaacactgccatgcacaagcacgctggtcttgcgtaaaaaataactagactcgagtgccacctaaacacaaagttccatcatgacactcacgtgcatgtcgccctcggagtggggtgcatccttcctgcaaatgatgctctggaacctttgcagcaagggcaaaagcggggcgctggtgccctgggcggaacgctcattgtcagtctcctgtgccccgctgtcccacagctgaagcaacaacaggatggcagacaacatttggctaaagaagaaaacatatttattcctagtaaaaacagattaacttttttttttttcatggttgatcaaaaataaaagcaaacagctagatagaagtgaagaaatacttgggatatgaaaggaaacgaaagtaaagccgtggtagttaaatcactgaattgacactgagattttagcacaagacatcgccttctgctgataggaaagaccagttaagaagctcaaagagcacatttacatgaagatctagggtcttaaattcatggaataaaaataattaaatgaggaaaactgaaagaaaaaaaaagaagaacagttcccaggctagaaaactgagcataaaacaggaagtgaagaaaaggaaaagagagagccctgggacatggttctctgtagagcaccacacctgctgcagtcacacgattcagtgaaacgcacacaatgcaacaggtatttggatacagaggcgcttccccaaagcattcccggtctgcaccagccctcacctcagcatgcctctctgcacagccagctccagcaggatggccagggccaagtgctggtcctgtagggggatgattctggccctttagtgcctggtattccgtgaacatccctgaaatgaaaacagtggatgcaggaacgaagcgacctccagaaagacagcatgcttacaatcacagtaacacatttgctacatgctccctcccaaggaaggatgtatctttaatatttagaatcaagcttctgagacttgctactcaaatttattcacagatttttaaagtatacaattaatttacagaaatgtattttatttaaagtattcattcagatactatattacagtagatgacatactccaagtgtgtgaagcataaaataatttatctcattatccaaaacatgagtaggagaatatctagctatcttttccagtttcaatgacgtgtaagactataccagtatcaaccttctcccacagaattagagaaccaatttctaaaaccacttgaggatctggaggcaaaatgtctacactaatttctatctctgatcaaagattacctggttgcttactccatacccagctctccagaattgacttggccccatatacaggtgcaggagtttcatcttttttctctctgtcatccagatcttctttctttgttccacttggttcaacactatcatctgcagaattaaaatttttttaatctgtaaccgcttttcagaatgccataccatctgtcagtctctgcaaatgtccctccccgaaaagttacaacacacatcattaactgaacgtttgacaacttaaaaataaaatacatcaatcgtacctgtaacagatccagtataattttcataaagcaatatatcggccgggagtggtggcttacgcctgtaatcccaagcactctaagaggccgaggtgggtggatcacgaggtcagaagatggagaccatcttggctaacatggtaaaaccccgtctctactaaaaatacaaaaattcaccaggtatgatggtggacgtctatagttccagctactcaggaggctgaggcaggacaatggcatgaacccaggaggcagagcttgcagtgagccaagatggcaccactgcactccagcctgggcaacagagcaagactccatctgaaaaaaaaaaaagaaaagaaaagaaaacaaaccaatatatcaaattatttaaagcatgtcttccaaaatgatatttcattagcttcctagtagatttcacaacagagaaacttagtctttgatatttacctacttcagtttcacaccaattgcttttatccagtgagtcccaatgcatgtgcacccatgggaaaagggagggtgtagaacaggagtatgattcaaaaatcttttaactctttacaaggccctactccactgccaactgggaagcagtgctatgcaggggcactgtgactgatagcataattcaagagcactgggacacaaaggaaaagctgagaaaaatgactttaggccactgacaatgtcaagtttcagtcaaaaacaactgtcataaaactccttacacagtaagcgaagagaagagagaaccttaaccttgaagtgtaaacacactccatcacagaaggctgtgactaaatgtctaaacaacataattagaaaaatgtatctcaatcggtgaaagacatgatatcccatccagattacaaataatgagtatctaaaaatctctaaggaaacagttcctctgtttacaacacttctgacatcaaacgtatggacttttgcaccaagcagttctccagttctttgtgacacccagctatgtgtcccacaatgcaattcgattctgaaactaactacctagaattagcacagaccccacaggttaataacaggagagaaaaggtgaatgctgaaaaaaatatccaaagaactaatggctgaaaacttcctaggttcagcaaatgacataaacccaggcagattaaagaatctgtgcaaagcccacacaagataaatccaaaagaagccatgacaaggcacatcataatcaactgctaaacactaaggacaaaacccttcaaaaagtgccacagagtgtagatatataagaatgtcttgtgtggcctgaaatgaagactaaatattatgtgctgccttgacgtcggtaaaatcaagaaggcctcaaatagcctaaccacaaggtctcctccaagctctgctcccacagatcaggtcccaaagccaaacagcctccttatggcggagagctgactccagtctgctcatccctgccggcccagagttattcaaacaagccaatcacatcttcccatggaagcaaggtcatctcaccctcctgttactacaaattttgccttccacagcccctcgtggttcactctgttcccaagtgcagcccccgtgtggcatgcggtgtcccccaccccagggctgtgagcatgcatgactaataaactgctatttcatctgtccagtgtcggtgtcctacgttcagccatcccatatccctagggcaggaatcttctagggttataaacagaactttaatcaacctctccttggttattttactggttccatgatacagctttttctgtgcaaaagatctgaacagaaacttcacagaggatacaagagtggcaaagaagaacacgatactcagcattcttagccattacggaagtgcaaattaaaaccacaatgagatcccactagacttgttagaatggctcaactaaaaaacactgataacaccaagtgctaacaaagacacagagcaacagaaacgtgacagattgccagtgggaatgcaaactaaaacagccacttcggaaaacagttcagcacatgacccaactttcacactactaggtctttatcctagggaaatggaaactatattcacacaaaatctgtacagaaatgctcacagcaggattacaattgggaaagaaaaatggaaacaaccacaaggtcctacaatagcagaatggataaacaccatgtggtacatccaaatgatgaaataccattcagcaataaaaagaactattaatacacagaacaacaacaaatctcaaacatataactaggaataaatgaagatggtttcaaaacgttacttaaaatatggttccactcacatgacattctcaaaaagaataccctatactgatggagaacagatcagtggttgccagggtatgagaccagggaacaggtgataaaaaggagcagcacaagggagcttttggggtgatgacacgtctccgtcctgatgatgatgagggttacatgaatctatagagatcaaaatttactcaactagataccacaataaaataaatttcatataagttttttaataaaaaaaaatgttggctgggtgctgtggctcacacctgtaatcccagcactttgggaggccgaggcgaacagatcgcaaggtcaggatttcgagaccagcctggccaacaaggtgaaaccccgtctctactaaaaatgcaaaaattagccaggtttggtggcacgtgcctgtaatcccagctacttgggagcctgaggcaggagaatcgcttaaacctggaaggcggaggttgaagtgagccgagattacgccactgcactccagcctggaccgccaagtgaaacgtcatcacaaaaaaaccaaaaacaaaaacacaaaaaaacaaagaaaatatctaggtccaggttagggaagacagctggaatacagtctggtggaatcatgtcagagcagggagctgggtctggagggctggagtagggtgtggccccactctaggaaggaactaggaaacacatcctgggtaaagcaacagcagagtctcgttctgcaacaggtgagcatttatcctgatctgagaaactacatgcaaatttagtatgtctcacttagcctcttattttccttaacaacatggaaaatgagagaacaaacaattcagaaggttaagacatgaaacacattgaattcagaaatcatacacagaaaggtaggaaataaatgggggataaaagcagctaatgaaaagtgaaaatgggccaagtgcagtggctcacacctgcaatcccagcacgctgggaggccgaggcgggcggatcacttgaggtcaggagtttcagaccaacttggccagcatggtgaaactccaactctactaaaaatacaaaaattggcccggcgtggtggcaggcacctgtaatcccaacagctcgagaggctgaggcaggagaattgcttgaaccagggaggcagaggttgcagtgagccaagatcatgccactgtactccagcctgggcaacagagcaagaccctgtctcagaaaataaaacaaaatattcatagccttaataatagaaaataaaaacatttactgaatgccagaaaatctccctaaaaaccccaatcagttgggatctacataaagaacaattatgctctgctttctaaccacgatttttaaaagaacaaaggacaaatatattcatcaaatatgggccgggcggggaggctcaagcctgtaatcccaacactttgggacgctgtggcgggcggatcgtgaggtcaggagttcaagaccagcctggccaatatgatgaaactccatctctaccaaaaatacaaaaattagctgggcatggtgaagggtgcttgtaatcctagctactcaggaggctaaggcagagaactgcttgaactagggaggcagagaactgcttgaaccagggaggcggaggttgcagtgagccaagatcatgccactgcactccagcctgagcgacagagcaagacaccctctcgagaggaaaaagaagcaaacaacaaattcatcaaaggtaataaataaaacatatactttggatttttccatgtacttagcttttcttagagcatcttttagaattattgtttcacaaaaaacacttcgggaaacgttttaatttattaacaaatactggagggctagaaagaagaggttaaaactttttaaaatatacagaatgaatcacagatacgtgaaagaaaaaagaaaaaaaggttgctgactcctgccatggaaggcactatcatatggacactcttagcctcagcatccggaggtccagaaagcgaaaatttcaagtcagagagaattctatatataccatttatttggaaccttcagcccttaagatcccaacatcatgacttcagtttcaacacaattatccttagaccttgtactggctacaaacacaaaacaaatagctcgactgaactaactcacctctccagaaacacaaacacaagacctcataaagtcagtgagtttctacaggccataattactgcaacttacttctccaattttcccctccacagttaactcaacagctcaaaaacgatcagtaacaaacaacagtcaccatgatatggttaggagtgtggcagatttcttaaccagtaataataaataggaaaaaaattttgcctactaatagatctcaagtttcgtgcacttacaagaaactaattaaaaggcagccgcgcacgatctacaaaaacagccataaagactgttacattttaagttacaggaaataaacctgctcctctaattcagcaagatacaactgacttccccttacataccctaaaaaaaagctttacacgagaaatttaaacatggaagcagaaacacaccaagaaaaagacatgtcaaaccccacctgtatatctgttttcaaccatttggagtcgaggcgagcccgggcagccaaacacaaagattcagagggcatcttttctccagcttcctcccaggtctcaggcctgcaagtaaacacatacgttgaagacctaacgctttttaatagtttacaaagacactcccgaaaggttcaatgcagaaaggaaaaaagagagagagaacagaaaggggggagagaagagctggtggaggggagagaaggggagagagggaaacagggaagagatggagggagagggaggtggggaagggaaagcctccttccaaggtaggcagggtgtgccgagtttctgcaccacgctgacgagaccttgagaatggacggtcacaggaagccaagtcacaatgtcatccccctgccctcaaatccaagaagtacacacataacagggagcccatcgttttaacgacaaatgacagcagcatgaatctgccgctttaccccacagcagggcgcgtgcgtgaaacaaattactcaaaaggatcgcctgcagaaaaacccacagccaccaccacttaagagatggagagaggcccgaggctgccccgcgggtggtccgcgcaggccccggtgcggccgcgcccacgcccgcctcccgggctcggccgcccgccagccccacgcccgtaccgcccccgccaccggccgcccaggtgccccaggccaggacctgacgcgcagggccgggccgcctcgccccgccggcgtgcggacgcagcctcccaagagccgctggctcagccggcgcccgcgatcccggcgcctctcgcggcccgaggggcgggccgacgcgggactgccgccccccgcgtacggccaatcgcaacgaggctgctccgtgggcgcagccaatggggaagaggagcccttcgccgctcctcccgactctcccgcttccagcaatcccgcttatcttcctacttggagcgccctggctgcggccaaggccaacagcgggcgccggaaggcgggatttccgccgcacgcacgcactcccgcactcccacgggagactgcttggcccggagcgctcttgatcacgccgcggcgggtggtggcgctcacactaactatagctatccagggcgcgggtcgagtggcgagaccagctcccctgggtatgagaacgcatctttgtgcggtcggctggctggggcctgaagagcttcctcctgtgtgttcaactgaacgcagcaaaagtcttgggcagattccatggagcagctgtggaagcactgtgcagggaatcgaagaaggaaacacctccagcgaccacaaaacaaaattgaagaactataaaacaatataggccgggcatggtggctcacgtatgtaattctcagcgctttgggaggccgaagcgggaggatccctcgaagccaggagttggaggatcccatgttgccagactgggcaacatagcaagaccccatctctaaaaaataaaaataaaaaaatttaacaattagccaggtgtggtggcacacacctgtgatcccagctgctcgggaggctgagacaggagaatcgcctgagcctgggagatcaatgctacagtgagctgagatcgtgccactgcactccagcctgggcgacagagtgagatcctgcctctaagaaagaaaaataacggccgggcgtggtggctcacgcctgtaatcccagcactttgggaggccagagcaggtggatcatttgaggtcaggagttcaaaaccagcctggccaacatgatgagaccccttctctactgaaaatacaaagattagccaggtgtggtggcacgtgactgtaatcccagctactcgggaggccgaggcaggagaatcgcttgaacccgggaggcggaggttgcagtgagccgacattgcaccactgcactccagcctgggggtcagaggctgcaccactgcagccttgacttaccgggttcaggtggttctccacctcagccttgccactagctgggactgcaggcacatggaaccacacctggctaatttttgtagtttttgtagacgggattttgccatgttgcccaggctggtctcgaactcctgggctcaagtgatccgcccgcctcagtctcccaaaatgctgggattacaggtgtgagtcactgcactcggctaatagtaatgaactttgaacagaaggaaagttgttattattttcttggttatgttctatttatattttctaatttttctaaacatgtaaagataaaattctaaaaactcagtaagacctcagaacaaaaaaattagagtataaatatttattttagttaacttgtacaaatttggtttctggaaaaagaatggaatagattttctgagaaaaaaaatccaccactttggccgggcgcagtggtttacgcgtgtaatgcctgcactttgggaggctgaggcggtggatcacctgaggtgaggagttcaagaccagcctgaccgacatgaagaaacccctgtctctactaaaaatacaaaaattagtcaggcctggtggcacgcacctgtaatcccagctactcaggaggctgaggctggagaatcgcttgaacccaggaggcagaggttgcagtgagctgagatcgcaccatagcgctccagcctgggtgacaaaaggaaaactctgtctcagaaagaaagaaagaaaagcagactggctgaaaggattgaagaacaaaatatgatccaccaatgtgctatctacaagataaacattttaaatacagaaacagattgaaagtaaagggatacaaagatacaattaaaatagtaaccaaaaaagagctgaaggggctgtactaatatcaaatgtaatacactttaaattaaagcagggctgggcatggtagctcaggcctgcaatcccagcactttgggaggtggaggcagagagatacttgagcccagaagttcgagatcagcctgagcaacatggcataatccaatctctacaaaaaatacaaaaattaggcgggcatggtggtacccacctgtggtcccagctatttgggaggctgaggtgggaggatcatgtgagctggggaagttgaggccacagtgagctaagatcgggcccctgcactccaccctgggcaacagagcgagaccctgtctgaaaataaaaaaaaataaaaaacggggttgagagacaaaaaaggacatccttttttttattattatattttgagatggagtttcgctcgttgcccaggctggagtgcaatcgtgtgatcttggctcactgcaacctccgcctcccaggttcaagtgattgtcgtgcctcaggctcccgagtacctggcattacatgtgcctgccatcacgcccagctaatttttgtattttggtacagacagggtttcaccatgttggccagggtggtctccaactactgacctcaggtgatccacctgccttggcctcccaaaatgctgggactacagacatgagccaccgtgccagccgaaaccttcattttaaaaaaggctgggtcaggcatcatgcctcatgcctgtaatcccagcactttgagagggcaacgcaggcggatcacctgacgtcaggagttcgagaccagaccaacatggtgaaaccccgtctctaccaaaaatataaaaattaggcgggtgtggtggcacacacctgtaatcccagctactcaggaggctgaggcaggacgattgcttgaatctgggaggtggaggttgcagtgagccaagattgtgctaccacactgcaaccagggtgacagagtgaaacgccttctcaaaaaatgaataaaggctgggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgaaaataccgcatacaatatcctcttgagtagaatcataatttagaactctaaaaatgaccggaaacaaaactgtccaagtttgtttaacgtaatgtgtttcaacttatttgactagaaaacccttcattcgtgcaacacttataaatatcccatggcaaatctagttttctatgaataatgaacgaaacatttataatttaaaactaaaattgtcttctaagcagagatctacgtatcaataaaatgaagaaataaaatttccatactgttttcttcccaatacaaggattagaaggaaagggaaaagagtaacagcgagaatcaatagcccatgtctggccaggctccatggctcaatcacacctgtaatcccagcaatttcagaagctgaggcgggaggatcactggcctttagtgatccttgaatgaaactccatctctaaaaaattaaaaatattagcttagagaatcatttgggcccaggagtttgaggctgtattgaactatgactatgctactgcattgcagcctgggcaacaggctgcttaaacctggaggggcagagcttgcagtgagccgagatcgcgccactgcactccagcctgggcaaaggagccagactccgtggcaaaaaaaaaaaaaaaaaaaagagattctattcacaatagcaacaaaaccctgagaatatatctagcaaagtatacacaggcctttcatgaagagtattgccatagcctgaatgtgtctcccaaaattcatgtattaaaacttaattcccaagatgatagtactaagaagtggggcctttaagaagtgattaagacataagggtgagccctcatgcatgagattagtgccttccttataaaagggcttgtgggtggtggtaaatctgtcccttctgcctcatgagaacatagcatttgcctgctccagaggaagcagcattcaacgtaccatcttggaagcagagaccaggccctcactagacactgtgtctgctggagtcttgatcttgttcttcccaacctccagaactgagaaaataaacttctgctctgtgtaaattacccagtctcaggtgttttgttatggcactatgaagggactaagacaaatataaaaattacccagggacttaaaggaagaactgactaaactgaaatatatgccatatatattatgaatcgtaggactcaatgctataaacatactacttctcaacaaattaatctataaattcaagaaattcctacacaaatcccaatagaatttttttgtggaactcgagaggctgatcctaaaattcatacagtcacttgaggggccaagaatagtgtaacagggctggcggggctggtggctcacacctgtagtcccagtactttgggaagtcaagactggaggatggtttgaacccaggagttcaagaccagcctaggcaacatagcaagatgttgtctcaaaatattaaaaataaataaataaataaataaaaagaaggttaagtatgcacattttgttgtgaatttcaattttatagtgattttttttttttttttgagacagggtcttgctctgtcacccaggctggagtgcagtggtgccatcttggttcactgcaacctctgcgtgggctcaagcaatcctcccgcctcactctctggagtagctgggaccacagttatgtgccaccacacctgactaatttttatatattttttttgtagagacggggtttttccatgttgcccaggttgttctcaaactcatccacctgccttggcctccgcaagtgagatcacagacatgggccactgcgcccggtctagtgcgcttttttttttttttttttaaccaaacaaacgatgaagtctcaggagtaaaagttgatacacaagtaaattttattggtaatgtttttgtgtggtctttaagcagagggaaaattagtctgcattatggtgtatccagactaaataactgatattaaaatgaaattatccttaggatttgcaatcttagagaaaactttttcattttttttgagttacaaattatcttcacttacatttgagaacagtgagtcacagagggattaagtatcttactcaagatcttgcaagtgtttggtttgaacccaatcttttcactctgcagaactcagagtcactcttatttggaaactttttaactgatgtggatcctctaatatgggcttcctattattcattccgtattagtcagaagttttgcaagcaggcagaattcattttgccaattacgggattttccctcagttgcagtcaaggttcataaaactataactatttatctttaattataaattttgtttttgagacaaagtcttgctctgttgctcagactgggatccagtggcacagtaacagcccattgcagctttgaactcctgggctcaagggatcctccgcctcagcctcccaagtatctgggactacaagtgcatgccatcatccctggctaattttgttaaaaaaaaaaaattgtagagatagggtcttgcttcgttgcccaggctggtctcaaactcctggcctcaagcaagtcttcagccttggtctcccaaagtgctgagattacaggtgtcagccattgcacctggccaaaactgtaactatatatacacacacacataactacatatatatgtgtgtgtgtatgtatgtgtgtgtgtatatatatttttatataaaaatagatatatctgaaaggcatcaaaagaaaaaagctgtaacttttagtcttgatcttgatagtgacttgattaggctatctgtttaacatcaaagatgcaaattaatgctttctttgggtgagcatattaaaaatgcagaaaatattggagtagttttttatgttaaataaattgtattctgtgtatttaaggtatacaacatgattttgtgggatgcatatagatggttaaaaaaattactacagtgaagcaaattaacgtatccttcaactcagatagttacccgttttctttttgtttggtggcaagaggagcttaaaatctcatttagcgtgaatcccaatacagcacaattttattacctatatttctcgcgttgtacattatatttctaggcttgttcatcctacatatctgctactgtgtaacctctgagctatgtccacccattttctctcttgccccccaagtaatttcctaaagtgtctcatataaaaaggcagtagctttcagcttaaactttttctctgtatatatttaagtcaatttctttgaggtatgtttttctctccagaatagttagatgtaggcataccactttaatgttgacactagttcacctagaacttatcttctgcaaatctgtctctatgtccatctctgtctccatctttgtctctatctttatctctgtctatctatctatccatccatccatccatccatctatctatctatccatctatctgtctatctaactaaagcaaattcatgcccttctcctatttatggaatcgagaccataaacagaggtgagggaaagaatttggcaggaattgcgatgtgtattacctgtggcataaggaaactttacagaactagggtcaaaagtatactttctagttctttcccatggcttttcactttgatgtagtccttatcaggcaactgaggttttatataagtcccctgattcttagaacatgaaggtgtagtattcaagtttggtcccttgaaaccacaatttttgttaaaaaaaattaagaaaattgtatgatttcctcagcaaatacatattgatcatctgttatacagccatgagaagtggttctgttgaacacgtttattttatcagatcccaattctaaaccaggcatagaatggaaaccatgaaggtaggatgaaataacttctgaatgtttgaaaatagtgtacttaaaaataaatatcaggtgtttttgttttgttttttgttttttgtttttgagacagggtctcactctgtcacccaggctggagtgtggtggtgccatctcacctcattgcagccttgacctcccaggctcgggtgatctcccacctcagcctcccaagtagctgggactacaggcacatgccaccatgcccagctaattttttgtattttttgtagagacagggtttcaccatgttgcccaggctggtctagaactcctgggcttaagcgatcttcccacctcagcctcccaaagtgccaggattacaggcatgagccaccatgcctggctgaaaataccaggtttttaagtatcagcactgcctcttcaatcttttctattactatgttgtgctcagtggtattttttattgaattagagcagtgctgttcaatggaaccttctttgaggatggaaatattttatgtctctgctgtgtgggtatggtattagctgggtatggggcacctgcctatagtcccagctactcaagaggctgaggtgggaggatcacttgagcccaggaggccgagtctgcaggttcgtaccactgcaattcagcctgtgtgacagaatgagactcagtctcagaataaaatgaaataaggaaataaaaatgtaattgttgaaataagaaactagtggatggattagacacgagaagaaagaattaattgtttagacgattctctccaaaaagtaagtcagcatgtcacacagagagacatgaggatagatgatagggcagaagttggtgggcttggaggggagaggaagatcagaatgaggtccaaaatgtgtcttagtgaaatcccaggaggagatattaaaattatattagaaagtgaaagaaatagaagttttatttatttatttatttatttattttgagaaggagtctcgctctgtagcccaggctcgagtgcagtggcacgatctgagctcactgcaagctccgcctcctgggttcacgccattctcctgcctcagcgtcccaagtagctgggactacaggcacccaccaccacgcctggctagttttttgtatttttagtagagatgtggtttcacctttttagtcaggatggtctcaatctcctgacctcatgatccaccagcctcaggctcctaaagtgctggaattatacgcataagccactgcacccggcccaaaagctttgtgtttttacaaatattacacatgtttcttgtttaagaaaaaaagtcttcacaataacgtaggagaataagagaaacatttttccaaaaaagagaagtcattgtgattattttatcttattggaatgttggataatatagtctgcttcagtaatcatcaagcatgctatggattttccattttcataggatctgtatctcggttaaggtaatactggtaatttttgtactctatgaaaaatataggccagaatcatagaccttgcatagaagctggatcatgaagacagctctggaggaacacacaggtacacacacacagacacacatatatataaagtatacacatatatattttttaaaagcttttaaagcaaaagccggccctgcccctctcccagagttggcggcctctcccctctcttagggtgggtggggacagtggttgcatgggcagctttccttgtgagccaaagatccctctggacacatgatgcctggccacgccccctttccctttcatctttctcattaaccaatgggcttggagcattaaggccacgcccctattctgccttctactgcatccctggttacgcctcctctggctcagtcgcacagctacctggtaggtgactggaggtgttgatcagtgcttggtgggattttgctgatgtggccccaagcccgcctccctccccaccctgcgatggcagaagaaactcgacaaagtaaattggcagcagccaagagaaaggtaaaaacacaccaggtcacggacccccaacccagccatagatcctctccaacgacaagactgctgccagagtccataccactcccgaggttcaccggactgggacccccacaccggtgcctctgggctacccccaccaaagttttgccagtcagccccaccccttcagcaagcagcccagtctctgccctcaccaatcaccccagggtgactttgggcaggtgaatcctggggctccccgctcctttactgggccctcatctcctgccaccccaagcttgacctcccagggctttttgggctcacatctccaaggacctgggtcccacagccccagaccccaccctcaccagtcatccctggctgactttaggctggtgaatcctggggctccctgctgctgactcttcccttccctcctgctgcctcaaggtggacctccctaggctgtgtgcactggcgtctccaaggacctgggtcccagctctgtttttccctcccctatcatggagcggtgactcggacatcatgctgatgtggtccctccccctcaccaggaagagtggaatgtagtgatgtcacggtccatccagtaactgtcattactgcgagactggcctttgatcttatgacccagtcccctaagcattgccaccccatttctggttcctcttgtcacagcacaaatttccagctggaaggggaatggagattgggacctaggagcaagaggtttcaggctgcctcactcccttaacataaacattgacagcgggaaaagcctacacttcccctgtgagctcaaaacattgacagtacctctggatggcaactggagaatgggtttgacttggtttggttttctcccaggcttctactttccagagagattttaacaaattttttgtgagttctccacctcacattctaattctccatggttctgggaccagactgcccttcagtcagtggtctgtgaagtgagatttgctcatcttctgtggaatagatcttgggaaactgaacttgacagcttgaatcttcctcatattatgtaaacctggggtactttgagtgccacaggatacatatgggacatctttctgaagcatcagtttccattgattctcttgagatcaagagaaaaaacattaatgtacttagggatgacagtcacataggtttctaacagtataccagacttctctctgaaatgaggcttgggttgtcctctttctgataaattcccagatttaacagaaaggctgccttctgccatgaggacacattgatataaaagtttgagaggtacaggtgcacttcttcacactaacagacgtgtgaggatgtatgactaaaccacatggcatacagttcctgcctacttaatgtttacttttctagctctgcctctggttttggtccctggcagctgatgattcttggtaaaaccccagagtttggagtcagaagactgagtttcaaagttcgtctgtcgcctttttcttttcttctttttttttctagccatgatatcaatctctttgagtcactaaatgattgtgacaacaccttgtacagttgttggtatcattaaatcagatggtgtataagagtattttataaaaactgtaaaggaggatgtggctgcaggggctgatagttctcatgagtattactgctcttgtttctgacagttaaaagaatattggcagagaaacagccctggtgttccagcaggagccaagaggaacaggaaaacaaatggcagcatccatgagacagccacttctggtggttgccactcacctggagatgtgagtcttggctgactaggttcctggggacaggggacccaaggggcactagagggtaattgttaagatgtggatggactgttgggtacctgtgaagaattctgggtttgaatcctgcctctttgtctgctagggatatgaattagggcaagttgctagacctcatcaggcctctcttttcacatctgtataatagaggtggtattgtttcacttccatttgtgaagtttaaatgagatttgttattgttgtttttatgttaatccctagtacatggcctgctgtaaacacccagaacacccaggatatggtcattgctgttcgattttcctcatccccagtctcaaggggaagccaggacaatgagaacagtcacttggcacaggagtcactgaaagggccgcagggtgctgtggtggggagataagaaccatgagagaagttggcacaaaggagttatgggacaaagggtccaagataggcagaaaagaaaattgtgccagttgatggggaagaaaagaagtcagagggcttagatactgagtgggacagaacatcttcatgtgcactctcatctcttgtagtcagcaacaggtatccacggggagagccctacatcatctgctaccctgaaggatctggaggtaagaggctctgggcagaggtgcagtgaccctgcagggcagccctccaacctcctcctccaggtgggacggggtgcccctctgccagctgagacagtccacacacaccccagccctaatgattgctctctctacctctccccccactcctcctccacctcctcctctctgcatgcgcctcagagcccgtgccaagaactagcagtagtcccagactcgaggtccgtaaaagtcagtcaactgaagaacaccatcaaatctttggtaagagtccactggggtcccctgattccacgctgccaatcctgggctctagtttccccttggggccctgaagaaaggggacggcggcccctggtgccaagggcgaatagggagctggggcgcccaggcctcacctggagggaccccggagcatgcagcatggctctttttttgctgccctgtttgctgactctcccctctccagacgcccctgctcgagtccttgctacacacgccctgggattgttgcctcttggggaagtgctagcctgactggttgtcaggggccctgtatttctgccatgactcagtccctaatttgctctttgattctggacaagccacctctcctttttgggctcatgtttccagaggaagtagtgagtatcaaaggtctctgttagctctcgagtctgagatttaaaggcctcctagaatggaaacctcagggccaaaggctcctgtctgtccttttccgccctaaatcttctgtgaagaaccgtacttggcccgtacgtgctcagtaaatgtttattgaatgaatgcacttttctaaatcacaagctggcagaagggggggcctttctcaaactccatctctagaggtttatattgctgtcctctcaagagattccagattcagaccttgagttctgtggctgtgggcaaaagccaacaaagacccaaatcctctgtccttgggagcttgaggagagtttaccagttcgagttcccactgggtctgagaactttgcctttaaaatccattcctggtccctgcctaccacttcctgctctggggaatagagttgagggggccaccctccatcaccttaatgtgactctccccacagaaacaacagaagaaacaagtggaacatcagctggaagaagtaacatgatttctttgtttgctcgcgacatgactgctcggtttgggggacactcagatgtagaggccccgagtctcgtctcacccactcccagcctggggaagaaggctcaccccccagagtccaccccatcccccacagggtctctgataacccggtcccatgggtgggcctgtcccggggcaggggcagtggtggcattctggggacatgtctcttgcagtaccatctctgcctctgcctggttagatctctgtcttcctcttcctacaggaaaagaaagcaaacaacgagaaacagaaagccgaaagggagctagaggtgagtggacggtgtgcagtttcctcctgtcctccggagaatgtttctttccttctctttcagcacttgcttggcttttctcccaaaggttcaaatccagagattgaacatacagaaagggaaactaaatacggacctgtaccacacgaaacgttctctcagatactttgaaggtgggaatctgggtaccctgtcatccttcaacctggaactttgacaggtcttcagggggagtcctttgggccccatctcaactctctcattacagaagagtccaaggatctggccgtccgtctgcaacattcattgcagcgtaaaggagagttagagcgggctctctctgctgtcaccgccacacagaagaagaaggcggagagggtgagtccaaccacctgccccgtcccctgggagcctggcttcgcagacagaggagtgagcctaaaggtcccttctgcaggatggagtgtcctgcccagaaggcagcatggccatttctcactgcttttttgtatggttgttagcggcagcttgggactgagtcagctgctgtgggtgagttggggggcactctggggagagagcacaggacgtagagcttggaggccaagtgcctgccatgcctttacctggctgtggtcttggccaagtcctcagtgggtattgggtacttgtactgtgaaggtacagaagagtacctttagtatgttaccatttctgtagagagaggaaacgtgtgtgtgtgtgtacatattatgataatatacataaaatatgtttgcaagtgttcataaaaactcaggagagagcaacagggtggctgggagatacttcccttctgtaccttctgagtctgggactatgtgaatgtattatcctttcaaaaagtgaacaaaagattaattttccccttcctagctgtgcccccacccccagcaagaaaaatgggcttagagaattggatagatctgggtgtttaaatcccagctctgcctaagtgatcttaggcaagcacttaacctcaaatactccatgttttttcatctacacaatagaggtcatcatagtaactgtctcccatggtggttgcgaggattaaatgggattgctagcatggtatctggtgaagcactccataaaagttcaaacagtggtaataataacagtaataacaatagcaatattatctgatctctctgggcctctgttagccagctataaattcgatctctttccctgtcccttccaactttactgagttctttaaaaaccaaaccacgggcttggaaatgccttgatctttactgaccgagttgtatattgggcctagccctggcccttttaaggggcactgtgtggaatggcccggcctccccagattgaaacttctcactcttcagcagttctccagccgcagtaaagcacgtatggagtggaagttagagcagtccatgcgggagcaggcactgctgaaagcgcagctgacacaggtgaggtgttcagagggagggatgtggaaggaagatgaccccaggtaaccaggagcaggtgaggaccagtgacagcccttcctaatttctgtgcccattcttgcagttgaaggagtcacttaaagaagtccagctagagagggatgaatatgctgaacatctaaaaggagagagggcccggtggcagcagaggatgagaaaaatgtcgcaggaggtgagatctgacccttcagcccccccacattagataggtcactggatctttctgggcacctgtaaaatgggaatagtacagccagaggtggtcatgggtctgggctttgtggaggtgggggcagagagagagatggtagcatgtccagcctccagcccctctctccagggccctttccccctgtgctttgggcaggtttgctcgttgaagaaggagaagaagcatgataaatatcgggtagagaagctggagaggagcttgtccaaactcaaaaaccagatgggtaagatggggctggcgtgacctggcagcaggactggcatcagagggctgtgagggtggcttggagtgccccagcgaggtgggtggatggaagggctttgaggcagagggaaagaggtctgtgccaggagacggcaagtcttgtcatctcaatgagcctcagtgtccccatcagcaaagagggcccgttgtcagccacccgcagtgctctttctctgaaagtgctttggaagactggctacccatctgggtgcgaggaatcattagcagtgaggctaagtttgaggagccggagaggagctgtgcgccaagaggagggttttttcttttcttttcttttcttttttttttggaatccagaggctcttattatctgcttcctttctcagctgaacctctgcccccggagcccccagcagtgccctctgaggtggagctgcagcacctgaggaaggaactagagagagtggcaggagcgctccaggcccaggtggagtacaatcagcgcataagtctcctgaatgaggggcaaaaggagaggcttcgggagcaggaggagaggcttcaggagcagcaggagaggcttccagagcaggaggagaggcttcagcagctggccgagccacagaacagcttcaaggagctggtgcgttgccccagctggggagcctgccctcctccctagccctccaggcctttgtttccccacctataaaatggggcagtgtagccctcaagtgaaatgttactcctaaaggcacctgtgagccagagccctgctctggtggctgtgggagacaggggatgatttttctaacctgcctccacccttcccggtgccatgggaggcagtcaccaagttctggggtctccagctgcagtgggtggctgctgattgcttctctctgtccagaacaatgagaacaagagcgtactacagttggagcagcaagtaaaggagctgcaggagaagctaggcaaggtgaaggagacggtaacctccaccccatccaagaaggtctgggaggtgggcaccagcctctggggaggggaggtgccaggccagaggcagctccagcccaggggcaggtgaccccagcaccctccagggcagtcctgtggctgtttcttgcttcctgccctctgattttagaggtgggtagccctgggctcctcccaggtctggacatcatcattccagctagagacatggagcacccccaatcacaggggaagagacagagtggtataacagtcttcttatgccagacgcggtggcttacgcctatagtgccaacactttgggaggctgaggcaggagaatcacttgaggtttggagtttgagatcagcctggccaacatggtaaaacctcatctctactaaaattacaaaaacaaaaaacaaaaaaagaaagaaaaattagtggggcatggtggtggcgcatgcctgtaatcccacctactcaggaggctgaggcacgagaattgcttgagcccaggaggtggaggttgcagtgagctgagattgcaccactgcactccggcctgggccacagagtgacactctgtctcaaaacaaaacaaaaagactccttagattaaaactggattccagcctcagttccactggtcaccattcaagtacttcacatctctaagtctctgtttctttaacttcaaaaggaagttagcattttccttacagaggtgctgaggattaaatgagataatacatgggaagcattaggcctgtagcacatttagcagatggtggttggctcccactacttttctaccattctgtggcctacagttgaaatggtgggaagaggacatgagatttgaggctggggaaggaggcatggggttctaggaaagggaggcagtcacttaggcctggagtaaggggccaggggcctgggcaggcgacagagccccacagtgccctcgctaccctattaatgggcccagaatctgcaaaccagccaccacgtcccctcacacccagggtcttcctgcaggtggagctgaagagccaagaggctcagagtctgcagcagcagccagaccattacctgggtcacctgcagcagtacgtggccacctatcagcagcaggtggccacctatcagcagctgacctgtgagaaggaggcgctgtacaggcagtgactgcagcagacccagctaatgaaccagctgcagcagcaggaagcttggggcaaagcggtggccgagatggcctgccaaaagttgcaggaggcccaggggagggagctgccgaggatggggccgtgagggggacgagctggcaaactctgtgccttctcactctttcctggccccttaggagcgtctggaagctgccagccagcagaaacagcagctaacggcccagttgagcctcatggctctccctggggaaggtacgggagaccgctcagaggaagaggagagagccccaggaggaaggggggactgctagcagcataggattgaggagttggaagagacctttagaacagctggtcattatactaaccgggtgcctgcactaagttcagcatcaatatggtgacctcctgggagcggggggccaccaagttgcctaaggatggctgaactggccgaggtcagaaagggagcaggtcagaactcccacatcgaccagtagtgggaatatgcctgggcagtatagcaagatcttggttcttcaaagtaaaaataaataacagcagctcattcctctctggggagggcctggctcagggttacacaatgagggtggaggcagaggtgggcccacaatacttcccttgttgagttgtctgaagacccctctggccaccccccacaggacacggaggagaacatctggacagtgagggggaggaggcacctcggcccatgccgagtgtcccagaggacctggagagcagggaggccatggtgagcctgactccccctgcacccattttgccacctttctctgtggtccctccaagacccctttatgctcttcgtttccctgccttctgatttctctggaccctcaccccttccgagagccagtggtcagacaccatttcacctgtgaccaacatgtgcagtctctggggccccaagggaaggggctgcgctccacctctctgccccatttcttctgtgtatgcccctagaagaatgctcacatcttgccctcaggtggcatttttcaagtccgctggagctagtgcccaggagaagcaggcacagttacaagagcaggtgaaagagcagagggtgtgctgccagcgcctggctcacccggtggcctcggcccagaaggagccagaggcagcggtcccagccccagggcctgggggcgagtctgtgagtggggagacccaccgggccctgcaggaagtcatggagaagctggcccatgccggaactcacctccgccttctccatgacttgaaaatgccacctgagggcaggtcgctggcgagatgtgaccccattattttggctccagagcggctttatggaccacctggaggagaaggcagacctgagtgagctggtggagaaagaagaacttggattcttccagtactacagagagggatgccatcagtgagtgggaggccagggcatggcagggggagctgcagggctgttggaggggccccagcgtctgagccctgtcctcccgcaggaaagtttatcaccctataacaaagccagggggcagtgccaaagatgcagcaccgggaggaggacaccatcaggctggccctggacagggaggagatgaaggtagagtgtgcaacatctctgcgggggtgggggtggctgtgacggtgagcgctggcagcagcgtgacagctgagcacccctccctccaggtgaagctgctggagctgcaggagatggtgttgcagctggtggcgactacaagggacacagcaaattcttggtgactgcccagaaccctgctcatgagcccagtccaggagccccagccccccaggagcttggggctgcccacaagcatggtggtgagtagagccctcaggcggggtgggcaggcaggagcaggggggctctcactgagctcagatccccgcctccctctctccaaagatctttgtgaggtgagcctcactgacagcgtggagcctgtgcaagtagaggccagggagggttctccccacgacaaccctactgcacagccgatcgtgcaggaccaccaggagcacccaggcttgggcagcaactgctgtgtgccattcttttgctgggcttggctgccaagaagaaggagataaacatcaccatcgtcaaagagctgctcaagaaatttttaaaaaagaaacaaagttatggggttaatctcctacacaattcatttacttcgtttgaatgttatagccacttatgattatttgtgtttctaatttatagtttaagtttatttgtaaatagttaaaagagagtgggtctctgtggctttcactgatgttcactctggcatactttcgcaattttctttttcaatttcatgattgtaggtcattagcgtgcatattgagtttgcccttacgtggtggggttcaaacacacaaagacccactatttgcacaaaactattcttgctggtttggaataggctgccatgtgtttttaatgttattgcagcatgtatattcattacagaattcagataaaatttgcctatgttctgctattgtttgatctaatcttaatcacagtgagctcttcattagcacaatatgtggtttgccccaagtgtgcactatttaatactttgtaatatgccaccaagagtactgacatttagagttgtttaaaggccgagaactggaaacagcctttccctcattttctgtgtattggtgatgggagtaataacattttgggggagctttttaaatttcacagaagaggaaagttgcctgctctggcaggtatgtgcaagatagagtgtgtttcatttgttctgttgccaagaattagtgctgtactattgtagttcctttaggatttgtatgtgctctgggctcatgaagatattgcatcatgagctgcagcagttgtactcttttttgatgacctaaaaagggcttatttctgaggaatgaaaggttcccatcattgactatggatgtggaaaacctttcctagcttagagcatttgtatctatattttaaagtcagagttcatgttacctgttttaatcacatgactgcatgtcccagtacacaaaagggcactggttggcattcttcttaatgtatttagtaaagatcagaagaaatcctttaagagtttaaatgtccctggaacacgcatacaggctctagtcaagaatgaattagagtgaaggaaagctgtgtgacacctggcattcctctgttcatggagcttctttgaggcttgaagattgattttaccatctagaccactctgcctattcttcaaccaccttggttactttgacataggaattgacttcttttccttgaatggaaaacactttgaaataataataaacattgttataaactaatatatgtgagagtgcttagttgaaacaaaaaggagttttagtagacagtattatactatctttgaaaatcaaggagaagtttatgcaacttaaaatgtgtacaaactgcagtgcaatctactgttggtgaatgtcagtgtattatcaggaaacatgtctatacaatcacagagttatatttcctcacaaacttctttgtgaagagtgaaatgtgtttctgtacctctgggtttcacttacgggcatattttgtgcagtatttatgtgattgtgcctatgcatgatgaatgaatgaatttcagttgtacattgcctaaatcataacttgatgatgcttgggaaagactcaacagttaaaacttcatgaagttctaatgtctgtgttccaaaacacatcacattattaggatgtagggagatatgtatgtgtgctccctggggtggggatttctagttactagaccatctccatttttagcagttggcatcctcatgatacttttataaatacgacattaacaggagagcagcagtacgattttgccgatggaataacagatttgccggcaatcactgaaagagtgcaaatatcgggtccttgtgacttcaacggactcttccaaattgtatgaatgtatcaatgtattagataaacccagtttcagaatgataaagaaaaaatgttagaccaaataatgcggctagttaacagtggtacgatttctagcccgtgggtttaaaatgcacttaaagtcctgtccttgccttttattttctgaacttgatgtttttgcattctttgagttcagtttaaagacaactacgagcatctgcaaccaatctgacaataatgtgttcatcaggtgcctatggattaaatcacatactggcatatttaagctgaatgtcaatctggaaaataaattgactatattaacagaaataccactctttgtgtagatatttgtcgtatatttaagaaaaagctaaaaagaatggaaatcgcatgactataacttaagtctttcttcaaagtgcatgcagtcttttgcgatacctcattcagccaagtattggtattcttcctcattcggtataaggcagctttcaatttgcttagaaggcaacattggaaggttagagttcatcagaaacagaattctaaaatgtgagttcaattcaataaatttgaatttctgtaggaagaatcaaatcaccgatttaaagagtgcaatatataataatcatttttaaagtattggattaaatctgataggttttccagaaatgaacaaaaatcagctctaaaaccaaagctgatttttagaaaatttgaaaatgtaaatcagccctatccatactatagtttctctaaaactttatctgaaagagtcattttaaaataactattaaacaatgtaactgctatcttaatgttctgaaataagttaaaacattttaaaatatgaatactgtaaaggaaataaatggtgggaaggaaaagtagagaaagaaatgccaattccagtccaaagctttatttgccaagttttcttggaatgaattttaccaatttatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattcttcatgaaaggcctgtgtatactttgctagatatattctcagggttttgttgctattgtgaatagaatctcttttttttttttttttttttgccacggagtctggctcctttgcccaggctggagtgcagtggcgcgatctcggctcactgcaagctctgcccctccaggtttaagcagcctgttgcccaggctgcaatgcagtagcatagtcatagttcaatacagcctcaaactcctgggcccaaatgattctctaagctaatatttttaattttttagagatggagtttcattcaaggatcactaaaggccagtgatcctcccgcctcagcttctgaaattgctgggattacaggtgtgattgagccatggagcctggccagacatgggctattgattctcgctgttactcttttccctttccttctaatccttgtattgggaagaaaacagtatggaaattttatttcttcattttattgatacgtagatctctgcttagaagacaattttagttttaaattataaatgtttcgttcattattcatagaaaactagatttgccatgggatatttataagtgttgcacgaatgaagggttttctagtcaaataagttgaaacacattacgttaaacaaacttggacagttttgtttccggtcatttttagagttctaaattatgattctactcaagaggatattgtatgcggtattttcaaaccaactcatcctgcgtcaggttgtggttacgctttgggagaggaagctataatcttatactgagactgtaatgaatgtattaaggtaattttcgtagctttctctttttggagttacctgagaaattatgacacccttttccaaacaggccaacctgctttgcaaacacgatttccataattttaacaatggtgaggccaggcacggtggctcatacctgtaattccttccagcactttgggaagcctaggcaggaggatcacttaagccaggagttcaataccagcctgggcaacatggcaaaaactcatctctacaaaaaatacacatattagccaggcgtggtggcacacacctatagtctcagctactcagaggttgaggtgggaaaattgcttcagctcaggagctcgaggctgcagtgaacggtgatcacgccactgcactccagcctgggtgacagagcaagaccctgtctcaaaaacaaacaaaacaaaacacaaaccaagggtgagagagatgttagatgtttttgtccttgttacagatgtaaatgctcagttggaaagagggaactatttagagtgaaaaagtttcggtggaacacacacaaaaataggaagatcaggtataactgttccaaaaaaaagagtatggcagtatagaagaaaaggtctccatgaaaatgcagaagaacaatttcacagctggtgctggcatttcagagaccttgagctgggaatcaaaagatgggaatttcagtctcggatgtgccactccttagaggtttaatatctactaaacccggcgggctccacttggtggtgtttgctatttaaaaaaacaaaaacatgtggcaatgatcttccacgtgattctgacttgagccccacgcgagtctgcagacttacccttccactgctttgcccttcaagtttgtgcccattagcaaagagaaattttctctttgggatcactgctgtgttgatctcaggaatatttggcgttgaatttaacatatttttcatatgtgtgtgcaatagggaggctgagaaagttgtcttttttttaaggtgttcatttttggggtacaggtagcagcctgctctacaatccacacagaagctggaaatagcctctagagaatttccacgtttagagaagataaatttatacatttgtatctaatcaacattttttagctaacatagtagtctaattatactatgtataattatactatgtataattatgggtactgaaatgacacctggcatatgctgtatgctgtgttatatatacatatatatttacacatatacatatatattacacatatacatatatatttacacatatatatttacacatatacatatatatttacacatatatatttacacatatacatatatttacatattttacatttacattttacatttattttacattttacatttacatttgacattctacatttattttacatttacatattttacatttacaaatatttacatattttacatttatatatacatatatttacatacatatatttacgtacatatttttacatacatatttacatgtgtatatatttacatacattcacatacatatttacatatatatttacatacatacatatttacataatatttacatacacatattacatacatatatgtacacatatacatatatttacacatatacatatactatgtataattatgggtactgaaatgacacctggcatatgctgtatttaaaaatgtgaggttcagtgagaacacatggacacaggaagggaaacaacacatactggggcctgtcagggcgggtgggggaggagcatcaggaaaaatagctaatgcgtgctgggcttaacactgaggtgatgagttgataggtggaccaaaccaccatggcacacgtttccctacgtaacactcctgcacatgtaccctagaacttaaaacaaaattttaaaaataataaaaaataaaaatgtgaaattcagcacataaactgttggttttattattcatattttcttaattcagaaattattttctgaactatggtttattagataattttgacgtaacaattttttaagaggaaatttaagttttactttttaattggggctcttggttctttttaagaaagacagagataaatcatttatacatttaattagaagagactgggcttgaatttttaaaaagtactagaaatcgtagccactatatatgttatctttgaaatgttttagacaataattacctaaacaaggagcaaataagttaaacctcttggattttaataagaactaaaatgtacagttgtattttctggttttttaaattgttacagtctaaatttattcttcctaatgaagaaatgtatgtgccgtcaatatcaggttctttgtgggtactcacagttccctttgccttttacgcagtgaatgtgggcaacatgcgtggaacagaaatgatgtcgttttctttcttttgaatatcactatgaatctaataattcaaagattcctaactttctgaatgccattattaattggattcacaatgacttaccaggtacagagttgtcccgtgtgtcttggggtgaactactgagagtggtatgagggaagcgattctcagctagcgctgagtggggccacttccaaagaggtgatggggtaagaagcacacacaatgtggcattttcactgcaaagggaggtttgtgctgcctctcctcctgtggcaggtctgctcgcaggggaggctccaaagtttggctttgctgggtttggcatgtgagaactgatgaaatatctgtatgtagtatctttcaaggatttatatcagttggatttctgtgtaaatttgcatatccctttgactgctttaccccatagaagctttgtatgcttaacaaaatctgtaacttttctgtcactttctcatttagcatctgcctttctggctttttactttatctttttattattgtttttagtttaatgagattatggttagagagaaagatgggtgcatgattccgcttctttggaatttgttgagattttccttatggctcagtacatatgtacttgggggggtgaatgctgtcactttggagagatatgttttttctgtacattaagtcaagcttgttaattttctagagagatgtaaatcttctatgtctatgctgattgttttttgtctcttttatcagacactgagatatgtatttaaattgccctctgagggttgcaattttgtcatattttgctttcatgtattttgagtgctagttattagatacattaacattttagattaccttctcccttggtttattagaatttttatcattatattgtggccttaaaaaatctcccatattgctttttgcccaaagcctattttatctgataataatatagcttccaacccttctttgggttaggtacatatgacaggtgtatcttttttcaatctctctcagtctttctgtgactttatgttttagatgtcttttcatactgtttattttctgttttttgtgtttttttgtgtgttttttttttttgatacggagtcttgctctgttgcccaggctggagtgtaatggtgtgatctcggcactgcaacctctgcctcctggattcaagcgattctcctgcctcagcctcctgagtaactgggattacagatgttcaccaccacgccggctaatttttgtattagcagagatggggtttcaccatgttggtcaggctgctctcgaactcctgaccttgtgatccctccgcctgcctcatcctcccaaagtgctgggattacaggcatgagccaccacgcgtgccctaattctgttttatagtcattttctcttaattattcagtctatttacatttattgtgattgttggcatagtttcttttataactttcatcgtattttgtgctatttgttccatctgtttttatttcttcatgtcttttttgtttcgtttttgctaattccttttatattcatggttattctgctcttgaaatgtatgctatgtgaatatatttgtgagttgacaatactttattagcaattaaatatactatttctctttttttttagaacttgctcaaatgttacataacctcaatatccttagtatctaaattaaactgactttctgaacaatcatcattttaaggcagttaccacgatctactaaaaaataaaaaaaaattagccgggagtggtggtgggcgcctgtaatcccagctactcaggaggctgaggcaggagaatcccttgaccctgggaggcagaggctgcagtgagccgagatagcgccactgcactccagcctgggcgacagagagactccgtctcaaaaaaataataataataataataataaaggaatttaaaaaaagactgggtttaaccatgttgcccaggccggtctggaactcctaggctcaagcaatcccccacgcttggccagtccaaagtcctggaatcaaaagcgtgaaccaccacgccaggccgatcacgcctgtcatcccagcacttggggaggcggaggtgggtggatcaccggaggtcaggaatttgagaccagcctggccaacatgatgaaaacccgtctctactaaaaatacaaaaaaaaaaattagccgggtgtggcggcaggcgcctgtaatcccagctactcaggaggctgaggcaggagaaccaccaaaacccgggatgcagaatttgccgcgagcggagacccagccactgcactccagcctgggcaacaagaaggaaactccgcctcaaaaaaaaaaaaaataataataataagagacagattttcaccatgttgcccaggcaggtctggaactcttaggctcaagcaattccccacgctcggttgtccaaagtcctgggatcgaaagcgtgagccaccacgccaggctgatctatttctttctgattaataaattgggccgggagcggtggctcacgcctgcagtcccagcaccccgggaggccgtggcgggcggatcacctgaggtcgggagtttgagaccagcctgaccaacatggagagacctgtctctaccagaaaaaaaaaaaaaaaaaaaaaagagccgggcatggtggctcccgcctgcaatcccagtcactcggaggctgaggcaggagaaccacccaaacccagaggcagaggccgcggggagccgacaccgcaccactgcactccagccctgcaacaagagggaaactacgcctcaaaaaaaaaaaaagagagagagagagagaccggttttcaccatgttgcccaggctggtctagaactcctaggatcaagggatccgccacgctcggccggtccaaactcctgggatcaaaagcgtgagccaccacgccaggccgatccttcctgtcatcccagcactttgggaggccgaggtgggtttacctgaggtccggagttcgagaccagcctggccaacatgatgaaaacccatctctactaaaaatacaaaaaaaaaaaaaaaaaaattagatgggtgtgctagcgggtgcctgtaatctcagctactcaggcggctgaggcaggagaatcgcttgaacctgggaggcagaggttgcagtgagccgagacagcgcaccactgcactccagcctgggtgacaaagtgagactccgtctcaaaagtatatatatataaaaataaaaaatgaaataaaaataaattgggtgtgtgcgctggctcacgcctgcaattccagcatccccggaggccgaggtgggcggataacctgaggtctggagtttgagatcagcttgcccagcatggagaaaccccgtctctaccaaaaacaaataaaaaaaaattagcagagcaatgttggtcaggcctgcaatcccagccactccggagactgaggcaggagaactactaaaaccctggaggcagaagtcgctgcgagcggagacccagccactgcactccaccctgggcaacaagagcgaaactccgcctcaaaaaaaaaaagagagagagagagagagagagagagaccgggtttcaccatgttgcccaggcaggtctggaactcctaggctcaagggataccccgcgctgggccatccgaagtactgggatcacaagcgtgagccaccacaccaggacgatctattcctttctgattaataagttgggccgggagcggtggctcaagcctgcaatcctagcacctcgggaggcctaggcaggtggatcacctgaggtcgggagtttgagaccagcctgaccaacagggagaaaccccatctgtaccaaaataaaaataaaaaaaaaatacaaaattagccgggcttggtggcttatgcctgcaatcccagccactctggaggctgatgcaggacaacgaccgaaacccgggaggcggaagtcgcggcaagcagagacccagccactgcattccagcctgggcaacaagagcgaaactccgtctcaaaacaagacaaaacaaaaagaccaggtttcaccatgttgcccaggcctgtctggaactccaaggcacaagcgatccaccctacttggccgtccaaagtcctgggatcacaagagtgagccaccacgccaggcagatcaaagcgttgagctgaataaagagttatcttttagcattttgtggagcccgggtagatctgtgcagggggaagcatattacagaagcgagaaacagagagttatttaattgaagcacgcattatgttttttttttttttacgtttttaggaaaaatatgttttgtgacttgcatttgtttgtttagtcaccttgcagttgcacagttagggaattagggttttgataatgcctgggaagggagcgataaggctcactagccataggaaaacaggtagtttttttaaaggactaaggctctttctcattctcagggggaattgggttttttttacatacagctgagtttttgcttacacattttttcatttcttttaattcctgttccaatcccagcatccttgcggtgcggtttcccagcggctctcttgccttgcagcttgtgtcgggagttgcagacagccatggcccatgggcctggcgctgacggaccctggagcggtgtctgagggaggtgggcaaagccactggctggcccgagtgcatcctcacgtaagtgcacagatcccgggctcgggtgcgactgcggtcgcacgtggacacgggttgcagacccctggcaaattgtggagctgggggaaggtaaggggaaatgtaaatcacttttccccacatttcagaggacctaggctatcaaaattttaaaaattgttaaaacttttacagtatggatctctcagttgaatgttattgaaatcaacctaacctcagttattcacgcctataagctccccttgaggcttattacggcccccatccccctacacacaactgtgttggtttctccttccgcctgtgctcctaaagcactcagtgtttacctgccatcatactttattgaaagcacaaacttgtcacttgtctgtctaccccactaagcttcttgagaattagaactttcatgtctcttcccaacacaaacgttttatgtgtattttgttgaagaacttcaaatatgacctataaaattatgactcatttatgtttcaaactccaacctctcccttgagttccttgctcacaagcaactccagactgagcttagttggaattcagtagcgcacaactgggatatccgcaccgtacggcttttaacaattttttaaattttggtcctctcagcatcacaaattcaccgtgtccaaaatacagtagaatgttgtttctacccacctacactctgccatccgctgaagtcctttccccttgctccaccactcaagccttgcctatcgcagtaaatggcagttctgtctctccagttgctcgcacataaaactaggctgctattttgatgtcttcacttttctctattctgtatctaattccttagcaatcctgtcagttctacctccaaactgtactcagcatattcactgctctaactccagcttaaatcaccatcatcctttgcctggaatgctgcatcaaccttctaatcactctactttcctcctcctccttcctccctttcttcttccttcgtataaatcatcatttcatccttctgcttaaaatcttctcacattttcttattacacttaaaacggcaaactcttacccttgagccctgcagaatttggctcccatcagtctctccgacttcaccttctgcctccttcacgctatagccatgctcacttttttattcctcaggcttaccaagctcaattgcatcttagagaatttgttcttgctgtttcttctgcctggaatacatgtttcccaatctttataagactatacttgtctgtaagtttcacctcagatgtcacatctaggagaggttttccttgaccactgtaagccaaagcaaatgttgatcattgagtgaataagggaatgaatgaatggagtggtatataatgtagcagagtagaaaatttaaggctaattctctatacatctccaagcaaatagatttgtaatgcttttcctgccaacaatctatacagctgattcacaaatacttggttgacaggttttatatatcactgtggctcatcagcttatatattgttggggccagaatctatacttacactttattcaaatttgattttacagaagagttgaggtttttatttttcttttaattaagagggctgtgaaattattatctataattctaaatctcatttaattcctcccaataggtttcaagctggattggaaccaaagttcacttctttaacgaaagtgctttatgactttaataaaacagtagagaatggtagaatccatggcagctctttacaaaaacttgtgatagaaagttttgatgatgagcagactttgcaacaactggaattgcaaaatgaagcaattttacagtgcttccagaatgcggttagtgaaagaaagatgaagatatcagtcttctcccagagagtgaagaacaggagcatgaagaggctggttcagaaacagaggctgatggccaggaggacctagaagatttagaggaggaggaggacgtgtcagatatgggtggtgacaatcctgaaatgggtgagagagctaaaaactcaagcaaattcagggccaggcgcggtggctcacgcctgtaatcccagcactttgggaggccgaggcaggcggatcacgaggtcaggagatcgagaccatcctggctaacaaggtgaaaccccatctccactaaacatacaaaaaattagccaggcgtggtggcaggtgcctgtagtcccagctactcgggaggctgaggcaggagaatgccatgaacccgggaggtggagcttgcagtgagcctagatcacgccactgcagtccagctgggcggcagagtgagagactgcatctcaaaaacaaaaacaacaattacttaactttaggatgctccaataatcaaaattgatagtggcttgtgaacagatagattacttgaatagaatagagcccagaaataaacccaaatgcttctgggggagtttggtacattataaacatgacattttaaatcaatgaggaaaagaaatcatttgcagctcaccccaccatacacagcaggaataggaagtcattggcagaataaaaagatggtaagaacagaacagaattgtagaacagtacatttcttgcttccccacttttcaaagtattttttgctttttcacaaatgtaagtgtaattttattttctaaatgtatactaattcttttcttctctttcttagatgaatgacaaaaattacatctttagaaaaagagttgttagaaaaaagccttggctgcatgtgggggaagtgacagcacagaagagaccagagaagagcctcctggaggagagcctgcactttgaccatgctgtccggatgggtgcagtgctcttttctgcaaagtgttcacttctctgctttttctgtggtcccatttcatagaaagatttggggtgatgtttctttccctcaacttttattttgaaaacttgcaaacacagaaaagttgataaaatcatacagtgaacatctgtatgctattcaactggattcactagttaatgttttgtcacacttgttttctgtcttctgcgtatggaagattgtatatgtgccctttttccccctgaatcatttcaaagtaagttggcagtatcagagcatttcactgttaagtactttcgcagatatcttctaggaaccaggacttctcctatataatcacaataccattaatccacccccaaaatttaacatcaatacactaatgatacctactgtatagattataatcagcttccttgcagcaatctgtttagaaggcttgcatcctgtcactgtccactgattaaattttgaactctaacttgaaaccctggtcatctcattgccttcttgcttatacccattaagtcaaaaggagctctcattttatttcaacagaaaagagaatggaaaagaggggaagagtccctagtaccttggataaagtatgagcacttactaccatatgtattctagttctgtagttttcaaacttcagggagcatctcaaggcttattaaagcacagatagctgtccttccccactttctgattcaggaggtgtggggctggcccaggaatttgcatgtctaacaagttcccacgtgtttctgatgctgagggtgtaaggactacaatgcgtgaatccgtggtttagtggatccacctaatgaatacatgttgtatttcctttggcacccgtgattacagaggaaacacctttcaactggaaggtatcattaaacagaggataagagatcaggtcagtaagaattaaatttcacttaattgaaatgtcactcaaatgtttagaaataatatgacaggccaggcacagtggctcatgcctgtaatcccagcactttgggaggccaaggcagacggatcacttgaggtcaggagttcgagaccagcctgtccaagatggtaaaacttcctctctactaaaaatacaaaaattagctgggcatggtggtgcatgcctatagtcccaggtactcgggaggctgaggcaggggaatcgcttgatctcgggatatggaggttgcagtgagctgagatgcgccaccgcactccagcctgggcaacagagtgagactccatctcaacataaataaataaataaataaataaataaataaataaataaataaataaataagataaaaataaaaataaagggaagatggggcagctttgtgtattgcatgtcctgaaaatgggctgatttctctcaagaggcagggatttaagctctgtagcctatgtgggatacatacaggagaaaaaagaagaaaaagaaaagaaatgtaaatataaataaatgaaaataacacttttccatgattataaaggaaatcacattgtttttgtaataatttggatgacaaaatgtaaagaaaaatctttaattttgccactcaaaacattccggtttgttgcttttcacactttttatgctgtaaacattttaaaaagtagaatcacaatacatggtcttttgtcacttactatattttaagcatgtttctatggagaaatataccctggcatcatcactggatgtatgttaagtgagtcattgccaccccagaggtggatttccttctatatatattttaatggactcgagtcaggatttttgcactgaattcatagaagtagaatttctagaggaaagtaatataaaacagttttaggatttttaaaagaaatgttcaaatcatcctacaggaaaattggttgagtttatgctcccaccaacagggacagagctccaggttcccccttccatttgtcatcttcgctggtctttaagcagaaaatctcattgttttcattacctttctttgatttctagtgcttttgaatctttttcatttgctcattggccatttttattcttgtgggaagtgctggtttctccattgcccattttctgctgcaaatcattcatttttttttctgagtaattttaaagatttctttataggctaaggctacaaacctttaatctgtcattgaggttacaaagatcttctcccagtaagtaatttgtcacttcactttatttatttattttttgctagcaaagcaccaaagtcaaatttcacttaatttttatcctgctgaatgaacacattttaagttagtgattttagtggaaacaggagcaggacagaatgtaataattagatctcgctctgtcaccccaactggagtgcagtggcatgatcatagctactgcagcctcaaacttctgggctcaagtgattttcccacctcagcctcccaagtagctctaggactacaggtgtgtgccgccaagcccagctaatttttaaattttctttgtagagatatgaattcgctatgctgcccaggctggtctttaactcctgacttaccccaccttagcttgccaatatgctgggagtacgggcgtgaactactgctcccggccaagagcttactttggtttgctagcaaggttcttggtatctttttatatttgaggctttcgtgctagtgctgaagtattacactcaccatctgaggtttacaggacttttgttttaatattgaaccgagggaactgtttagttttgcatctttgcaggtatacaaaatgtgcctaccaggactctgctttatatccattgaaaagcaagaagtaatacagtaaaagtttgcctggctacaggctttggaagaatggagtattctggtttaattctattaacttggaaggatgaaggtggaaaaaattcaaaactttaatttcctgttgaatgcaatttgaaaatatagccaatgagtccacttttcttctctagtaagtttggacattcagatctacttggtcttttatcatagaactcctagtgcgcctgagtcttacgttgtgaaaatccttttctaaaactttagatgtaagaggatagaaatgatattggatgagatcaggctggatgagaactgatacctgtagatatattttttagatgaaatctctgattgccacacgttttcttattgaactcataaaaataaaacacactggctggagggtggaagtaggaaggagatttatgtcttttaattgcatgtcattgtttcatattgagacagaacatatagtatccctggctttggacctacagaaggaaacacatttttctacctgctgtatggcagaggttcctgagcacctggagggattattgcagcacggattgctgggccctactgcagagtttctgattcattcatgtctagggtggggcctgagaatttacatttataagaagttcccaggtgctcctggtccggagactacatgtttgagagccacccttacatactaactgtaaattgtagaactctagaaaaaagcgtagtttggactgggagaagaagcacacaggtaatggagcaaatcatgaaaaagtcaacccttgatcccaggtaacaagcaatacacagtgacataacacaattcttggttttcatgattgcaagtcatagccaagtatcgagtgagaaattcagtttcattttcagggcttagaggccaggtgattctagaaaaatcggatttagtgattaactcatgagagtaggagttatttatgtcctttttctctcccccatcacttagcatttagccttactttagaagggtcctgtatttgctttaaccttgtaaagaactttgagtgcttattaaatggaaagccttgtgtgtgtgtgtgtgtgtgtgtgtgtgtgtgtgtctgtgcgtgtgtgtgtgtgtgtgtgtatttagagacagagtcacattctgtagcagcccaggctgaagtgcagtggcatgattttggctcactgcaacctctgcctcacaggttcaagggattctcctgcctcagcctcccaagtagctaggattacaggcacctgccaccatgcccagctacttttgtatttttagtagagacaggatttcatcatgttggccaggctggtcttgaactcctgaattcgggtgatccacccgccccagcctcccaaagtgctgggattacaggcatgagccatcacgcctggctcaaagctttgtatttttaaagatattagacatgtttcttgtttgtttgttttttttaaaaaaactaaacgctaatgtaggagaataagagaaagtttttccaaaaaagagaaaacattgtgattatcttattggaatgttggataataaagtctgctttatcaatcatcaagcacactataaaatttccattttaataggacttgtacctcaattgaggtaataaagttttaaagtttttaaagtgaaagccagccccgcccctctcctggagtgggcggggacagcggttgcataggcagctttccttgtgacaacacaggtccttcatgacacgctgctgtctggccacacctccttttcctttcatctttctcattgaccaatgggcttcaagcatgaaggccacacccctattctgcattctagtgcagccctggttacgcctcctctggctcagtcacacagcgacgtagaggtgactggaggtatatacttgtcctcacctggatcatgctgatgtggccccaaccccacctccctacccatccccacctccctacccatccccacctccctacccatccccacctccctacccatccccacctccctacccatcctatgatgtccaaagaaaccagacagagcaaattggccgaggccaaggaacaggtaaacgcaccaacaccccaacccaacccgaggccccctctgacagccgaactgctgccagagtctgtgccactcctgagggacaccaggctgggccccccaccccagtgcctctgggctccccacaccaaaatcttgtcagccagcccaaccccctcataagtcctgcccctgctctgcccggcacaccagggtgactttgagcaggtgactcctggggcttccaactccatactccgcccttacctcctgctaccccaaacccgacctccctgggctccttgagctcacatctccaaggacctgggtgccccagaacctgccctcaccagttgccacagggtgactttggggatgtgactcctggagctccttgctccttaattggccctcacctcctgccgccccaagcctgacctcccggggctctttggggtcacgtctccaaggacctggctcccaattttgtgaccccctccccagtctcaaagcggcaacttgggcattgcactcatgtgtcccccccaaccactccaccgaggagtagaatgtagtgatgtcacagtcccgctacaaactgtcattactaccacaagaccggcctttggtcttaggacccagtcccctaagtgttcttgcccacttctgtttcctctggttgcagcacaggtttccagctggaaggggaatggggactgtgggacctagaagagagaggtttcaggctgcctgacttccttaccacagaccttgacagtgtgaaaagcctacacctcccccatgagctcaacacgttgacagtgtctctgggtggcaatgggagaacgggtttggtttggttttctcccaggcttctactctccagagagattttaacattttttctcagttctgcacctcagatttgaattctccattgttctgggaccagagtgcccctcagtcactggttctggagtgagatctgcttatcttctgtggaacagatcttgggaaactgaacttagcttgagtcttcctcatctcatctcaacctggggtactttgagtgccacaggataaatatggggcatctttctgaagcatcagtttcccttgattctattgagaggcaaaacattaatgtacttagggatgaaagtcacgtagatttataagcgtatacaagacttctctctgaaatgaggcttgggttgtcctctttctgttaaattcccagatttagcagaaaggctgccttctgccatgaggagacattgatgtaaaggtttgagaggtactggtgtactttttaacactaacagacgtgtgagggtgaataaccctaaaccacatagtgcacagttcctgcctacttaatatttgcttttctacctctgcctctggttttggtccctggcagctgctgatttagggcaaaatcccagagctcagagtcagaagactgagtttaagttccattactgccttttttttcagccatggtatcaatctctctcagtcactaagtgattgtgacaacatttcctacagttggtggcattaaatcagatggtctataagagtatttagtataaactgtaaagcaggatgtgactgtaggagcttgtagttctcatgagtatcactgctcttcctttccacagttgacagaccatcatccccagaccaaccctagtgttggtacagcagcaagcgacaccaaaaagaagaaaataaataatggcactaaccctgagacaaccacttctggtggttgccactcgcctgaggatgtgagtcttggctggccgggctcctggggacagagggcccaaggggtggtggagggtaattgttaagattgtggaagaactgccaggtactggctaagaattctgggtttgaatcctacccctccatctgctagggacatgatttagcgcaaattgcttgagctctttgggcctctcttttcacatccgtaaaatacgagtggtattgttttccttacgtttgtgaagtttaaatgagatttgtcattgtgtttttatgttaatccctcgtccaggacctgctgtaaactctccttcttgggcttgcgtttcctgaggtagagttagagagtatcagaggtttctgttagctctgagagcccgagagttaaaggcccactagaatggaaacctcggggccaagggctcctgtctgccttttctgacctctattcccgctgtgaagaaccgtccctggcccgtatgtgctcaacgtttgctgagtgaatgcacctttctaaatcacaagctggcggaagggtgggcttttctcgcactccacctctgaaggtttctgttactgtcttttcaagagaatctagtttcagactttgagttctgtggctgtgggcaaaaaccaaaaagacccaaatccttcttctttgggagttgaggagagttgaccagttcatgttcccattgggtctgagaactgtgccttttaaatccattcctggcccctgcctatcgcttcctggcctggggaatagagtcaagggggccaccctcagtcaccttcctttgactctccccacagaaacaatagaaccgagctcagctggaagaagtagtgtgatttctttgctcacgacatgaccgctgggtttgggggcactcagatgtagaggccccaggctcatctcacccactcccagcctggggaagaaggctcacccccaagattccaccccatccccacagggtccctgataaactggtcccatgggtgggcctgttctggggcagtggtgccattctgggggcatgtctcttgctgtggatctctgcctccccctagtaagagctctgttttcctctttctataggaacagaaggcaagccaccaacatcaggaagccctaaggagggagctagaggtgagtggagggtgtgaagttccctcctgccctctggagaatgtttctttgcttctctttcagcatttgcttgtcttttctcccaaaggcccaggttcataccatacgaatccttacatgtcagaaaactgagcttcagatggcactctactacagccagcatgctgtcaagcagttggaaggtgggaatctggcaccccatcatccttcaacctggcactttgacaggcctttagggggagtcctttgggccacatctgaatgtctctcattccaggagaggccagggatctgatcagccgcctgcatgattcatggaagtttgcaggagagttagagcaggctctctctgctgtcgctacacagaagaagaaggcggatagggtgagtccaaacacggccccgtcccttgggagcccagcttcgcagatggaggagtgagcctaaaggtcccttctgtaggatggagtgtcctgcccagaaggcagcatggccatttcttgctgcttttgtgtgtggttgttagaggcagactggggctgagtcggctgttgtgggtgagttggggagcactgtgaggagcgagcactggacatagagctcagaggccaagtgcccgccctgcccatacttggctgtggccttggccaagtcctaagtggcggttagggtacttgtaccataaaggtacagaagagtatcttgagtatgttattatttgtgtggagagagggggcaggtgtatatgtgtgtgtgtgtacgtattatggtaacatacataaaacacgtttgtaaggattcattaaaaaactcaggatagaggcacagtgttggggggagatatttcccttctggactttctgagttttggactatgcgaacgtatcatcctttcaaaaattcaacaaaggattaatttcctccttcttaactgtgcccctacctccagcggaagaatgggcttagagaatcagatatagctgggtgttgaaatcccagctccaagtgatcttaggcagcacttaacctttaataccgcatgtttttcatctacacaatagaggtaataatggtaaccatctcctatggaggttgtgaggattaaatgggattgttagcatagtgcctggtgaagcactcaataaaggttcgaacagtggtagtactaacagtaatagcaataacaatattatctgatcgctctgggcccctgttagccagccctaaattcaatctctttccctgtcccttccacatccactgagttctttgaaaaacaaatgagggccaggtgctctcgctcacgcctgtaatgccagcactttgggaggctgaggtgggcggatcacctgcggtcaggagttcaagactagactgaccaacacgaagaaaccccgtctctactaaaaatacaaaattagcccggtgtggtggcacatgcctgtaatcccaactactcgggaagctgaggcaggagaattgcttgaacccaggaggtgtaggttgtggtgagctgagattgtgccattgcactccagtgagggcaacaagaatgaaactctgccaaaaaaaaaaaaaaaagaaagaaagaaagaaagaaaaacaaatgagaccatgggcttggaaatgccttgagaacacgtcaggtgtgattgagagtgaggaagtgttactgtggagtagtcactgtagcagttgttcctggtcgtccagctactgctgtgcctgctctatcctgacttaacctttctctatttgcagtacattgaggagttaacaaaggagagggacgccctgagtctggaactgtacaggaacacgtaggatgggggaaggtggaatgggaggtctgggggcccttagcatgggtggtgtgctgggaggtggggggtccaggtgagtgtggggagaggctcatacatgttttcatgtgtgcacacggaagctctagtgctggctgtgccactgactcatggggtagcctcaggcaactcatgtcttctctctggcctgccacctgggacttttaattcctggggtcccttccagcgccacggttctgtggttgtggggcgagggtagggggtcaatcaccaaagtggtcttttatgttcttcattcattcctttctctactgcctctggccatagcataactgatgaggagctgaaggagaaaaatgccaaactacaagaaaaacttcaacttgtagaatctgaaaagtctgagatccagctcaacgtaaaggagctaaaaaggaaactggagagggccaagctcctgctgccacaggtgagcagctgcagccccgggggttgtgggagacccatccagctgggaccatggtctagggatcatgcagggtatggggaggctccagccaagagctggaaaatttgggtccttgttctggtcccgccatagaatcctctagagtgtactaaaaatgtacaaattggggccctgcctggggaatcagaatctcaagagttagggcttaaaaatatttttttaaaggatcatggatgaaaaccattattttatagattacatttatttatttatttatttatttatttatttatttgagaagtagtctcactctgtcacccaggccagagtgcagtggcgcaatctcggctcactgcaagctccaccccccggcttcacgccattctcctgcctcagcctcccaagtagctgggactacaggtgcccaccaccacacccggctaattttttgtatttttagtagagacggggtttcactgtgttaaccaggatggtctcgatctcctgacctcgtgatccgcccacctcggcctcccaaagtgctgggattacaggcgtgagccacggctcccagcctatagattacatttatgtggctagctcatgattctgcttccttctgaggttcaaaaaaaaacactttcactattccagcagcagctgcaggcggaggctgaccacctgggtaaggagctgcagagtgtgtcagcaaagctccaagcccaggtggaagagaacgagttgtggaaccgcctgaaccagcaacaggaggagaagatgtggaggcaggaggagaagatacaggagtgggaggagaagatacaggagcaggaggagaagatacgggagcaggaggagaagatacgggagcaggaggagaagatgcggaggcaggaggagatgatgtgggagaaggaggagaagatgcggaggcaggaggagatgatgtgggagaaggaggagaagatgcggaggcaggaggagatgatgtgggagaaggaggagaagatgcggaggcaggaggagatgatgtgggagaaggaggagaagatacgggagctggaagagaagatgcacgagcaggagaagatacgggagcaggaagagaagaggcaggaggaggagaagatacgcgagcaggagaagaggcaggagcaggaggcgaagatgtggaggcaggaggagaagatacgggagcaggaagagaagatacgggagcaggaggaaaagatgtggaggcaggaggagaagattcacgagcaggagaagatacgggaggaggagaagaggcaggagcaggaggagatgtggaggcaggaggagaagataagggagcaggaggagatatggaggcaaaaggagaagatacacgagcaggaggagaagatacggaagcaggaggagaagatgtggaggcaggaggagaagatgcacgaccaggaggagaagatacgggagcaggaggagaaggtgtggaggcaggaggagaagatacgggagcaggaggagaagatacgggagcaggaggagaagatacgagagcaggaggagatgacgcaggaacaggaagagaagatgggggagcaggaggagaagatgtgtgagcaggaagagaagatgcaagaacaggaggagaagatgcggaggcaggaggagaagatacgggagcaggagaagaagatacgggagcaggaggagaagatacgagagcaggaggagatgatgcaggaacaggaagagaagatgtgggagcaggaggagaagatgtgtgagcaggaagagaagatgcaagaacaggaggagaagatgcggaggcaggaggagaagatgtgggagcaggaagtgaggctgcggcagcaggaggagaagatgcaggaacaccaggtgaggctgcaggagctggaggagaggctggggaagctggggcagaaggccgagctcttggggggagcaggcggaggtgtgtgcaaaccctggagatcatacagaatgacctcaccacaacttagcagatggtggttggctccctctgcttttccaccagtctgtggcctacagtttaaatggtgggaagaagggtgtgagatttgaggctggggagggaggcatgggcctctaggcaagggaggcagtcatttaggcctggaggaaggggccagggccaggggcctgggtaggcgacagagccccgcagtgccctcactaccctgtttatgggcccagaatctggaagccagccactacctaccctgacgcctatcctgcaggtggagctgaagagccaagaggctgagtctgcagcagcagcgagaccattacctgggtcacctgcagcagtacgtggccgcctatcagcagctggcctctgagaaggaggcactgcccagctgcagcagcaggaagctcagggcgaagcggtggccgagatggcccaccaatagttgcaggagacccggttgagggagttgatgagggcggggccccaagggggatgatctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccactctttacaaaaaaaacaaaaattaggcgggcgatggtggtacccacctgtggtcccagctattgagagggttgaggtgggagcatcatgtgagttggggaagttgaggcccacagtgagctaagatggggcccctgcactccaccttgggcaacagagcgagaccctgtctgaaaataaaaaaaaataaaaaacggggttgagagacaaaaaaggacatccttttttttattattatattttgagatggagtttcgctcgttgcccaggctggagtgcaatcgtgtgatcttggctcactgcaacctccgcctcccaggttcaagtgattgtcgtgcctcaggctcctgagttgtaaaacgacgaccagtagacctgcagatctgatatcatcgccactgtggtggaattcagacggggtttcaccatgttggtctggtctcgaactcctgacgtcaggtgatccacctgcgttgccctcccaaaatgctgggactacagacatgagccaccgtgccagccgaaaccttcattttaaaaaaggctgggtcaggcatcatgcctcatgcctgtaatcccagcactttgagagggcaacgcaggcggatcacctgacgtcaggagttcgagaccagaccaacatggtgaaaccccgtctctaccaaaaatataaaaattaggcgggtgtggtggcacacacctgtaatcccagctactcaggaggctgaggcaggagaattgcttgaatctgggaggtggaggttgcagtgagctgagattgtgctaccacactgcagccagggtgacagagtgagacgccatctcaaaaaataaataaaggctgggtgccagatgtggtgcataggcctagtttgttgactcctgtacttaacatataaaactctaaagaacagtgggaaggagcttccctctagaggcacaggagcggccaagttggtccctgagcagtgactttataataacatgttacactgtgttttttgtttttgtttggttttttgtttgtttgagacggagtttcgctcttgttgcccaggctggagtacaatggcgtgatctcagctcaaaacaacctctacctcccagattcaagctattctcctgcctcagcctccaaagtagctgggatttcagtcatgcaacaccatgcccggctaattttgtacttttagtagggatggggtttctccatgttggtcaggctggtctcgaactcctgacctcaagtgatctgcccgcctcggcctcccaaaatgctgggattacaggcgtgagccaccacacccggcctatattttttttctttttttttagacacagtctgactctattgcccaggctggagtgcagtagcacgatcttggttcactgtaacttctgcctccctggttcaagcgattctcctgcctcagcctcccaagtagctgggattacaggcatgcaccaccacatccgactaatttttgtatttttagtagagatggggtttcaccatgttggccaggctggtctcaaactcctcacctcaagtaatccgcccgcctcggcctcccaaagtgctgggattacaaggcgtgacccaccgggcctggccctgtgtgttgttttatgtatgtttctatatgtgttatatttcacaataaactaaatattaaaacaaagaataactgatagctatgcacaaaggtatttaaatttcaccctcacaaataatttttttttttttgagacaggatctctgttacccaggctggagtgcagtggcaccaccttggttcactgcagacttgacctcccaggcccaagcgatccttctacctcagcctcctgagtagctgggactacaggcacactccaccacacccacctaatttttgtatttttggtaaagatggggtttcaccatgttggccaggctggtctcgaacttctgggatcaaggaatcctccaaccttggctttccaaagtgctggtattacaggcgtgagccactgtacccggccaagaatagtttcttctccttacctaggtagagacctctgcagaaatgctgggagatctttggagaggggagattttttaaataaaaaatttaatacttggaggggcgtggtggcttacccctgtaatcccagcactttgggaggccaaggcggacagatcaggaagtcaggagattgagaccaccctggctaacacggtgaaaccccatctctactaaaaaaaatacaaaaaattagctgggcatcgtggcgggcgcctgtagtcccagctactcgggaggctgagtcaggagactggcgtgaacctgggaggcggagcttgcagtgagccgacatcgggccactgcactccagcctgggcgacacagcaagacttcgtctcaaaaaaaaaaaaaaaaattaatactttgggatgccaaggcaggtggatcacgaggtcaggagttcaagaactgcctggccaagatggtgaaaccccgtctctactaaaaatacaaaaatttgccgggcttggtggcaggtgcctgtaatcccagctattcaggaggctgaggcaggagaattgcttgaacctgggtggcagaggttgcagtgagccaagatagcaccactgcactccagcctgggcaataagagtcagactctgtctaaaaaaaaaaaaaaattgatctagttcaaaacctcactttgaatccacccacattgctctaaaatactttcatctttcctgtggctaaaaccttaaagccttgccagtaactcccattgcacttaaggaaatccaatctcccttgttgtggcccctgaacaggctgctgctggcccaccacggtgcctctagtttgtgtaaaatgcatatgttaatttacaataaatcatatgaggcttttttagctctaaaaggctattattcactagttgctgtgtgaatcagtatttctgggtgcagttagaaattattagagttgatgcccaagactcatctccatcagcacgggggaggcatctgctcgttttatggtcagtgactctgggcctcctgctgggcttagtcctgaggtgggtctgactcaggtcagggctgtgcaccccggccctcctcctcaacgtgcatgagtgctctttaggatggagctgaacactggcttctcaaaaccacttggccccatcacaggccctgagaactgattgggtcactctggtgggctccccagccctagccaagaagggtttctctagggagcctggccccccacttatgagatctggagccccaaagatcctgaccaggggcctgcctcctccagggaggggccactcgcccccaccaagctcccttcacagagacccatccaacagagctgaggaaaaccatgcctcataaatgaataaatacataaataaggatgccggggacctgtggattttgtaattcctgaaagaaggcagagtggctggctcacagcaagcgcagtaggagatactgctccccggccaggctgttctctgtctctttggagggagccctagggtacaagaaaagccagaggagaccagctggcccagaaggtgcctctccaccccttccccagagtttctgggaaacaaagcccacccgagggacacatgccttcttgggagttgtaccaggcctccttcctcatccggccatgcagtggttttcagtgcccgaaacagatgaataaaataggccctttactggatgttcttcaggaacatgcgcacttctttggatcttaccatcgttttatctctatttaaagttaaatgctgtgttatacagagtattggtaaagatgtagagctacaagaactgtcaagctggcagtagcataaaattgtataagcacattggaaacctgtttggcagcttccactaaagctatatctatgcctaccttcagaaattccatcctaagcatgtacacaagagaaacgagtgcatatgtccacaaaaagacttatataagaatgttcactgccatttttattcataagagccccaaatgaaaacaacctaaatgtccatcaacaggagagtgaataaatggtgatacagtcacatcatggaatactacacagccaaaaaagaaaaatgaagtggtaggaacactcaacgacatgggtgaatagagggagccaggtatgagagacagtgcacagtaccagcccacctagatgaagcgcaggaaggcagaactgacgatgattgaagtcagaagagtagtttcctttgtgggaaagtgtaggtcaggaaggagccttctggggtactacaaatctgccgtattttggctgggtgcaacagctcacaccagcacttcgggaggcataggcaagagggtcacttgagcccaggagttagagaccagcttgggcaacacagcgagatcccatctctacaaaaaaattaaaaattagcgtggcatgctggtgtgcacctgtagtctcagctactcaggaggctgaggcaggaggattgcttgagcttaagagtttgaggttgcagtgagctcccaaagtgctgggattacaggtgtgagacactataccagcctgatttttaaatactgaccaagccttgtgttactgggataggcatcacttggccacaatttactactctctttcttttttttttttttttttgagacagaatctcactctgtcacccaggctggagtgcattggtgcaatctcagctctctgcaacctctgcctcctgggttcaagcaattctcctgcctcagcttcctgagtagctgggattagaggtgtgcaccaccacacctggctaattttgtttgtttgttgtttgtttttagtagagatggggtttcaccatgttggccagcctggtctccaactcctgacctcaagtgatccaccctccttggcatcccaatattcctatgattacaggcgtgagccactgcgcccggccctattctgtttctatattgctaaatttgacttgctaacacgtttttgaggatttttctgttgatgctcatcagggatgttggtttgcagttttctttctttgtattacactatctcgtctggctttctgtcaggggaaagctgaccttatacaaagtattggcatgtgttccctccttttccattttctctaagggattgtgtagaattagtgttatttcttctttaaatgtttttgaatccatctgaacctggagatttctttctaaaagattttacgccgggcgcggtggctcgtgcctataatcccagcatgttgggaggccgaggcaggtggatcacctgaggtcaggagtttgagaccagcctggctaacatggtgaaaccccgtttctactaaaaatacaaaaaattagtcaagcttggtggcgtgcgcctgtaatcccagctactcaggaggctaaggcaggagaatcacttgaacctgggaggcagagattgcagagagctgagattgcaccaatgcactccagcctgggtgacagagtgagactccggctcaaaaaaaaaaaaaaaaatttttacaaattcaatttatttaacagatacagaactattcaggtaacctgtttgtttctaggaggattttcctggtttgtggcactcggacattgctttatttcatctaagttgtctgatttttaagtgtcaagttttccttagtgttctcttgctaaccgtctgaagtctgtggggcctgcagtgatgtcccttcattcattcctgatactgataatttgtatcttttctgtttttttgtcagttttcctagagtttttcaattttgttgatcttttcaaagaatgatctttaagtttcattaatttttcccttctttttttgctttcaatctcattagtttctgcttttatcttggcatttgttcctttggcttgttttgcgttcactttgctctttttctggtttcttaaggtggaaacttagattgctgatttagacctatcttttttgtaatatataatgatttgatgctataaattttcctctaagcagtgctttaattaaacccacaaattttggtgcattttcatttatgttcaaaatattttctcatttctttggagaattgttctttgacccatggatgatgatgatgatgatgattattattattattattatttttcttcaatacggagtttcactgttgttgcccaggctggagtgcaatgacatgatctcggctcactgcaacctctgtctcctgggttcaagcgattctcctgcctcagcctcctgattagctgggactacgggcacccgccaccatgcccggctaattgttttgtattttcagtagagatggggtttctccatgttggccaggctgatcttcaactcctggcctcaggtgatccccccaacttggcctcccacagtgttgggattacacgcgtgagccagtgcgcccggcctgacccatggattattaagtatgtggttttattttgaagtgtttgcagattgttttgttaatgatttctagtttaataccattgtgattggagaacaaactgcatatgatttcatttcttttaaatttgttaagatttatgtgtcaggttatgttctcagtgaacattctgtatgtgcttaaaaagtatatgtatggtctgtatatgtatggtctgtatatacatatatgtatacatatatgtgtaaaaagtatatgtatggtctgtatgtgcttaaaaagtatatgtatggtccagcactttgggaggccgaggcaggcagatcacaaggtcaggagatcgagaccatcctggctaacagggtgaaactccgtctctactaaaaatacaaaaaaaattacccgggcatgatggcgggcgcctgtagtcccagctacttgggaggctgaggcaggagactggcttgagcctgggaagcagagcttgcagtgaactgagatcatgcgactgcactccagcctgggcgacagagctagactccatctcaaaaaaataaaatttaaaaaaagtatatgtaaagtatatgtatggccgggcacggtggctcacgcctgtaatcccagcactttgggaggccaaggcaggtggatcacgaggtcaggagatcaagaccatcctggctgacatggtgaaaccccatctctactaaaaataaaaattaaaaaaataataataattagccaggcgtggtggtgagcacctgtagtcccagctactcaggaggctgaggtaggagaatggcgtgaacccaggaggcagagcttgcagtgggctgagatcgtgccactgcactctagcctgggcgacagagcgagactctgtctcaaaaaaaaaaaagtatatgtattttgctgttgttgggtgaagtgttccataaattagatccagtttattgaaggtgttctacagttctcctagatttttgccgattacttgttctctcactatgaaagatattgtgtgtgttatatgtgtctaacaattcattgtctagttagagttgctattataccacttcaagtggatggagagcctccctgccatccattaatgtgcattaatcattttgagagtgaaaagattttttaaaatgtttttactcttttaggtatggccaagtgagatggggctagtgaaatgggtgggagaattggaagctgatagtgtgtgagctagacacccatgaatgcttttccactgggcagttagagggatgataggtaataatataaggcagctccatcacacaagctggtgactcctgtgcgacagaccaagagctgcatttggagattcatttccgattgttgcgtttcctcttagagcattgcttggtcatcgtgttctgagtggtccattggcctccatgtcccttttggggtggatatttgctcagtgacttttgagcagctggatctcctgcttcggcaggtgagtgaggggatggatggctccgcggactggcccccgccccaggagaaagagtgcgtggccgtggcaacgctgaatcttccccgacttcaggtattcgtgatttcccttcctcttgctccttttataagtgtcttagcgatttgtaagaaggtttatgtattttgaaggacataggttttagcctgttgggggaagtattttaaagtaagattgtaatgcactaataatggacgcaaggcttaaaaaacttgatctgtttattttatgtttgtcctggaagtcagcctcggcatgcaggaagagtgtatatggattgtgttatttttgctataatcattagtttgttggtattcttactgttttactgttgttgcgtgtggagaaatgactgggtgagatcacaggtgatggagagagacagcgctcagctgagagaccagtgctggcctgtctctcctctgtcctgtgaaaaccctgctccaggagggtccagtcttttggtttccctgggccacactggaagaagaattgtcttgggctacacataaaatacacttatgatagctgatgagcttaaaaaaagaatcccaaaaatatctcatgatgttttaagaaattttactttgggccacattcaaagctgccctgggccacatgctgccctcgggccgtgggttgaacaagcttgatctactcagtaagctcggctcccaaagcaataccttcctttcctcaccatgaaggctgtggttagggtcaaaataaaagctacaaaagccttcctccctagcaaaactaaagctgaagtgtttgatcatcatcttttgtctttgtaataaaaccctctaacttaatgacaagaaccacggttttctcgacatagtaatttttcccttttattacagtggtttcttgtaacaacccgtcatgtccctcttccagcccctcccctttttgccctgcttctagaatgtacagaactgagtgtagtgtttagttgcagtaatgaactgagcagaggtctggagcatgcttctcctctagtcctctgtagcactcatttatcaccatatctgtggcatcctggcgtttgcgtggttgcgccccaggtgtttgctgcccctcctggtttgcggtgatgtgtctgttctggtcagtgctgtggggcgtggccttgcgtatgtcttaggctgtcgaggtgtcccagcgtatggttttgcatttgcctctccggggtcctgaaggttctgtaggtttcacagactccaggtgagtttcggtggtcatttcctgacctgtgatatctatacctagatgagtggtgtgcttttgatttcacttctactcacagggcaaggccgggtctctgatttctcatggggcctcttgctacccagagcctgggacgggcagtgtgttgccccctggctgcggttggctggcaggcaggtgatcctgagtggctcccagccttctgcaggaagctcgggttcagtgggtccttgtgtgcattcccgtgtgggaggttgtgctgaagcctggcggcttggctctgctttcagagcccggaacctcttgactcctgctgtgtgtgcccacgtgaattttggttttgcacttgaggagtttccctgtgtactctcagctccgcagtctaatttttagcagctctttttttttttttagacagggtgtcactttgtcacccaggctggaatgcagtggtacagtcttggcctgccaggttcaagtgattctcctgcctcagcctcccaagtagctgggactacaggtgtgtaccatcacacccggctgatttttttatagagatggggtttcatcatgttggccaggctgatcttgaactcctgatctcaagtgagctttcccgtcggcctcccaaagtgctgggatgacaggcatgagccaccgcctgtggcagcttttgtggttacattgtagccattatttctgtgtttggtgcagattgttggggcggggtggaggttgctgttgctagttgtttagctcttctgctcatcttgagcttttccatatatgtgttcatagtggggttaaaaaaaattcctctagaaaatacttcaactattgtgggtaagagtttttttagtccagtttttaaaaatacgtaaactgagaagttattttgtctatttagataatacttcaaattgacttttattcagtgtttaataagactttgaaattcactcatttttaggggttctaagtgaaaattgtttttctcctttcagttgcatgctgccattagtcaccaggttgacctggaattccttggtttaggtctgggcagcgtcttcctgaacagcctgaagcagaaggtggtgaccctggcaagcagcgcagacgtgctgagcaccgtgcagtcggcctcccaggccatgctgcagagcggctggtccatgctgttgcccaccgctgagaagcaggcccgggcactctgctctcctgtcctgcggaggtgggctcggggaaggaacaggagagggcatgggtcagggtgctgggaggggatggcgtttcactcaaattggcacacactttctatttcagtttcaggcaatgaagtgagcataagtccaggtcatcgattggtgattgatcttctggtgggcagcttgatggctgatggagggttggagtcagccttacacgcagccattactgcagagatccaggtatggccttggaggcacacgtgacctggtggtgggctgagatcggaaataccacactcacacatgtgaagaataactgaaaacagtaaaacactaaacttatatccaagtatttttttaaattaaaattcttttatgtgctaattttaaaaattattgagatgatttgtgataaaatactgcatgttgtctgtttcagtgaagttaacaggtaacctgttcctcatgtagaccattcccgtcacccggaaagatcgctgtgctccttggcacttgcagccaggatactcccctgccctgagattagattcatttttcctgctctgagtgtcgcagcaatataactgtatagtatgcactctttcctgctttgccttggagaatgattttcagattcgctcactgttgtgtgtattgcgacttcgtttttattattgggaagttttccattttataggtgtagtactgtttgttagttcattctcctattgaaggacatgtaattgtttttggtttttgttttctttttttttttttttttgagacagggtcttgctctgtcacccaggctgtatacagtgacctgatgttggctcactgcagccttgtactcctaggctcaaatgatcctcccacctcagcctcctgtgttgcagggaccacatacatgtcaccatgcccggctagttttttgatttttttgtagagacaaggtttcactgtgttgcaaggctggtcttcaactcctgggctccagtgatccccccaccttggcctcccaaagtgttgggattacaagcgtgagccaccgcgcccaggctttctggtttttggccgtgtagagctgccacaattgtgctgtgaacaagtactttagtgaacatatgttctccctttggataaacacttggagtggaatttgttaggtcctggggttagtgtgtgttcatagtttcccaaagtggctttgccatttgcatttgaaccaggacttgtgtgtgagaattctagctccttcttgtccttacagagcagctggatgctgcgtgtgtggagccgatcacattgggttttgtgtgagccattagcagggttaaggattttagggacttcacagaaggaggctggagagcatcagcagaggcagcctagaccttggatctgtaaaaagaagacactgtttgaaactgcacaaatgagttggggtttccaacagggcaggtgggggcctgtgggtggatgggtgtggcagccacagaggctgggatagcttggcactggggtcagggctcagccagcctgtgtgccttcacacctggtaatgagatcacttgtaaacaatttctgtttatcaattacaggatacaaaaaaagaagcacggaaggaaaaagaaatttatgaacaggaagcaaatgcctcaacatttcatagaaggaggactccattggataaaggccttattaatacggggatctgtgagtcttctggcaaacagtgtttgcctctggttcagctcatacaacagcttcttaggtaaatcatattagctgtattgtattgtgttttatttatttacttttttgttttttgagacagagtttcgctcttgttgcccaggccggagtgcagtggtgcgatcttgactcactgcaacctccgcctcccaggttcaagtaattcctctgcctcagcctctcgagcagctgggattacaggcatgcgccaccatgccccactaattttgtagttttgttagagacagggtttcttcatgttggtcaggccggtcttgaactcccgacctcaggtggtccatccactttggcctcccaaaatgttgggattacaggcattagccaccacgcctggcctatttatttacttattaatggtgttttttttttgttttttttttttttgagatggagtcttgctctatcgtccaggctggagtgcagtgtcacgatcttggctcactgcaacccccgcctcctgggttcaagctattctcctgcctcagcctcccgagtagctgggactacaggcgtctgcaaccacacctggctgatttttgtatttttagtagagatggggttttaccatattggtcaggctggtctcaaattcctgacgtcaggtgacccacctgccttggcctctcaaaatgttgggattacaggtgttagccactgtgcctggcctgtattgtattttaataggtgattattggttttcatattaagatagtgaaatctagcgcaaggatctcaaaaatttgtttgatgattgaaggaatattctgaaaattacctagtatagatgttaggataaagagcagacccttttcaatataggtgagaggagaagttggagggtgtgatgatactcaaaagtttttcactgaagagaaattggggcgtgcagtaaacatgtaaaaagattcttactaataagcaggtggatgcaaatgaaaatcatcatggaaggttatttttaaaactggttctatcattgcctcactttatatattacagagttatacatactactttgtaagataacttttcttttcaaaactgaagtcaatgtgatagaatggtgagcattattttggaaggccagactaggaggaggtgggaggaagaagtcagactcagcctgtgaacagacgctaaccttggcagaagccaaaacagtcagacagtgttgtctaaaaatgatcattcaagaagagcgaaacagcaaggtgatttgtgaaagagatttattagaaaatgaaacacatttatacctctgttcaataaaaatctgcttttcgtcaactgatgctcctggtttttgtttctacacatagagaaagcagagccctggcagcttgggtcaggcagccgagtacagaccagggagccctgggcagtggctgcagctctcagctggcctgttcatggggccatggtgggtctgtggcgtggggtgggcctgtggcgtggggtgggcccgcggcgtggggtgggcctgcggcatggggtgggcccgcggcatggggtgggcctgctgtccacagccagaaaaactaacttagtgcacacacagtgaaattttgaaacaggaagttttagagctagtttctgtcatagattttagtaaatgctattttgcaaaacctttttctgatgtttgttttgtttttctaatctgataatgcatatttcacacattctggtctttaacaaatggaaataaagagaactaaacaatatagtttgtgtcgatggaaagagcttgggatttgttctcagaaaatttcagttacaacagtttgttcatataggtggacttccaacacagtaactatgggagtaagaataaaagctgtgtttactttcacagagttaattaagaatacatgagaaaatggatgttaaaaaccttgtaattaaaatgtacagttacatgcaaagttttaaagtgagcattttccagaggtgcttttctaagttcttgaatgcctctcccttttctgaagtggctgcttcgtggggctgttggtctttggcagggggtgagtgcagggttcctgttgtgggtcctttgttctcacgagggcagtgcccgttttccccgtctcctgcttgcccagactgttcccgtgcgcagagagactggcctgtttgacctgcagctgtgctgtttgagctgcagctgtgtagcctgcgctggcccatctggctacactcaacaccgtttgctgatcagcacttgaagtctgtccgtcatagctgagacactgaatattttatctgtttaatttttattcattaaaatgcaggtttgaaaatttgattctgttattagaaagcacttaagtatgtttagaatcacttggccttgggagtctactttgtcaactgtgtattttatgagtctaaatggagatcagatgttttcaatgcaaatttcacggtccaaattgaaatgtgttacatatgtaagctactcagatggtttttgaggacttaatatgaaataacctatgtaaaatatctcaataatttttcttagattgatttcatgttgaaatggtcatatttttgatctgttggaataactatgatacattattaaaattatttttattttttaagatggaatcttactctgttgaccagactggagtgcagtggtgcaatcttggctcactgcaacctccgcctcttgtgttcaagtgattctcctgcctcagcctcctgagcagctgggactacaggactacagactcccgagcagctggcactaccaccacgcctggctgatttttgtatttttgtagagacagagtttcaccatgttggccaggctggtctcggactcctgacctcaagtaatctgcccgctttggcttcccagagtgctgggattacaggcatgagccactgcaaccagccattattacaattaattttatgtgttgttgtttttcttcttggtgtttttttttttttttttttttacttttgttaatgtgactaagaacaattttttttccccacccggagatggatcctcactctgttgcctggactggagtgcagtagcacgatctcagctcactgcagcctctgcctcctgggttcaaatgattctcctgcctcaacctcctgagtggctgggactaacagaagcatgccaccatacctggctgatttttgtatttttagtagagatggggtttcaccatgttggccaggatggtcttgaactcccaacctcaggtaatctgcccacctcagcctcccaaagtgttgggattacaggcgtgagccaccgcacctggccatgtttattaatacgactaagaacattttgaattgcacctgtggctccattggtgtcctgggcaggtggctctgtgctgtccacacaggttgtctcctgtgtcttcgtcttcgctgcgtgtgactttttggttcctgtggcacgtggggtcctgtatgggacattggttctacagcagatttatagtaaggatgtacctactaaaaaatacaaaataaaaagaatagacacaaacatagaaataagtatcacctcacaaaacttttggaaagtagaaaaagaaaaatgcattcgcagctttccagtagccgatatccaggctgtcttcatcagcatggatcatgtgtccctctcctgcatgggtagacactgttttctcaccttaagtgtttgtgagtgaaggattcttgatgtgttgacttggcagatgcagttgttgaacagtagtttatctaaagatcgtaagagacttttggagacatttcatgtccttttttcccttggaaaacgtgggttggagaaatcgctgcttgccaaaaataagccgtgaaatgtatttcagagtagatcgttatttacatgctggcgaggagccacagaataccatttacatttgaaaatagagcgctgcgaagtttttataagtagtgaatcccatcagaattacacattttgattatggctctaaattttatattaaataaactaaaaatttcattgtattgtattaccgtctcttgctccttcaggtgtagcatacatgctagattctagacctgtttcttgtgttacagtggtgttatccaggcagggtatcatgtagtgaaggtgatgtcgagtggtggtggtgagcccagtgaaggcgcatccttgccgtgtgtgatgagggcctgtgggttgctatgggattccccaaccctggctcctctgtctcctgcttctgtccttactcacactgctggtagttttctggtgtgagacacgggggcaagtgggattgacaagcctgctgtcacattaggaacctgagttaaagtggagctgaaagcatgtcctcgctcttgatgttgtgcagagagccacctgtgctcctggctcaacggggcgggtgtggtgggtctggaaccaggccctggtttggctctcctcccctccatgttcccctgtcctgtctgatttgcttcacactgacataagagttactttccctcggcctcccaaagtgctggtattacaggcattagccaccgcgcccagctagcatcctttcaagtactggggtacacccaagctcccagcttctagctaggagtcattttgtccctctttatcccaaaggacttgccaccatctttggttcccaaagcccaggagggtccaggctcttcagcctccaaccactttgcatttcttgtctgcttttcgttcatggagataattaacttatttttcagcctgggcatgtcttttttatttactttattttttatttttattttttgagatggagtctcactctgtcgcccaggctggaatgcagtggcgggatctcatttcactgcagcctctgcctcccgggttcaagtgattctcctgcctcagcctcctgagtagctgggactacaggtgtgcaccactatgcccagctaatttttacatttttagtagagacagggtgtcgccatattggccaggctggtctcgaactcctggcttcaagtgatcctcctgcctcagcctcccagagtgctgggattacaggcacgaccaccgcacccagcctttatttactttgtatatctcatctattactgctgcagtttgcagaagagaggatgccctcaaacctaacttctccaaaccatcccaaatgggaagtctgctccacgtcaacagcattgttgcttttaaagactatacgtcaacatgccagattatagcaaaaggatgtcgagggagcaataggaaagcaagcctgagagtcctggagagaaggtggcagagctgccttttgaaggtggttccttcctcagaccctgcccttcctgccttgttcctccagttgccagatttgctgttggagctcctccacgggcgaagaggtgaggctggactgagagggagatggagaagctgccagagattcttttggatctagaattgagacagcagttccagccaggtccagaggtgggggctgtcacccagcccccaggggaatggtactgattgcagaatgtggcgagaactccctggctgggagagggaggtgcttgctcccttgaatcacctgagcccaggctggaaggcccaagggggaggacgaggccagctcactccagctccatcccctccctttaaccctaagctagttaaccctcccagactccagtcctttttcctaagtgccctccctgcaaagtctgcaccgagcagcgctccctcgcaccagctcaccctgcactgtcttgtctttcagcaaccccatgggtttgaacttgagacgattcatgttcctaaaagcctctttgggctgagggaaggcatgggtggctctgccagttttggagtgggggccgactcttctcagagccgctgcaagggccagggccaccctcccaggcgggtgtctctgggctgggcagcagctttgtaggcagcctgggtcatccccactggcctgggaagctgggggtgcaccggctcctgctcctgatagggccaaggcaccttccttacctaagagctgactttcttgaagagtgggcacagaggagccggcaacctgggctgtgtaggcacccaggagaaaatctgcagctcagtatcagaagtctccaccagcacggctgttgcagagatggggaaactgggctgagagggaagggggcttgcccaaatcaccagccctggaatgttttgagctttgggggtggatctcccaggaaacgtgtttttatggcaccaccgcctctggtcacccaccccgaggtgtggcgggcctggacagccagcttgactgagggccaggctggtgaagtcaaaactaccactcaggaagaagacctagcccttctccagacagagttcaaatgtgaggactgccttctttgggcctcaaattccccacgtgaattccaaggacccctctagctcctacactctgggccaaggtttcctctgagccgcagtcagcctagaggacctaggatacatcttccttggacagagacccaccataggggcagcaggaggtaggggtgggggtaggcaagattcctgtggggaggtggagctgtcatcagagatggtgtctgcaggcagtgggtgtatcgtggctctgctactacttgctgggtggccccatgacgtttctttccccactctgacctcagtttccctatctgttccgtggagataagatgcctgcctacatatttgtggactgggatgtgtgtgggccagttgcagtgtttcttggtgtggtcctggggcaggctgcaccaccccatagagatttctgggccccaccctaggctcacaggaccagaatctctgggaatgaagcctgggaatttgcatttccacaggcatctggctgattctgacatgactgaaaagcactaatagtatatagcaagctctttataaaaggtaaattcatagctgccttttactaaacataaatctcaccttcccttcctcagttaaggacacacaccgcagttgaaaatcactgtgcctttccagatgcagaatctgacctttccgataagattctgttaactgctgctttctgcagtttgtattccaaaacaaggggaatatgtttccattttttcaatacaaatgtttaagtcggatatgctttctcaaactggacacgcactcacacagcttagggtttcagctatggcttcctctcaaattattagcctctttctgccagggagcagtttttcccagacaagaccctggacagaggttggtggggccctcctcatcagaatcactagattatgactgacccctagaggtggcttttctgcttaagtgtcagcccatgggctgggttgtgacccccaaagctgcggcagaagcttccacccatcctgggccccccctgccatctatggggaaaggcctgtcccttgtcttctgggcccagccggcctcacaggcattcagcagattggaaagtcgaagcatgtgctgtgcttggctgggctctcctgcgcccctttttggggtgaggtggagtgcatccagcccccagcatccctgccgtttattcccacccctcatccccacccccatacacactcacaagtacaaacacaagcacagtcactggcacacaccactctggacagcaccatttccagcctcagcggggcagtttccttacagggaagttaatgaggcactaacgaaggctcaggggacagggggaacctctatcgagaagaggctcctagacctggttctgcctctgaattgctgggggtccttgagaaagttgctatccctctctggtctcagtttcctcaggtgagaaatggggggccggccaaatggtctaaggttctgggaacctctaaatcagagcccgtagctggtggtcaagatgagggagaggccctcagggtcagccgaatgcctgagaggccggacaggcccaaaggtgagcaacgtgagcacatcaggtgggctcagagctggcgcatgagccccacagcctgcagagcagccctgtactcgggagcccgctcgcaccaacccagtgggacttcagagatgtggggtccagcctttcctactattgctgggctgagggctgggagctgcagattctgaccccacagctgccttagacatgccagatggtctggggcaagacacacccctctctatgaaatgagcagccagtccaaataggtacattagagaagggctgtgggatggacccagctgtagcctggggctacagactggcttccggggtactcaagcagctggcctctggggtagcagccccaggtatgagaggcaggactcagaatctaggccaagcctccataggaatcccctctggagagcccgggcactctgcaggaggggcagcaggcagcaggtgcaccaggagcatgtttcacaaggtgcccaatatcgcatctgctcagataggcagcgagttggaaagtggatgcaataggcagggtggcggctgctccccacagccaggagtccggcccagcacccacctgagtccgcctcagtcctgctcaattgggttatccgtgctcttggccctctggtcccacccacagagggaggtctttggggcgaccaggtgagctggcccttgtgggaggatgtaactgactcctgagcctggcgagccaggcagcccctcgccaacgtccccacccctacctctccagcccccccgcattccctgatcctcccatccgctcccctgacccagcagttgcctctgctcactctcttttcctgctcccaggctcgcctggtcatgtgtccttcactctcctctgagtctccctctttccaagccgcctccactctacttgacacagtctcccttaagacaccagagtacacaagcgcaagtccctgcacctcacctttactcccagacatgggagggagatgacatgaagacccaaacgccacttagcaggagatctggggtatgcagaggggcagaacggaggctgtggaagctccaggggctcccttcaggaggccacatgtaagctggctattgaatgtggctctgagctgagacctctccttgaagctccagaccaggagccagctgatagctggacccctccatttggtgcctcagagaaactttgcactctctaggtctaactttgaacccagaaaattcccccatgtcggccctgtctcttcacagggaaagcaccacctcagacccagttctgcaccaaacccacatttgagtcacgaggctcctgccctgcactgtgagcactctggataagccagtgctgagggggaaagagctctgaatgccaagccaaaacatgagcttcaactccacctccagctctgagagctgtgggtagggaagggccctagtccagtttgctgtagaaagaccagtctgccactgtatggcacatggatggcaggggcagagtgcaggtggagagaacagaaggtgggcagggcgggggaggcagggacatggctgtagccgtggagatgggaggacagacaggacttggtggccacttgggtgaaccaagggaggagtcaggaagagacacccagttttgtatcagatgtgtagagcgtgggatgctgttcattgacggagggaggaggaggaggaagaggtatggcatggggaggaggtagctgagctctgtcgtgaatgtcatttgaagtccccagggaaagccaggccggccagcaccttcactgcttcagccagctctcagggtgtctgtgctccctggccctctcagctcctgcttcatagctgtcagctgcagtgggagacagctgcacaagggcccagcatgtctgtgtgtttacccaggggactgccgcatggcccatgccgagcagaaactgatggacgaccttctgaacaaaacctgttacaacaacctgatccgcccagccaccagctcctcacagctcatctccatccagacggcgctctccctggcccagtgcatcagcgtggtaggtgcagagggtacctgtggctcaggctcaggtgaagaggcagctcatgcccaagccctaagcagtcaatgtccagaggaatgaaatgactagagttgacttagactcaccggtacacggtggggaggctggaggagggtccatgaggtttataggtgtccagtatttaatgaggtcatggttttgttaacaaagaagaaatgagggtgggagcgagatcaccactggctaggcagccaatgggcctgcagagactctgctcagctgagtctccagcacgaccatgagcttctcatcctgatcctcccatccccaccctacttttctcccccagcttgctcaacaggtgaccttacaggctccctactctttgcagggaataagaaccagactgggggaactgacgggtacagaggcccaggtgtaggcgcaggaccacaggcagtgaagcgtctactgacccaggcgggtgagggtctggagagtgggcatggctgctgcaggcatggaaagcaggcacagatggcggcactcccagggcccattgtcagggtctccacatgtggacgtgtgcagaggtgggggtgctgagggaggaggggcagggaatttctcatcttctctctactgcctctgagttggagatgtcagagggagccatggcccactgtaaagtaacacaatgtccccacccacaggattagaacccctcccctggaagcagctctgaggggaacagtcacatgtagagagtgcagggcactgtgtccagccgggggaaggaggtcaccaagggggttgacccccctctggccaggtggctgccttctgacacaccagcctctgtctctagcacggtggcccccacacacccagcctgtgaaacctacagccctcaagaaggctttggccaaattaaggagcggctccctctcccaggaggaagcacaggtgaaggatgtggagggcagtagagttgtgtgtgctccgccccctttctccacagtcggatggaaagaagggggctttcagccaggctcgcccaggctggggtctgagtgtcactgtccagctattggcttcttgcttaatgggtgagcccagctgctcccgtgcagctgccgccctagtgagggtgaaccggcaggcgagttacatttctgaaagcctgggaatacagtaaatattaggctgtgggctgctgggccaggaagagttgtttatttttcagggtttgtttatctattgacttgatgagggagggttataggtacaaccagtttaaagatggaaattttgagagagcaggcagggatttagtgctgggtaagcctggtcaaagcggctcttttggggcggccagaatccagtaccaatgtcctcagcatgttcatcagctgctgggggagtgcgggacagcatgaaagcacaggagaactttctggatgatagaaatactctgtatcttcaaaggaggtgggttccatagtaatgttaaatgagttaaaactcatcaaaatgtaaaccagacctgtgcatttcactaatagaaattatacctccaattaaaaacatgttttaaaagacagatgggccggatgcagtggctcatacttgtaatcccagcactttgggaggctgaggcaggtagatcacctgagtcaggagctcgagaccagcctggaaaacatggtgacatcctgcctctattaaaggtataaaaaaaaattagccaggcatggtggcacacgctactcgggaagctgaggcaggagaattgcttgaacccaggaggcagaggttacagtgagcagagatcgtgccattgcactagagcctgggcaacagcgcaagactccatctcaacaacaacaaaaaaaggacagatgaaggttttcaactttcagtaaaggcagaggagcttgttacagattcgcctccccacaagagcagttagaaaaactggataaaaatgtgccccgcccccaatcaaaaacaattgttggaaggtaattggagacctcagtcaggacttgagtgaccaggcctaggaggtgatcctgacagtctgtagtgctttcccacatttggtgattggtcaacagtagagggctaagaggctaagaaactgagtatgaagtggtagttaagaggctggagagcctagctgaatgtttggcactctcacagggctgaaatgacctaatgagaatttgggtcccaggaaggagatgggaccttggtggggaccctggaagggccacccctgggagtccaaatgaataaaacatagaccagccatcagaaaacctaaaacctgctttgaaccagcttagtcccaaagtagatgaaggcgatctgcccttactccaattgtgtgccataaactcaaagtcaatactctctggaggcagataaaagtttactatgaatgtcaaaagacaacacaagactaaatgagaaagaccaagaagaaaactaatagaaacatacatgtaaggaagaaacttttttttttgagacggagtttcgctctgtcacccaggcttgagtgcagtggcacgatctcagctcactgcaacctctgcctcccaggttcaagcgattctcctgcctcagcctcccaagtagctgggattacaggcatgcgccaccatgcccggctaatttttgtattggccaggctggtcttgaactcttgacctcaggtcatccatttacctcggcctcccaaattgctaggattacaggcgtgagctaccatgcctggccagtattttgccacaatttaaaataaataaaatttttttttcaggtttgtgctcagactatattctaaacagtcacatggcggcttactcttctccaggccttgctgccggcttttacatgtttattgtctttgccttcttgtcatgtgctcattagatggcagcttccaggtgctcctaaggggccaggaaagagagtgagaaggcacggaggttgccagatcatcccccttggggccccgccctcatcaactccctcaaccgggtctcctgcaactattggtgggccatctcggccaccgcttcgccctgagcttcctgctgctgcagctgggcagtgcctccttctcagaggccagctgctgataggcggccacgtactgctgcaggtgacccaggtaatggtctcgctgctgctgcagactcagcctcttggctcttcagctccacctgcaggataggcgtcagggtaggtagtggctggcttccagattctgggcccataaacagggtagtgagggcactgcggggctctgtcgcctacccaggcccctggccctggccccttcctccaggcctaaatgactgcctcccttgcctagaggcccatgcctccctccccagcctcaaatctcacacccttcttcccaccatttaaactgtaggccacagactggtggaaaagcagagggagccaaccaccatctgctaagttgtggtgaggtcattctgtatgatctccagggtttgcacacacctccgcctgctccccccaagagctcggccttctgccccagcttccccagcctctcctccagctcctgcagcctcacctggtgttcctgcatcttctcctcctgctgccgcagcctcacttcctgctcccacatcttctcctcctgcctccgcatcttctcctcctgttcttgcatcttctcttcctgctcacacatcttctcctcctgctcccacatcttctcttcctgttcctgcatcatctcctcctgctctcgtatcttctcctcctgctcccatatcttctcctcctgctctcgtatcttctccttctgctcccgtatcttctcctcctgctcccttatcttctcctcctgcctccgcatcttctcctgttcttgcatcttctcttcctgctcccccatcttctcttcctgttcctgcatcatctcctcctgctctcgtatcttctcctcctgctcccgtatcttctcctcctgctcccgtatcttctcctcctgctcccttatcttctcctcctgcctccacatcttctcctcctgctcccgtatcttctcctcctggtcgtgcatcttctcctcctgcctccacaccttctcctcctgcttccgtatcttctcctgctcgtgcatcttctccttttgcctccatatctcctcctgctcccttatcttctcctcctgcctccacatctcctcctgctcctgcctcttctcctcctcccgtatcttctcctgctcgtgaatcttctcctcctgcctccacatctttttctcctgctcccgtatcttctcttcctgctcccgtatcttctcctcctgcctccacatcttcgcctcctgctcctgcctcttctcctgctcgcgtatcttctcctcctcctgcctcttctcttcctgctcccgtatcttctcctgctcgtgcatcttctcttccagctcccgtatcttctcctccttctcccacatcatctcctccagcctccgcatcttctcctccttctcccacatcatctcctcctgcctccgcatcttctcctccttctcccacatcatctcctcctgcctccgcatcttctcctcctgctcccgtatcttctcctcctgctcccgtatcttctcctcctgctcctgtatcttctcctcccactcctgtatcttctcctcctgcctccacatcttctcctcctgttgctggttcaggcggttccacaactcgttctcttccacctgggcttggagctttgctgacacactctgcagctccttacccaggtggtcagcctccgcctgcagctgctgctggaatagtgaaagtgtttttttgaacctcagaaggaagcagaatcatgagctagccacataaatgtaatctataggctgggagcggtggctcacgcctgtaatcccagcactttgggaggccgaggtgggcggatcacgaggtcaggagatcgagaccatcctggttaacacagtgaaaccccgtctctactaaaaatacaaaaaaattagccgggtgtggtggtgggcacctgtagtcccagctacttgggaggctgaggcaggagaatggcgtgaagccggggggtggagcttgcagtgagccgagattgcgccactgcactctggcctgggtgacagagtgagactacttctcaaataaataaataaataaataaataaataaataaatgtaatctataaaataatggttttcatccatgatcctttaaaaaaatatttttaagccctaactcttgagattctgattccccaggcagggccccaatttgtacatttttagtacactctagaggattctatggcgggaccagaacaaggacccaaattttccagctcttggctggagcctccccataccctgcatgatccctagaccatggtcccagctggatgggtctcccacaacccccggggctgcagctgctcacctgtggcagcaggagcttggccctctccagtttcctttttagctcctttacgttgagctggatctcagacttttcagattctacaagttgaagtttttcttgtagtttggcatttttctccttcagctcctcatcagttatgctatggccagaggcagtagagaaaggaatgaatgaagaacataaaagaccactttggtgattgaccccctaccctcgccccacaaccacagaaccgtggcgctggaagggaccccaggaattaaaagtcccaggtggcaggccagagagaagacatgagttgcctgaggctaccccatgagtcagtggcacagccagcactagagcttccgtgtgcacacatgaaaacatgtatgagccactccccacactcacctggaccccccacctcccagcacaccacccatgctaagggcccccagacctcccattccaccttcccccatcctacgtgttcctgtacagttccagactcagggcgtccctctcctttgttaactcctcaatgtactgcaaatagagaaaggttaagtcaggatagagcaggcacagcagtagctggacgaccaggaacaactgctacagtgactactccacagtaacacttcctcactctcaatcacacctgacgtgttctcaaggcatttccaagcccatggtctcatttgtttttctttctttctttctttctttttttttttttttttggcagagtttcattcttgttgccctcactggagtgcaatggcacaatctcagctcaccacaacctacacctcctgggttcaagcaattctcctgcctcagcttcccgagtagttgggattacaggcatgtgccaccacaccgggctaattttgtatttttagtagagacggggtttcttcgtgttggtcagtctagtcttgaactcctgaccgcaggtgatccgcccacctcagcctcccaaagtgctggcattacaggcgtgagcgagagcacctggccctcatttgtttttcaaagaactcagtggatgtggaagggacagggaaagagattgaatttagagctggctaacaggggcccagagcgatcagataatattgttattgttattactgttagtactaccattgttcgaacctttcttgagtgcttcaccaggcactatgctaacaatcccatttaatcctcacaacctccataggagacggttaccattattacctctattgtgtagatgaaaaacatgcggtattaaaggttaagtgctgcctaagatcacttggagctgggatttcaacacccaggtatatctgattctctaagcccattcttccgctggaggtaggggcacagttaagaaggaggaaattaatcctttgttgaatttttgaaaggatgatacgttcgcatagtccaaaactcagaaagtccagaagggaaatatctccccccaacactgtgcctctatcctgagttttttaatgaatccttacaaacgtgttttatgtatgttaccataatacgtacacacacacacatatacacctgccccctctctccacacaaataataacatactcaagatactcttctgtacctttatggtacaagtaccctaaccgccacttaggacttggccaaggccacagccaagtatgggcagggcgggcacttggcctctgagctctatgtccagtgctcgctcctcacagtgctccccaactcacccacaacagccgactcagccccagtctgcctctaacaaccacacacaaaagcagcaagaaatggccatgctgccttctgggcaggacactccatcctacagaagggacctttaggctcactcctccatctgcgaagctgggctcccaagggacggggccgtgtttggactcaccctatccgccttcttcttctgtgtagcgacagcagagagagcctgctctaactctcctgcaaacttccatgaatcatgcaggcggctgatcagatccctggcctctcctggaatgagagacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaattccagccacttaggaggctgaggcatgagaatggcttgaacctgggaggtggaggttgcagtgagctgagatactgctactgtactccaacctgggcaacagagtgagactctgtctcaaaaaaaaaaaaaaaaaaaaaaaaaggaattgtcatcaaagtcctacggctaaacccttttcctttttttttaataactagtattactagtcttttccaagaaccaaagttaaaagttagttctttaaaacaccaggccaggcacagtggctcatacatgtaatcacagcactttgggaggccaaggcaggaggatcacttgaatgcaggtgttctagaccagcccggacaacaaagaaagaccctgcctctacaaaaaaaaatttttttgctgcaaaatgctctcaattaacctgacaaaatgtcacatacagggttactacatcttttttatcatggaattttgaaaacaaaaattgttctattgaggcaccagtatttggatattagaggtaaaaaccacccttagaatccagtcctaaaaacgtcaatgaagactcccatgtttacaaattcttttatttctacatgtcatctatcaactggattatgaacctgaaagcctgagaacagaatttatcaagatactcatgtttatactttttttatctactgatcgtttttattttttttgagacggattctcgctctctcaccaggctgtagtgcagtggcgcgatctcggctcactacaacctccgcctcctgggttcaagcgattctcctgcctcagcctcctgagtagctgggactacaggcacgtgccaccacacccagctaatttttgtatttttagtagagatggggtttcaccatgttggccaggatgacctcgatctcctgacctcagcctcccaaactgctaggattacaggctgagccaccacacccagccatgtagccatctactgatatttctaagcatgaagtgacaatttttttttttgagatggagtcttgctgtgttggccaggctggagtgcaatggcatgatctcggctcactgcaacctccacctcctgggttcaagcacttctcctgcctcaacctcccaagtagctgggattacaagcgcacactaccacgcctgactcttttgtatttttagtagagacagggtttcaccatgggcgccaggctggttttgaactcctgacctcaagtgatccgccctcctcggcctcccaaagtgctgtgattacaggcgtgagccaccgcgcccagccgaagtgacaatatttatatacaataagcttaactctaagagcttacatttatgcgtagtcattcttaattgatgattagaggaagagacaaataaatggtcccagtttagctactgatatactcaacaaaccttgacggacctgagggcattatgctgagtaaagaaaatcatttccgaaggtcacatatcacttggtaatctcacagtaacaaaattatagagatggagaacagattagtggttgtcaggagttagagatggtggcagaagagaggcaggagagacatctttgtagtgatgaaacagttctgcataggaaattgtagtagtagttacatttacagacccttgatagaatggcacagaactacgcacacacattgtaccaacttcaatttctgggtttttatactctattataattacataaaatgtaaccactggggcagtatgcgcaaatacacagtgacctctctagtttctttacaacttcctgagagtctattattatttcaaaataaaaagttttttaaaaaattgcttcatgcctatctaatttcatgtgccacttaaaaaagaacacaaaaatagaaactgtaggaaattcatctgagtgcagcttatgcaagaaggggcaggataactccattctggacttatgctcaaagacatgcgcctttaccttacaacaaaactggcgaacaggcatgtgttttaagaataaaaagcttttaaggtatcatatattgttttttatagttcctttgcttaactgacgttttggtttgctaaaaaactaccaatcacatcagattacaagtactttcactgtaaaaataaaaagtgatgtgactgacacctcttagctctgtaacgtattactctttacgagagcagtgaaggaaaacatggtgattcaatcactccacacaccaagcagaaaagtgttgaacaggccgggcgcggtggctcacgcctataatcccagcacttccggaggccgagacgggtggatcacttgaggtcaggagttcaaaaccaacctggcccacatggtggagccctgtctctactaaaagtacacaaaattagccaggcgtggtggtggacacccgtagtcccagctactcgggaggctgaggcaggagaatggcatgaacccaggaggcttgcagtgagccaagatggcaccactgcactccagcctgggagacagagtcagactccatctcaaaaaaaaaaaagtattgtacaattaaactgtttatatgtaataaccacatatatatgcctggcataaaatgagccctgcattagaggttgctggatgtagggccctaggcctgacgtatccaaataatgtctatgataaagaagtcaataagtgctctctataacacacaagcattataagttttcacactccaaaaactcttcctttctaaagttactaaaacttttaagggcatttcaaacaaaaacagctgtggaaaacagatcggttaaatcctatggctaagaaacatcttcctatcccatgtattattcattacccaggtgtcaattctgtttccaatacaaaagtctcaagcagtgaagcgcttcccactccagctgggagagccatcctcaacaagataagggtaaaacctgtgagcacaaggcttccatctgcaattcctgtctgcagggaagctccccaaagagggaaaccatgtcttattccttacggtaaaacaccaccattcattccttgtgtttaacaaccaatgctggtggaacataaaacaaagcttagcaatcacttttttcatgctacttagacctgtaacacatttttcctctggtgcacactatccaaaacctagtcatttcccttactcctaggaggaatttagatgactttttttttggccaggtgcagtggctcacgcctgtaatcccagcaatttgggaggccgaggcaggcagatcgctttgaggtcaggagaccagccaggccaacacagtgaaaccccatctctactaaaaatacaaaaattagtcgggcatgcatggtggcacacacttgtaatcccagctactcggaaggctgaggcgggagaatcacttgcattcgggaggcggaagttgcagtgagccaagattgcgccactgcacgccagcctgggcgacagagcaagactccgtctcaaaaaaaaaaaaaaaaaaaaaaagactttctaatcatattggaaatgtgtaacaaggaccaagtactgtgtattaaacttaataaatcaaaacaacaggccctctaagatataaatggtgcttcactgtatgtttatctgcccaacccatcataggaactcaattcagcattaaactggttttagatcaagacactagaactcatgtttagcagttattaaattacaattattaagaaaaacactttattacgtaaagtcctttactccaaaaagtttctcaaaatacataaacactaatataaaacaattattaaaactttgcctgaatctcaggatttcagaaatatgaaagtactcatctctcacctctcccatccacttaaaatgacaaaacagatcattatagctaaatcaaaggaaatgtttaaagagaaacaaacccaaagagtaactacaccaattcttgacccaattctctgtactctgtcttatgtaacattacactatgaataacaatcccatcatccacaacagcttttttttttttgaaacagttttgctctcattgtccaggctggagtgcaatggcatgatcttgacccattgcaacctccacctcccgggttcaagcgattctcctgcctcagcctcccgagtggctgggattacaggcatacaccaccacgcctggctaattttgtatttttagtagagacggggtttcaccatgttggtcaggctggtctccaactcctgacctcagggcatccacccgcctcggcctcccaaactgccgggattacaggcgtgagccactgcgcccggccacgcaacacagctctaaacactggactctcatatctaccaacactcaatacctgtttaaaaagaaaaaaaaaattaggaaggggcaataacacttcagtgtaagtatccatgatcaactactgcttaacagcctacacgacttttgatgaacagtcaaggcacattacttaatacttaaaatggttaaccttagggagtaggaaaatacagacacacacaaaatatttcaaacacttctttttgctgctgataaggagttccaaaagtagtttttccaagccatttccaaataaaagtagattgggtgtaaataattgtctatcgaaatattagttattatttatttaataatgtcctgacaagcttgcagttatctcattaaatcaaaaaattaggatctaaggccaacattgtttcctcacattcttgatgtgaaaatctgagcactcctcttaataaggagttacaaagacaaaacaaacagctcaactgaactaactcttgtctctccagaaacacaaacacaagacctcataaaatgagtgagtttctataggccataattactgcaacttacttctccaattttcccctccacagttaactcaacagctcaaaaacgatcagtaacaaacaacagtcaccatgatatggttaggagtgtggcagatttcttaaccagtaataataaataggaaaaaaattttgcctattaatagatctcaagtttcgtgcacttgcaagaaactaattaaaaggcagccgcgcacgatctacaaaaacagccataaagactgttacattttaagttacaggaaataaacctgctcctctaattcagcaagatacaactgacttccccttacataccctaaaaaaaagccttacacgagaaatttaaacatggaagcagaaacacaccaagaaaaagacatgtcaaaccccacctgtatatctgttttcaaccatttggagtcgaggcgagcctgggcagccaaacagaaagattcagagggcatcttttctccagcttcctcccaggtctcaggcctgcaagtaaacacatacgctgaagacctaacgctttttaatagtttacaaagacactcccgaaagccagaaaagaaaaaagagagagagaacagaaaggggggagagaagagctggtggaggggagagaaagggagagagggaaagagggaagagatggagggagagggaggtggggaagggaaagcctccttccaaggtaggcagggtgtgccgagtttctgcaccacgctgacgagaccttgagaatggacggtcacaggaagccaagtcacaatgtcatccccctgccctcaaatccaagaagtacacacacataacagggagcccatcgttttaacgacaaatgacagcagcatgaatctgccgctttaccccacagcagggcgcgtgcgtgaaacaaaaaattactcaaaaggatcgcctgcagaaaaacccacagccaccaccacttaagagatggagagaggcccgaggctgccccgcgggtggtccgcgcaggccccggtgcggccgccgcgcccacgcccgcctcccgggctcggccgcccgccagccccgcgcccgtaccgcccccgccaccggccgcccaggtgccccaggccaggacctgacgcgcagggcccggccgcctcgcctcgccggcgcgcggacgcagcctcccaagagccgctggctcagccggcgcccgcgatcccggcgcctctcgcggcccgaggggcgggccgacgcgggactgccgccccccgcgtacggccaatcgcaacgaggctgctccgtgggcgcagccaatggggaagaggagcccttcgccgctcctcccgactctcccgcttccagcaatcccgcttatcttcctacttggagcgccctggctgcggccaaggccaacagcgggcgccggaaggcgggatttccgccgcacgcacgcactcccgcactcccacgggagactgcttggcccggagcgctcttgatcacgccgcggcgggtggtggcgctcacactaactatagctatccagggcgcgggtcgagtggcgagaccagctcccctgggtatgagaacgcatctttgtgcggtcggctggctggggcctgaagagcttcctcctgtgtgttcaactgaacgcagcaaaagtcttgggcagattccatggagcagctgtggaagcactgtgcagggaatcgaagaaggaaacacctccagcgaccacaaaacaaaattgaagaactataaaacaatataggccgggcgtggtggctcacgtatgtaattctcagcgctttgggaggccgaagcgggaggatccctcgaagccaggagttggaggatcccatgttgccagactgggcaacatagcaagaccccatctctaaaaaataaaaataaaaaaatttaacaattagccaggtgtggtggcacacacctgtgatcccagctgctcgggaggctgagacaggagaatcgcctgagcctgggagatcaatgctacagtgagcttagatcgtgccactgcactccagcctgggcgacagagtgagatcctgcctctaagaaagaaaaataacggccgggcgtggtggctcaggcctgtaatcccagcactttgggaggccagagcaggtggatcatctgaggtcaggagttcaaaaccagcctggccaacatgatgagaccccttctctactgaaaatacaaagattagccaggtgtggtggcacgtgactgtaatcccagctactcgggaggccgaggcaggagaatcgcttgaacccgggaggcggaggttgcagtgagccgacattgcaccactgcactccagcctgggggacagaggctgcaccactgcagccttgacttaccgggttcaggtggttctccacctcagccttgccactagctgggactgcaggcacatggaaccacacctggctaatttttgtagtttttgtagacgggattttgccatgttgcccaggctggtctcgaactcctgggctcaagtgatccgcccgcctcagtctcccaaagtgctaggattacaggtgtgagtcactgcactcggctaatagtaatgaactttgaacagaaggaaagttgttattattttcttggttatgttctatctatattttctaatttttctaaacatgtaaagataaaattctaaaaactcagacctcagaacaaaaaaattagagtataaatatttattttagttaacttgtacaaatttggtttctggaaaaagaatggaatagattttctgagaaaaaaaatccaccactttggccgggcgcagtggtttacgcgtgtaatgcctgcactttgggaggctgaggcggtggatcacctgaggtgaggagttcaagaccagcctgaccgacatgaagaaacccctgtctctactaaaaatacaaaaattagtcaggcctggtggcacgcacctgtaatcccagctactcaggaggctgaggctggagaatcgcttgaacccaggaggcagaggttgcagtgagctgagatcgcaccatagcgctccagcctgggtgacaaaaggaaaactctgtctcaaaaagaaagaaagaaaagcagactggctgaaaggattgaagaacaaaatatgatccaccaatgtgctatctacaagataaacattttaaatacagaaacagattgaaagtaaagggatacaaagatacaattaaaatagtaaccaaaaaagagctgaaggggctgtactaatatcaaatgtaatacactttaaattaaagcagggctgggcatggtagctcaggcctgcaatcccagcactttgggaggtggaggcagagagacacttgagcccagaagttcgagatcagcctgagcaacatggcataatcccatctctacaaaaaatacaaaaattaggcgggcatggtggtacccacctgtggtcccagctatttgggaggctgaggtgggaggatcatgtgagctggggaagttgaggccgcagtgagctaagatcgggcccctgcactccaccctgggcaacagagcgagaccctgtctgaaaataaaaaaaaataaaaaacggggttgagagacaaaaaaggacatccttttttttattattgtattttgagatggagtttcgctcgttgcccaggctggagtgcaatcgtgtgatcttggctcactgcaacctccgcctcccgggttcaagtgattgtcgtgcctcaggctcccgagtagctggcattacatgtgcctgccatcacgcccagctaatttttgtattttggtacagacggggtttcaccatgttggccagggtggtctccaactactgacctcaggtgatccacctgccttggcctcccaaaatgctgggactacagacgtgagccaccgcgccagccgaaaccttcattttaaaaaaggctgggtcaggcatcatgcctcatgcctgtaatcccagcactttgagagggcaacgcaggcggatcacctgacgtcaggagttggagaccacactggccaacatggtgaaaccccgtctgtaccaaaatacaaaaattagctgggcgtgatggcaggcacatgtaatgccagctactcgggagcctgaggcacgacaatcacttgaacccgggaggcggaggttgcagtgagccaagatcacacgattgcactccagcctgggcaacgagcgaaactccatctcaaaatacaataataaaaaaaaggatgtccttttttgtctctcaaccccgttttttatttttttttattttcagacagaattccaccacagtggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggtgaggaacattgaagtttctgagatattccttaaggaccaagctataattcacagctatctatttacatcagatctcagctttttttttttttttttttttttttttttgaggagggtgcaggaggagatgtgcgcagaacatatatatacggcttgccctaaaggatgaaataaaattgtgtatgctatgacctctctaggaagcctctaaacttttcttataaattgtcttctaactaaaatatttcttttggccgtccttggagtactcccaggtgacacacagctcgggctaacatttctacaggactgctaccttgatctctagagagtccaatgatgttccataccaatatgtctcagcgtcactgccgagcttccacccacacccttaacacacagagaaagctgacactttctgttagctataattttccttgagaaaaacgtggcaatatgtagcaaaatacaattattagtttcaatatgtagaacgtattacaagaaaaaaaagatgccaaaaacatcttatgtctactgctattcctattagtctttattatcatgaaaaactggtcgcatcctaaatatccaactttcggtgactgggtgaaggaaaactgtaatttttccatatgatagaatagtatgccagcactaacaaccagatagcagactatttaatgtcatggtaaagtatttgttttgtgtggtcaggtgagcagttcagatcataaaatcaaatgtaccctatgatcttattttttgaagtaaagtactgatgtatttatatgtataattaagtatagagaaaagcctagatggcttctcttataagtcttttcattgttttataaatggtatcaatatttatttttcactttttccatcagatttcctagaataataaaattcaattccctctgatgagcattcattattcttttttttttttttttttttgagacggagtctcactctgtctgctagagctagagtgcagtggcctgatctcagctcactgcagcctccgcctcctgggtcattattcttacagtaagaaaaaatgaatgttactaagtatcttctctgtcctagatcaactaggtatatacaaggtgccaaatacatttaataaaatgttttattcattcatagctttttgcagtacaattttttttgtatgattcccttgtcctatcatctccaccaatagttttggtgtgaatttatactctaaaggaaaggtgacaaccttatacaatctcagggcttaaatactatccacgtgctgatgcttacaaacatacacctccagttgtgtggtctccctgagttctgcacatccctcttgggcatctaacaagcatctcacagttaacaaaaccactgatttctaatcaatcccagggaccctccgccaggcctgctcctctctcagaattccttttctcacttagtgacactatcatcccaccaaacctcgctatcatctttcttccgtctcccaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattcattagattttattcttgtaaaaaaagagataatttaaaggaatctatttttaaatactctgaggagggtgatactaggggtgctggttgtcctgttttaactttgtcttaatttctaatgtaattaaattttgagtaggtaatgtgacctgtgtggtttttattttaaaaaatatattgaggttttatataatctatttttaaaatattcaatggaaacttgaaaacatactgtttcacatattctcgtatatatatattaaaaatctttttttatttattttttatttttatttttttttgagacggagtctcgctctgtcgcccaggctggagtgcagtggcgccatctgggctcactgcaagctccgcctcctgggttcacgccattctcctgcctcagcctcccgagtagctgggactgcaggcacccaccaccacgcccagctaattttttgtatttttagtggagacagagtttcaccgtgttagccaggatggtctcgatttcctgacctcgtgatccgcccgcctcagcctcccaaagtgctgggattacaggcgtgagccacttagcccggcctaattatttgttttttaaaagacggtacataggaagaagtaaatcaggaaaagtggatagtgattggtggcagtagaagtgagtcagtgttacagttactattgctgcttaagaaactaacccaaatggcctgggcgccgtggctcacgcctgtaatcccagcagtttgggaggctgagacgggcggatcatgagttcaggagatcgagaccatcctgcctaatacggtgaaactctgtctctactaaaaatacaaaagttagcctggcctggtggtggtgggcgccttaagtcccagctactcgggaggctgaggcaggagaatggcgtgaacccgggaggcggagcttgctgtgagccgagatcgcgccactgcagtccagcttgggccacagagggagactccgtctcaaaaaaaaaaaatttaaaaaaagaaaaagaaaaaagaaactaccctaaatttaataaggtaaaacaacgaccacttcattatatctcatggatcctataggtgagaaattccagcaggattcatctgagtgattcttcctctctcacatcattaactagggtgactcagtgctagtcggctggcaaacaagtcagtctggaaggtgcaaggtgctttttttctgtcttataaattggtggagttgtctggaaggcaaggctcagatgggaaggactcttagttatagtgcctgcacagggtaaactttttttttttcttttttttttgagacggagtctcactgtcccccaggctggagtggtgtggcccgatctcggctaactgcaagctccgcctcccgggttcacgccattctcctgcctcagcctcccgagtagctgggactacaggcgcccaccaccaggcccggctatttttttgtatttttagtagagacggggtttcaccgtgttagccaggatggtctcgatctcctgacctcgtgatccacccgcctcggcctcccaaagtgctgggattacaggcgtgagccacagctcccggccaagaaggctctcttaaaaggaatcacttcttgttttcttacaagttataacctcactaccctagagtcacatttttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcacagtaaatgagtgaatttagaaattaaattttaatatgaaaggttcatgttgtcaaaactgactatgttagtccatctcaatgctataaaggaatacctgagactgggtaatttataaagaaaagaggagtatttgggctgatggtttgcaggctgtacaaacaggccaccagtatctgctcagcttctgctgaggcccgggaagctgacaatcatggcttaaggcaaagggggagctggcatattacatggggagagagggagcaagggagatgccaggctcttttaaacaacaagatctctcgtgaattcatagagcaagaactcactcattaccaggaggacagcacaaaaccattcatggggatccacccttgggaaacaaacacctattactaggcccacctccaacactggaggtcgcatttcaacatgagatttggaggggacaaaacatccaaaccgtatcactaacggaaaattattgtttaaatttctgtattcagtcccttggcctttttgagaaatgccattcatttcagccatcaagcaaattattatttgagacatttatacctcttcatcctttaaaagtttcagaagcatgaatttaaaaagtattcattgtaaatttgaggctagtcaaattgatgtggcatctaagtagcacggtgatgggatgaggagacaaagtcacgagggaaggtaggaagaagcagagagaaaaagagaaataggaagagagaaaaagaaatgaggagagagtataagaaaaataaagaagaaagaggaaaagaaaaatggtttaaatgagaggcaaatgtcatctgatgttttaccatggggccatagggtatttgaagattcagaaaattcgtaagttattaaaaaatgtgactctagggtagtgaggttataacttgtaagaaaacaagaagtgattccttttaagagagccttcttggccgggagctgtggctcacgcctgtaatcccagcactttgggaggccgaggcgggtggatcacgaggtcaggagatcgagaccatcctggctaacacggtgaaaccccgtctctactaaaaatacaaaaaaatagctgggcctggtggtgggcgcctgtagtcccagctactcgggaggctgaggcaggagaatggcgtgaacccgggaggcggagcttgcagttagccgagatcgggccacaccactccagcctgggggacagtgagactccgtctcaaaaaaaaaagaaaaaaaaaaagtttaccctgtgcaggcactataactaagagtccttcccatctgagccttgccttccagacaactccaccaatttataagacagaaaaaaagcaccttgcaccttccagactgacttgtttgccagccgactagcactgagtcaccctagttaatgatgtgagagaggaagaatcactcagatgaatcctgctggaatttctcacctataggatccatgagatataatgaagtggtcgttgttttaccttattaaatttagggtagtttcttttttctttttctttttttaaattttttttttttgagacggagtctccctctgtggcccaagctggactgcagtggcgcgatctcggctcacagcaagctcccgcctcccgggttcacgccattctcctgcctcagcctcccgagtagctgggactaaaggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttaaatacagaaacagattgaaagtaaagggatacaaagatacaattaaaatagtaaccaaaaaagagctgaaggggctgtactaatatcaaatgtaatacactttaaattaaagcagggctgggcatggtagctcaggcctgcaatcccagcactttgggaggtggaggcagagagacacttgagcccagaagttcgagatcagcctgagcaacatggcataatcccatctctacaaaaaatacaaaaattaggcgggcatggtggtacccacctgtggtcccagctatttgggaggctgaggtgggaggatcatgtgagctggggaagttgaggccgcagtgagctaagatcgggcccctgcactccaccctgggcaacagagcgagaccctgtctgaaaataaaaaaaaataaaaaacggggttgagagacaaaaaaggacatccttttttttattattgtattttgagatggagtttcgctcgttgcccaggctggagtgcaatcgtgtgatcttggctcactgcaacctccgcctcccgggttcaagtgattgtcgtgcctcaggctcccgagtagctggcattacatgtgcctgccatcacgcccagctaatttttgtattttggtacagacggggtttcaccatgttggccagggtggtctccaactactgacctcaggtgatccacctgccttggcctcccaaaatgctgggactacagacgtgagccaccgcgccagccgaaaccttcattttaaaaaaggctgggtcaggcatcatgcctcatgcctgtaatcccagcactttgagagggcaacgcaggcggatcacctgacgtcaggagttcgagaccagactgaccaacatggtgaaaccccgtctctaccaaaaatataaaaattagccgggtgtggtggcacacacctgtaatcccagctactcaggaggctgaggcaggagaattgcttgaatctgggaggtggagtttgcagtgagccgagattgtgctaccacactgcagccagggtgacagagtgagacgccatctcaaaaaataaataaaggctgggtgccagatgtggtgcataggcctagtttgttgactcctgtacttaacatataaaactctaaagaacagtgggaaggagcttccctctagaggcacaggaccggccaagttggtccctgagcagtgactttataataacatgttacactgtgttttttgtttttgttttgttttttgtttgtttgagacggagtttcgctcttgttgcccaggctggagtacaatggcgtgatctcagctcaaaacaacctctacctcccagattcaagcgattctcctgcctcagcctccaaagtagctgggatttcagtcatgcaacaccatgcccggctaattttgtacttttagtagggatggggtttctccatgttggtcaggctggtctcgaactcctgacctcaagggatctgcccgcctcggcctcccaaagtgctgggattacaggcgtgagccaccacacccagcctatattttttttctttttttttagacacagtctgactccgttgcccaggctggagtgcagtagcgcgatcttggttcactgtaacttctgcctcccaggttcaagcgattctcctgcctcagcctcccaagtagctgggattacaggcatgcaccaccacatccgactaatttttgtatttttagtagagatggggtttcaccatgttggccaggctggtctcaaactcctcacctcaagtaatccgcccgcctcggcctcccaaagtgctgggattacaaggcgtgacccaccgggcctggccctgtgtgttgttttatgtatgtttctatatgtgttatatttcacaataaactaaatattaaaacaaagaataactgatagctatgcacaaaggtatttaaatttcaccctcacaaataattttttttttttgagacaggatctcactctgttacccaggctggagtgcagtggcaccaccttggttcactgcagccttgacctcccaggcccaagcgatccttctacctcagcctcctgagtagctgggactacaggcacactccaccacacccacctaatttttgtatttttggtaaagatggggtttcaccatgttggccaggctggtctcgaacttctgggatcaaggaatcctccaaccttggctttccaaagtgctggtattacaggcgtgagccactgtacccggccaagaatagtttcttctccttacctaggtagagacctctgcagaaatgctgggagatctttggagaggggagattttttaaataaaaaatttaatacttggaggggcgtggtggcttacccctgtaatcccagcactttgggaggccaaggcggacagatcaggaagtcaggagattgagaccaccctggctaacacggtgaaaccccatctctactaaaaaaaatacaaaaaattagctgggcatcgtggcgggcgcctgtagtcccagctactcgggaggctgagtcaggagactggcgtgaacctgggaggcggagcttgcagtgagccgacatcgggccactgcactccagcctgggcgacacagcaagacttcgtctcaaaaaaaaaaaaaaaaattaatactttgggatgccaaggcaggtggatcacgaggtcaggagttcaagaactgcctggccaagatggtgaaaccccgtaaaaatacaaaaatttgccgggcttggtggcaggtgcctgtaatcccagctattcaggaggctgaggcaggagaattgcttgaacctgggtggcagaggttgcagtgagccaagatagcaccactgcactccagcctgggcaataagagtcagactctgtctaaaaaaaaaaaaaaaaaaaactgatctagttcaaaacctcactttgaatccacccacattgctctaaaatactttcatctttcctgtggctaaaaccttaaagccttgccagtaactcccattgcacttaaggaaatccaatctcccttgttgtggcccctgaacaggctgctgctggcccaccacggtgcctctagtttgtgtaaaatgcatatgttaatttataatatatgaggcttttttagctctaaaaggctattattcactagttgctgtgtgaatcagtatttctgggtgcagttagaaattattagagttgatgcccaagactcatctccatcagcacgggggaggcatctgctcgttttatggtcagtgactctgggcctcctgctgggctaagtcctgaggtgggtctgactcaggtcagagctgtgcaccccggccctcctcctcaacgtgcatgagtgctctttaggatggagctgaacactggcttctcaaaaccacttggccccatcacaggccctgagaactgattgggtcactctggtgggctccccagccctagccaagaagggtttctctagggagcctggccccccacttatgagacctggagccccaaagatcctgaccaggggcctgcctcctccagggagcggccactcgcccccaccaagctcccttcacagagacccatccaacagagctgaggaaaaccatgcctcataaatgaataaatacataaataagaatgccggggacctgtggattttgtaattcctgaaagaaggcagagtggctggctcacagcaagcgcagtaggagatactgctccccggccaggctgttctctgtctctttggagggagccctagggtacaagaaaagccagaggagaccagctggcccagaaggtgcctctccaccccttccccagagtttctgggaaacaaagcccacccgagggacacatgccttcttgggagttgtaccaggcctccttcctcatccagccatgcagtggttttcagtgcccgaaacagatgaataaaataggccctttacgggatgttcttcaggaacatgcacacttctttggatcttaccatcgttttatctctatttaaagttaaatgctgtgttatacagagtattggtaaagatgtagagctacaagaactgtcaagctggcagtagcataaaattgtataagcacattggaaacctgtttggcagcttctactaaagctatatctatgcctaccttcagaaattccatcctaagcatgtacacaagagaaacgagtgcatatgtccacaaaaagacttatataagaatgttcactgccatttttattcataagagccccaaatgaaaacaacctaaatgtccatcaacaggagagtgaataaatggtgatacagtcacatcatggaatactacacagccaaaaaagaaaaatgaagtggtaggaacactcaacgacatgggtgaatagagggagccaggtatgagagacagtgcacagtaccagcccacctagatgaagcgcaggaaggcagaactgacgatgattgaagtcagaagggtagtttcctttgtgggaaagtgtaggtcaggaaggagccttctggggtactacaaatctgccgtattttggctgggtgcaacagctcacaccagcacttcgggaggcataggcgagagggtcacttgagcccaggagttagagaccagcttgggcaacacagcgagatcccatctctacaaaaaaattaaaaattagcgtggcatgctggtgtgcacctgtagtctcagctactcaggaggctgaggcaggaggattgcttgagcttaagagtttgaggttgcagtgagctcccaaagtgctgggattacaggtgtgagacactataccagcctgatttttaaatactgaccaagccttgtgttactgggataggcatcacttggccacgatttactactctctttctttcttttttttttttttttgagacagaatctcactctgtcacccaggctggagtgcattggtgcaatctcagctctctgcaacctctgcctcctgggttcaagcaattctcctgcctcagcttcctgagtagctgggattagaggtgtgcaccaccacacctggctaattttgtttgtttgttgtttgtttttagtagagatggggtttcaccatgttggccagcctggtctccaactcctgacctcaagtgatccaccctccttggcatcccaatattcctatgattacaggcgtgagccactgcgcccggccctattctgtttctatattgctaaatttgacttgctaacacgtttttgaggatttttctgttgatgctcatcagggatgttggtttgcagttttctttctttgtattatactatctcgtctggctttctgtcaggggaaagctgaccttatacaaagtattggcatgtgttccctccttttccattttctctaagggattgtgtagaattagtgttatttcttctttaaatgtttttgaatccatctgaacctggagatttctttctaaaagattttacgccgggcacggtggctcgtgcctataatcccagcacgttgggaggctgaggcaggtggatcacctgaggtcaggagtttgagaccagcctggctaacatggtgaaaccccgtttctactaaaaatacaaaaaattagtcgagcttggtggcgtgcgcctgtaatcccagctactcaggaggctaaggcaggagaatcacttgaacctaggaggcagagattgcagagagctgagattgcaccaatgcactccagcctgggtgacagagtgagactccggctcaaaaaaaaaaaaaaattttttacaaattcaatttatttaacagatacagaactattcaggtaacctgtttgtttctaggaggattttcctggtttgtggcactcggacattgctttatttcatctaagttgtctgatttttaagtgtcaagttttccttagtgttctcttgctaaccgtctgaagtctgtggggcctgcagtgatgtcccttcattcattcctgatactgataatttgtatcttttctgtttttttctttgtcagttttcctagagtttttcaattttgttgatcttttcaaagaatgatctttaagtttcattaatttttcccttctttttttgctttcaatctcattagtttctgcttttatcttggcatttgttcctttggcttgttttgcgttcactttgctctttttctggtttcttaaggtggaaacttagattgctgatttagacctatcttttttgtaatatataatgatttgatgctataaattttcctctaagcagtgctttaattaaacccacaaattttggtgcattttcatttatgttcaaaatattttctaatttcttttgagaattgttctttgacccatggatgatgatgatgattattattattattatttttcttcaatacggagtttcactgttgttgcccaggctggagtgcaatgacatgatctcggctcactgcaacctctgtctcctgggttcaagcgattctcctgcctcagcctcctgattagctgggactacgggcacccgccaccatgcccggctaattgttttgtattttcagtagagatggggtttctccatgttggccaggctgatcttcaactcctggcctcaggtgatccccccaacttggcctcccacagtgttgggattacacgcgtgagccagtgcgcccggcctgacccatggattattaagtatgttgttttattttgaagtgtttgcagattgttttgttaatgatttctagtttaataccattgtgattggagaacaaactgcatatgatttcatttcttttaaatttgttaagatttatgtgtcaggttatgttctcagtgaacattctgtatgtgcttaaaaagtatatgtatggtctgtatatgtatggtctgtatatacatatatgtatacatatatgtgtaaaaagtatatgtatggtctgtatgtgcttaaaaagtatatgtatggtccagcactttgggaggccaaggcaggcagatcacaaggtcaggagatcgagaccatcctggctaacagggtgaaactccgtctctactaaaaatacaaaaaaaattacccgggcatgatggcgggcgcctgtagtcccagctacttgggaggctgaggcaggagactggcttgagcctgggaagcagagcttgcagtgaactgagatcgtgcgactgcactccagcctgggcgacagagctagactccatctcaaaaaaaataaaatttaaaaaaagtatatgtaaagtgtatgtatggccgggcacggtggctcacgcctgtaatcccagcactttgggaggccaaggcaggtggatcacgaggtcaggagatcaagaccatcctggctgacatggtgaaaccccatctccactaaaaataaaaattaaaaaaataataataattagccaggcgtggtggtgagcacctgtagtcccagctactcaggaggctgaggtaggagaatggcgtgaacccaggaggcagagcttgcagtgggctgagatcccgccactgcactctagcctgggcgacagagcgagactctgtctcaaaaaaaaaaaaaaaaagtatatgtattttgctgttgttgggtgaagtgttctataaattagatccagtttattgaaggtgttctacagttctcctagatttttgccgattacttgttctctcactatgaaaggtattgtgtgtgttatatgtgtctaacaattcattgtctagttagagttgctattataccacttcaagtggatggagagcctcactgccatccattaatgtgcattaatcattttgagagtgaaaagattttttaaaatgtttttacttttttaggtatggccaagtgagatggggctagtgaaatgggtgggagaattggaagctgatagtgtgtgagctagacacccatgaatgcttttccactgggcagttagagggatgataggtaataatataaggcagctccatcacacaagctggtgactcctgtgcgacagaccaagagctgcatttggagattcatttccgattgttgcgtttcctcttagagcattgcttggtcatcgtgttctgagtggtccattggcctccatgtcccttttggggtggatatttgctcagtgacttttgagcagctggatctcctgcttcggcaggtgagtgaggggatggatggctccgcggactggcccccgccccaggagaaagagtgcgtggccgtggcaacgttgaatcttccccgacttcaggtattcgtgatttcccttcctcttgctccttttataagtgtcttagcgatttgtaagaaggtttatgtattctgaaggacataggttttagcctgttgggggaagtattttaaagtaagattgtaatgcactaataatggacgcaaggcttaaaaaacttgatctgtttattttatgtttgtcctggaagtcagcctcggcatgcaggaagagtgtatatggattgtgttatttttgctataatcattagtttgttggtattcttactgttttactgttggtgcgtgtggagaaatgactgggtgagatcacaggtgatggagagagacagagctcagctgagagaccagtgctggcctgtctctcctctgtcctgtgaaaaccctgctccaggagggtccagtcttttggtttccctgggccacactggaagaagaattgtcttgggctacacataaaatacacttatgatagctgatgagcttaaaaaaaaaatcccaaaaatatctcatgatgttttaagaaattttactttgggccacattcaaagctgccctgggccacatgctgccctcgggccgtgggttgaacaagcttgatctactcagtaagctcggctcccaaagcaataccttcctttcctcaccatgaaggctgtggttagggtcacaataaaagctacaaaagccttcctccctagcaaaactaaagctgaagtgtttgatcatcatcttttgtctttgtaataaaaccctctaacttaatgacaagaaccacggttttctcgacatagtaatttttcccttttattacagtggtttcttgtaacaacccgtcatgtccctcttccagcccctcccctttttgccctgcttctagaatgtacagaactgagtgtagtgtttagttgcagtaatgaactgagcagaggtctggagcatgcttctcctctagtcctctgtagcactcatttatcaccatacctgtggcatcctggcgtttgcgtggttgcgccccaggtgtttgctgcccctcctggtttgcggtgatgtgtctgttctggtcagtgctgtggggcgtggccttgcgtatgtcttaggctgtcgaggtgtcccagcgtatggttttgcatttgcctctccggggtcctgagggttctgtaggtttcacagactccaggtgagtttcggtggtcatttcctgacctgtgatatctatacctagatgagtggtgtgcttttgatttcacttctactcacagggcaaggccgggtctctgatttctcatggggcctcttgctacccagagcctgggacgggcagtgtgttgccccctggctgcggttggctggcaggcaggtgatcctgagtggctcccagccttctgcaggaagctcgggttcagtgggtccttgtgtgcattcccgtgtgggaggttgtgctgaagcctggcggcttggctctgctttcagagcccggaacctcttgactcctgctgtgtgtgcccatgtgaattttggttttgcacttgaggagtttccctgtgtactctcagctccgcagtctaatttttagcagctcttttttttttttagacagggtgtcactttgtcacccaggctggaatgcagtggtacagtcttggcctgccaggttccagtgattctcctgcctcagcctcccaagtagctgggactacaggtgtgtaccatcacacccggctgatttttttatagagatggggtttcatcatgttggccaggctgatcttgaactcctgatctcaagtgagctttcccgtcggcctcccaaagtgctgggatgacaggcatgagccaccgcctgtggcagcttttgtggttacattgtagccattatttctgtgtttggtgcagattgttggggcggggtggaggttgctgttgctagttgtttagctcttctgctcatcttgagcttttccatatatatgttcatagcggggttaaaaaaaattcctctagaaaatatttcaactattgtgggtaagagtttttttagtccagtttttaaaaatacgtaaactgagaagttattttgtctatttaaataatacttcaaattgacttttattcagtgtttaataagactttgaaattcactcatttttaggggttctaagtgaaaattgtttttctcctttcagttgcatgctgccattagtcaccaggttgacctggaattccttggtttaggtctgggcagcgtcttcctgaacagcctgaagcagaaggtggtgaccctggcaagcagcgcagacgtgctgagcaccgtgcagtcggcctcccaggccatgctgcagagcggctggtccatgctgttgcccaccgctgagaagcaggcccgggcactctgctctcctgtcctgtggaggtgggctcggggaaggaacaggagagggcatgggtcagggtgctgggaggggatggcgtttcactcaaattggcacagactttctatttcagtttcaggcaatgaagtgaacataagtccaggtcatcgattggtgattgatcttctggtgggcagcttgatggctgatggagggttggagtcagccttacacgcagccattactgcagagatccaggtatggccttggaggcacacgtgacctggtggtgggctgagatcggaaataccacactcacacatgtgaagaataactgaaaacagtaaaacactaaacttatatccaagtatttttttaaattaaaattcttttatgtgctaattttaaaaattattgagatgatttgtgataaaatactgcatgttgtctgtttcagtgaagttaacaggtaacctgttcctcatgtagaccattcccgtcacccggaaagatccctgtgctccttggcacttgcagccaggatactcccctgccctgagattagattcatttttcctgctctgagtgtcgcagcaatataactgtatagtatgcactctttcctgctttgccttggagaatgattttcagattcactcactgttgtgtgtattgcgacttcgtttttattattgggaagttttccattttataggtgtagtactgtttgttagttcattctcctattgaaggacatgtaattgtttttggtttttgttttctttttttttttttttttttgagacagggtcttgctctgtcacccaggctgtatacagtgacctgaggttggctcactgcagccttgtcctcctaggctcaaatgatcctcccacctcagcctcctgtgttgcagggaccacatacatgtcaccatgcccggctagttttttgatttttttgtagagacaaggtttcactgtgttgcaaggctggtcttcaactcctgggctccagtgatccccccaccttggcctcccaaagtgttgggattacaagcgtgagccaccgcgcccaggctttctggtttttggccgtgtagagctgccacaattgtgctgtgaacaagtactttagtgaacatatgttctccctttggataaacacttggagtggaatttgttaggtcctggggtaagtgtgtgttcatagtttcccaaagtggctttgccatttgcatttgaaccaggacttttgtgtgtgagaattctagctccttcttgtccttacagagcagctggatgctgcgtgtgtggagccgatcacattgggttttgtgtgagccattagcagggttaaggattttagggacttcacagaaggaggctggagagcatcagcagaggcagcctggaccttggatctgtaaaaagaagacactgtttgaaactgcacaaatgagttggggtttccaacagggcaggtggggggcctgtgggtggatgggtgtggcagccacagaggctgggatagcttggcactggggtcagggctcagccagcctgtgtgccttcacacctggtaatgagatcacttgtaaacaatttctgtttgtcaattacaggatacaaaaaaagaagcacggaaggaaaaagaaatttatgaacaggaggcaaatgcctcaacatttcatagaaggaggactccattggataaagaccttattaatacggggatctgtgagtcttctggcaaacagtgtttgcctctggttcagctcatacaacagcttcttaggtaaatcatattagctgtattgtattgtgttttatttatttacttttttttttttgagacagagtttcgctcttgttgcccaggccggagtgcagtggtgcgatcttgactcactgcaacctccgcctcccaggttcaagtaattcctctgcctcagcctctcgagcagctgggattacaggcatgcgccaccatgccccactaattttgtagttttattagagacagggtttcttcatgttggtcaggccggtcttgaactcccgacctcaggtggtccatccactttggcctcccaaaatgttgggattacaggcattagccaccacgcctggcctatttatttacttattaatggtgttttttgttttttgttttttttttgagatggagtcttgctctatcgtccaggctggagtgcagtgtcacgatcttggctcactgcaacccccgcctcctgggttcaagctattctcctgcctcagcctcccgagtagctgggactacaggcgtctgcaaccacacctggctgatttgtgtatttttagtagagatggggttttaccatattggtcaggctggtctcaaattcctgacgtcaggtgacccacctgccttggcctctcaaaatgttgggattacaggtgttagccactgttcccggcctgtattgtattttaataggtgattattggttttcatattaagatagtgaaatctagcgcaagggtctcaaaaatttgtttgatgattgaaggaatattctgaaaattacctagtatagatgttaggataaagagcagacccttctcaatataggtgagaggagaagttggagggtgtgatgatactcagaagtttttcacagaagagaaattggggcgtgcagtaaacatgtaaaaagattcttactaataagcaggtaggtgcgaatgaaaatcatcatggaaggttatttttaaaactggttctatcattgcctcactttacatattacagagttgtacctactactttgtaagataacttttcttttcaaaactgaagtcaatgtgatagaatggtgagcattattttggaaggccagactaggaggaggtgggaggaggaagtcagactcagcctgtgaacagacgctaaccttggcagaagccaaaacagtcagacagtgttgtgtaaaaatgatcattcaagaagagcgaaacagcaaggtgatttgtgaaagagatttattagaaaatgaaacacatttatacctctgttcaataaaaatctgcttttcgtcaactgatgctcctggtttttgtttctacacatagagaaagcagagccctggcagcttgggtcaggcagccgagtacagaccagggagccctgggcagtggctgcagctctcagctggcctgttcatggggccatggtgggtctgtggcgtggggtgggcccgtggcgtggggtgggcccgcggcgtggggtgggcccgcggcgtggggtgggcccgcggcatggggtgggcctgctgtccacagccagcaaaactaacttagtgcacacacagtgaaattttgaaacaggaagttttagagctagtttctgtcatagattttagtaaatgctattttgcaaaacctttttctgatgtttgttttgtttttctaatctgataatgcatatttcacacattctggtctttaacaaatggaaataaagagaactaaacaatatagtttgtgtcgatggaaagagcttgggatttgttctcagaaaatttcagttacaacagtttgttcatataggtggacttccaacacagtaactataggagtaagaataaaagctgtgtttactttcacagagttaattaagaatacatgagaaaatggatgttaaaaaccttgtaattaaaatgtacagttacatgcaaagttttaaagtgagcattttccagaggtgcttttctaagttcttgaatgcctctcccttttctgaagtggctgcttcgtggggctgttggtctttggcagggggtgagtgcagggttcctgttgtgggtcctttgttctcacgagggcagtgcccgttttccccgtctcctgcttgcccagactgttcccgtgcgcagagagactggcctgtttgacctgcagctgtgctgtttgagctgcagctgtgtagcctgcgctggcccatctggctacactcaacaccgtttgctgatcagcacttgaagtctgtccgtcatagctgagacactgaatattttatctgtttaatttttattcattaaaatgcaggtttgaaaatttgattctgttattagaaagcacttaagtatgtttagaatcacttggccttgggagtctactttgtcaactgtgtattttatgagtctaaatggagatcagatgttttcaatgcaaatttcacggtccaaattgaaatgtgttacatatgtaagctactcagatggtttttgaggacttaatatgaaataacctatgtaaaatatctcaataatttttcttagattgatttcatgttgaaatggtcatatttttgatctgttggaataactatgatacattattaaaattatttttattttttaagatggaatcttactctgttgaccagaccggagtgcagtggtgcaatcttggctcactgcaacctccgcctcttgggttcaagtgattctcctgcctcagcctcctgagcagctgggactacaggactacagactcccgagcagctgggactaccaccacgcctggctgatttttgtatttttgtagagacagagtttcaccatgttggccaggctggtctcgaactcctgacctcaagtaatctgcccgctttggcttcccagagtgctgggattacaggcatgagccactgcaaccagccattagtacaattaattttatgtgttgttgtttttcttgttggtgtgttttttttttttttttacttttgttaatgtgactaagaacaattttttttccccacccggagatggatcctcactctgttgcctggactggagtgcagtagcacgatctcagctcactgcagcctctgcctcctgggttcaaatgattctcctgcctcaacctcctgagtggctgggactaacagaagcatgccaccatacctggctgatttttgtatttttagtagagatggggtttcaccatgttggccaggacggtcttgaactcccaaactcaggtaatctgcccacctcagcctcccaaagtgttgggattaccggcgtgagccaccgcacctggccatgtttattaatacgactaagaacattctgaattgcacctgtggctccattggtgtcctgggcaggtggctctgtgctgtccacacaggttgtctcctgtgtcttcgtcttcgctgcgtgtgactttttggttcctgtggcacgtggggtcctgtatgggacattggttctacagcagatttatagtaaggatgtacctactaaaaaatacaaaatagaaagaatagacacaaacatagaaataagtatcacctcacaaaaattttggaaagtagaaaaagaaaaatgcattcgcagctttccagtagccgatatccaggctgtcttcataagcatggatcatgtgtccctctcccgcatgggtagacactgttttctcaccttaagtgtttgtgagtgaaggattcttgatgtgttgacttggcagatgcagttgttgaacagtagtttatctaaagatcgtaagagacttttggagacatttcatgtccttttttcccttggaaaacgtgagttggagaaatcgctgcttgccaaaaataagccgtgaaacgtatttcagagtagatcgttatttacttgctggcgaggagccacagaataccatttacatttgaaaatagagcgctgcaaagtttttataagtagtgaatcccatcagaattacacattttgattatggctctaaattttatattaaataaactaaaaatttcattgtattgtattaccgtctcttgctccttcaggtgtagcatacatgctagattctagacctgtttcttgtgttacagtggtgttatccaggcagggtatcatgtagtgaaggtgatgtcgagtggtggtggtgagcccagtgaaggcgcatccttgccgtgtgtgatgagggcctgtgggttgctatgggattccccaaccctggctcctctgtctcctgcttctgtccttactcacactgctggtagttttctggtgtgagacacgggggcaagtgggattgacaagcctgctgtcacattaggaacctgagttaaagtggagctgaaagcatgtcctcgctcttgatgttgtgcagagagccacctgtgctcctggctcaacggggcgggtgtggtgggtctggaaccaggccctggtttggctctcctcccctccatgttcccctgtcctgtctgatttgcttcacactgacataagagttactttccctcggcctcccaaagtgctggtattacaggcattagccaccgcgcccagctagcatcctttcaagtactggggtacacccaagctcccagcttctagctaggagtcattttgtccctctttatcccaaaggacttgccaccatctttggttcccaaagcccaggagggtccaggctcttcagcctccaaccactttgcatttcttgtctgcttttcgttcatggagataattaacttatttttcagcctgggcatgtcttttttatttactttattttttatttttattttttgagatggagtctcactctgtcgcccaggctggaatgcagtggcgggatctcatttcactgcagcctctgcctcccgggttcaagtgattctcctgcctcagcctcctgagtagctgggactacaggtgtgcaccactatgcccagctaatttttacatttttagtagagacagggtgtcgccatattggccaggctggtctcgaactcctggcttcaagtgatcctcctgcctcagcctcccagagtgctgggattacaggcacgaccaccgcacccagcctttatttactttgtatatctcatctattactgctgcagtttgcagaagagaggatgccctcaaacctaacttctccaaaccatcccaaatgggaagtctgctccacgtcaacagcattgttgcttttaaagactatacgtcaacatggcagattatagcaaaaggatgtcgagggagcaataggaaagcaagcctgagagtcctggagagaaggtggcagagctgccttttgaaggtggttccttcctcagaccctgcccttcctgccttgttcctccagttgccagatttgctgttggagctcctccacgggcgaagaggtgaggctggactgagagggagatggagaagctgccagagattcttttggatctagaattgagacagcagttccagccaggtccagaggtgggggctgtcacccagcccccaggggaatggtactgattgcagaatgtggcgagaactccctggctgggagagggaggtgcttgctcccttgaatcacctgagcccaggctggaaggcccaagggggaggacgaggccagctcactccagctccatcccctccctttaaccctaagctagttaaccctcccagactccagtcctttttcctaagtgccctccctgcaaagtctgcaccgagcagcgctccctcgcaccagctcaccctgcactgtcttgtctttcagcaaccccatgggtttgaacttgagacgattcattttcctaaaagcctctttgggctgagggaaggcatgggtggctctgccagttttggagtgggggccgactcttctcagagccgctgcaagggccagggccaccctcccaggcgggtgtctctgggctgggcagcagctttgtaggcagcctgggtcatccccactggcctgggaagctgggggtgcaccggctcctgctcctgatagggccaaggcaccttccttacctaagagctgactttcttgaagagtgggcacagaggagccggcaacctgggctgtgtaggcacccaggagaaaatctgcagctcagtatcagaagtctccaccagcacggctgttgcagagatggggaaactgggctgagagggaagggggcttgcccaaatcaccagccctggaatgttttgagctttgggggtggatctcccaggaaacgtgttttatggcaccaccgcctctggtcacccaccccgaggtgtggcgggcctggacagccagcttgactgagggccaggctggtgaagtcaaaactaccactcaggaagaagacctagcccttctccagacagagttcaaatgtgaggactgccttctttgggcctcaaattccccacgtgaattccaaggacccctctagctcctacactctgggccaaggtttcctctgagccgcagtcagcctagaggacctaggatacatcttccttggacagagacccaccataggggcagcaggaggtaggggtgggggtaggcaagattcctgtggggaggtggagctgtcatcagagatggtgtctgcaggcagtgggtgtatcgtggctctgctactacttgctgggtggccccatgacgtttctttccccactctgacctcagtttccctatctgttctgtggagataagatgcctgcctacatatttgtggactgggatgtgtgtgggccagttgcagtgtttcttggtgtggtcctggggcaggctgcaccaccccatagagatttctgggccccaccctaggctcacaggaccagaatctctgggaatgaagcctgggaatttgcatttccacaggcatctggctgattctgacatgactgaaaagcactaatagtatatagcaagctctttataaaaggtaaattcatagctgccttttactaaacataaatcttaccttcccttcctcagttaaggacacacaccgcagttgaaaatcactgtgcctttccagatgcagagtctgacctttccgataagattctgttaactgctgctttctgcagtttgtattccaaaacaaggggaatatgtttccattttttcaatacaaatgtttaagtcggatatgctttctcaaactggacacacactcacacagcttagggtttcagctatggcttcctctcaaattattagcctctttctgccagggagcagtttttcccagacaagaccctggacagaggttggtggggccctcctcatcagaatcactagattatgactgacccctagaggtggcttttctgcttaagtgtcagcccatgggctgggttgtgacccccaaagctgcggcagaagcttccacccatcctgggtcccccctgccatctatggggaaaggcctgtcccttgtcttctgggcccagccggcctcacaggcattcagcagattggaaagtcgaagcatgtgctgtgcttggctgggctctcctgcgcccctttttggggtgaggtggagtgcatccagcccccggcatccctgccgtttattcccacccctcatccccacccccatacacactcacaagtacaaacacaagcacagtcactggcacacaccactctggacagcaccatttccagcctcagcggggcagtttccttacagggaagttaatgaggcactaacgaaggctcaggggacagggggaacctctatcgagaagaggctcctagacctggttctgcctctgaattgctgggggtccttgagaaagttgctatccctctctggtctcagtttcctcaggtgagaaatggggggccggccaaatggtctaaggttctgggaacctctaaatcagagcccgtagctggtggtcaagatgagggagaggccctcagggtcagccgaatgcctgagaggcaggacaggcccaaaggtgagcaacgtgagcacatcaggtgggctcagagctggcgcatgagccccacagcctgcagagcagccctgtactcgggagcccgctcacacccacccagtgggacttcagagatgtggggtccagcctttcctactattgctgggctgagggctgggagctgcagattctgaccccacagctgccttagacatgccagatggtctggggcaagacacacccctctctatgaaatgagcagccagtccaaataggtacattagagaagggctgtgggatggacccagctgtagcctggggctacagactggcttccggggtactcaagcagctggcctctggggtagcagccccaggtatgagaggcaggactcagaatctaggccaagcctccataggaatcccctctggagagcccgggcactctgcaggaggggcagcaggcagcaggtgcaccaggagcatgtttcacaaggtgcccaatatcgcatctgctcagataggcagcgagttggaaagtggatgcaataggcagggtggcggctgctccccacagccaggagtccggcccagcacccacctgagtccgcctcagtcctgctcaattgggttatccgtgctcttggccctctggtcccacccacagagggaggtctttggggcgaccaggtgagctggcccttgtgggaggatgtaactgactcctgagcctggcgagccaggcagcccctcgccaacatccccacccctacctctccagcccccccgcattccctgatcctcccatccgctcccctgacccagcagttgcctctgctcactctcttttcctgctcccaggctcgcctggtcatgtgtccttcactctcctctgagtctccctctttccaagccgcctccactctacttgacacactctcccttaagacaccagagtacacaagcgcaagtccctgcacctcacctttactcccagacatgggagggagatgacatgaagacccaaacgccacttagcaggagatctggggtatgcagaggggcagaacggaggctgtggaagctccaggggctccctgcaggaggccacatgtaagctggctattgaatgtggctctgagctgagacctctccttgaagctccagaccaggagccagctgctagctggacccctccatttggtgcctcagagaaactttgcactctgtaggtctaactttgaacccagaaaattcccccatgtcggccctgtctcttcacagggaaagcaccacctcagacccagttctgcaccaaacccacatttgagtcacgaggctcctgccctgcactgtgagcactctggataagccagtgctgagggggaaagagctctgaatgccaagccaaaacatgagcttcaactccacctccagctctgagagctgtgggtagggaagggccctcgtccagtttgctgtagaaagatcagtctgccactgtatggcacatggatggcaggggcagagtgcaggtggagagaatagaaggtgggcagggcgggggaggcagggacatggctgtagccgtggagatgggaggacagacaggacttggtggccacttgggtgaaccaagggaggagtcaggaagagacacccagttttgtatcagatgtgtagagcgtgggatgctgttcattgacggagggaggaggaggaggaagagatatggcatggggaggaggtagctgagctctgtcgtgaatgtcatttgaagtccccagggaaagccaggccggccagcaccttcactgcttcagccagctctcagggtgtctgtgctccctggccctctcagctcctgcttcatagctgtcagctgcagtgggagacagctgcacaagggcccagcatgtctgtgtgtttacccaggggactgccgcatggcccatgccgagcagaaactgatggacgaccttctgaacaaaacctgttacaacaacctgatccgcccagccaccagctcctcacagctcatctccatccagacggcgctctccctggcccagtgcatcagcgtggtaggtgcagagggtacctgtggctcaggctcaggtgaagaggaagctcatgcccaagccctaagcagtcaatgtccagaggaatgaaatgactagagttgacttagactcaccggtacacggtggggaggctggaggagggtccatgaggtttataggtgtccagtatttaatgaggtcatggttttgttaacaaagaagaaatgagggtgggagcgagatcaccactggctaggcagccaatgggcctgcatagactctgctcagctgagtctccagcacgaccatgagcttctcctcctcatcctcccagccccaccctactctctcccccagcttgctcaacaggtgaccttataggctccctactctttgcagggaataagaaccagactgggggaactgacgggtacagaggcccaggtgtaggcgcaggaccacaggcagtgaagcgtctactgacccaggcgggtgagggtctggagagtgggcatggctgctgcaggcatggaaagcaggcacagatggcggcactcccagggcccattgtcagggtctccacatgtggacatgtgcagaggtgggggtgctgagggaggaggggcagggaatttctcatcttctctctactgcctctgagttggagatgtcagagggagccatggcccactgtaaagtaacacaatgtccccacccacaggattagaacccctcccctggaagcagctctgaggggaacagtcacatgtagagagtgcagggcactgtgtccagccgggggaaggaggtcaccaagggggttgacccccctctggccaggtggctaccttctgacacaccagcctctgtctctagcacggtggcccccacacacccagcctgtgaaacctacagccctcaagaaggctttggccaaattaatgagcggctccctctcccaggaggaagcacgggtgaaggatgtggagggcagtagagttgtgtgtgctccgccccctttctccacagtcggatggaaagaagggggctttcagccaggctcgcccagcctggggtctgagtgtcactgtccagctattggcttcttgcttaatgggtgagcccagctgctcccgtgcagctgccgccctagtgagggtgaaccggcaggcgagttacatttctgaaagcctgggaatacagtaaatattaggctgtgggctgctgggccaggaagagttgtttatttttcagggtttgtttatctattgacttgatgagggagggttataggtacaaccagtttaaagatggaaattttgagagagcaggcagggatttagtgctgggtaagcctggtcaaagcggctcttttggggcggccagaatccagtaccaatgtcctcagcatgttcatcagctgctgggggagtgcgggacagcatgaaagcacaggagaactttctggatgatagaaatactctgtatcttcaaaggaggtgggttccatagtaatgttaaatgagttaaaactcatcaaaatgtaaaccagacctgtgcatttcactaatagaaattatacctccaattaaaaacatgttttaaaagacagatgggccggatgcagtggctcatacttgtaatcccagcactttgggaggctgaggcaggtagatcacctgagtcaggagctcgagaccagcctggaaaacatggtgaaatcctgcctctattaaaggtataaaaaaaaattagccaggcatggtggcacacgctactcgggaagctgaggcaggagaattgcttgaacccaggaggcagaggttacagtgagcagagatcgtgccattgcactagagcctgggcaacagcgcaagactccatctcaacaacaacaaaaaaaggacagatgaaggttttcaactttcaataaaggcagaggagcttgttacagattcgcctccccacaagagcagttagaaaaactggataaaaatgtgccccgcccccaatcaaaaacaattgttggaaggtaattggagacctcagtcaggacttgagtgaccaggcctaggaggtgatcctgacagtctgtagtgctttcccacatttggtgattggtcaacagtagagggctaagaggctaagaaactgagtatgaagtggtagttaagaggctggagagcctagctgaatgtttggcactctcacagggctgaaatgacctaatgagaatttgggtcccaggagggagatgggaccttggtggggaccctggaagggccacccctgggagtccaaatgaataaaacatagaccagccatcagaaaacctaaaacctgctttgaaccagcttagtcccgaagtagatgaaggcgatctgcccttactccaattgtgtgccataaactcaaagtcaatactctctggaggcagataaaagtttactatgaatgccaaaagacaacacaagactaaatgagaaagaccaagaagaaaactaatagaaacatacatgtaaggaagaaacttttttttttgagacggagtttcgctctgtcacccaggcttgagtgcagtggcacgatctcagctcactgcaacctctgcctcccaggttcaagcgattctcctgcctcagcctcccaagtagctgggattacaggcatgcgccaccatgcccggctaatttttgtattggccaggctggtcttgaactcttgacctcaggtcatccatttacctcggcctcccaaattgctaggattacaggcgtgagctaccatgcctggccagtattttgccacaatttaaaataaataaaatttttttttcaggtttgtgctcagactatattctaaacagtcacatggcggcttactcttctccaggccttgctgccggcttttacatgtttattgtctttgccttcttgtcatgtgctcattagatggcagcttccaggtgctcctaaggggccaggaaagagagtgagaaggcacggaggttgccagatcatcccccttggggccccgccctcatcaactccctcaaccgggtctcctgcaactatcggtgggccatctcggccaccgcttcgccctgagcttcctgctgctgcagctgggcagtgcctccttctcagaggccagctgctgataggcggccacgtactgctgcaggtgacccaggtaatggtctcgctgctgctgcagactcagcctcttggctcttcagctccacctgcaggataggcgtcagggtaggtagtggctggcttccagattctgggcccataaacagggtagtgagggcactgcggggctctgtcgcctacccaggcccctggccctggccccttcctccaggcctaaatgactgcctcccttgcctagaggcccatgcctccctccccagcctcaaatctcacacccttcttcccaccatttaaactgtaggccacagactggtggaaaagcagagggagccaaccaccatctgctaagttgtggtgaggtcgttctgtatgatctccagggtttgcacacacctccgcctgctccccccaagagctcggccttctgccccagcttccccagcctctcctccagctcctgcagcctcacctagtgttcctgcatcttctcctcctgctgccgcagcctcacttcctgctcccgcatcttctcctcctgcctccgcatcttctcctcctgttcttgcatcttctcttcctgctcacacatcttctcctcctgctcccacatcttctcttcctgttcctgcatcatctcctcctgctctcgtatcttctcctcctgctcccgtatcttcttctcctgctcccttatcttctcctcctgcctccgcatcttctcctcctgttcttgcatcttcgcttcctgctcacacatcttcccctcctgctcccccatcttctcttcctgttcctgcatcatctcctcctgctctcgtatcttctcctcctgctcccgtatcttcttctcctgctcccttatcttctcctcctgcctccgcatcttctcctcctgttcttgcatctcctcttcctgctcccacatcttctcctcctgctcccccatcttctcttcctgttcctgcatcatctcctcctgctctcgtatcttctcctcctgctcccatatcttctcctcctgctcccgtatcttctccttctgctcccgtatcttctcctcctgctcccttatcttctcctcctgcctccgcatcttctcctgttcttgcatcttctcttcctgctcccccatcttctcttcctgttcctgcatcatctcctcctgctctcgtatcttctcctcctgctcccgtatcttctcctgctcccgtatcttctcctcctgctcccttatcttctcctcctgcttccacatcttctcctcctgctcctgcctcttttcctcctgctcccgtatcttctcctcctgcctccacaccttctcctcctgctcccgtatcttctcctcctgcctccacatcttatcctcctgctcctgcctcttctcctcctcccatatcttctcctgctcatgcatcttctcttcctccctccacatctcctcctgctcccgtatcttctcctcctgcctccacatcttctcctcctgctcccgtatcttctcctcctgcctccacaccttctcctcctgctcccgtatcttctcctcctggtcgtgcatcttctcctcctgcctccacaccttctcctcctgcttccgtatcttctcctcctgctcgtgcatcttctccttttgcctccatatctcctcctgctcccttatcttctcctcctgcctccacatctcctcctgctcctgcctcttctcctcctcccgtatcttctcctgctcgtgaatcttctcctcctgcctccacatctttttctcctgctcccgtatcttctcttcctgctcccgtatcttctcctcctgcctccacatcttcgcctcctgctcctgcctcttctcctgctcgcgtatcttctcctcctcctgcctcttctcttcctgctcccgtatcttctcctgctcgtgcatcttctcttccagctcccgtatcttctcctccttctcccacatcatctcctcctgcctccgcatcttctcctccttctcccacatcatctcctcctgcctccgcatcttctcctcctgctcccgtatcttctcctcctgctcctgtatcttctcctcccgctcctgtatcttctcctcctgcctccacatcttctcctcctgttgctggttcaggcggttccacaactcgttctcttccacctgggcttggagctttgctgacacactctgcagctccttacccaggtggtcagcctccgcctgcagctgctgctggaatagtgaaagtgtttttttgaacctcagaaggaagcagaatcatgagctagccacataaatgtaatctataggctgggcgcggtggctcacgcctgtaatcccagcactttgggaggccgaggtgggcggatcacgaggtcaggagatcgagaccatcctggttaacacagtgaaaccccgtctctactaaaaatacaaaaaattagctgggtgtggtggtgggcacctgtagtcccagctacttgggaggctgaggcaggagaatggcgtgaagccggggggtggagcttgcagtgagccgagattgcgccactgcactctggcctgggtgacagagtgagactacttctcaaataaataaataaataaataaataaataaataaataaatgtaatctgtaaaataatggttttcatccatgatcctttaaaaaaatatttttaagccctaactcttgagattctgattccccaggcagggccccaatttgtacatttttagtacactctagaggattctatggcggggccagaacaaggacccaaattttccagctcttggctggagcctccccataccctgcatgatccctagaccatggtcccagctggatgggtctcccacaacccccggggctgcagctgctcacctgtggcagcaggagcttggccctctccagtttcctttttagctcctttacgttgagctggatctcagacttttcagattctacaagttgaagtttttcttgtagtttggcatttttctccttcagctcctcatcagttatgctatggccagaggcagtagagaaaggaatgaatgaagaacataaaagaccactttggtgattgaccccctaccctcgccccacaaccacagaaccgtggcgctggaagggaccccaggaattaaaagtcccaggtggcaggccagagagaagacatgagttgcctgaggctaccccatgagtcagtggcacagccagcactagagcttccgtgtgcacacatgaaaacatgtatgagcctctccccacactcacctggaccccccacctcccagcacaccacccatgctaagggcccccagacctcccattccaccttcccccatcctacgtgttcctgtacagttccagactcagggcgtccctctcctttgttaactcctcaatgtactgcaaatagagaaaggttaagtcaggatagagcaggcacagcagtagctggacgaccaggaacaactgctacagtgactactccacagtaacacttcctcactctcaatcacacctgacgtgttctcaaggcatttccaagcccatggtctcatttgtttttctttctttctttctttcttttttttttttttttggcagagtttcattcttgttgccctcactggagtgcaatggcacaatctcagctcaccacaacctacacctccggggttcaagcaattctcctgcctcagcttcccgagtagttgggattacaggcatgtgccaccacaccgggctaattttgtatttttagtagagacggggtttcttcgtgttggtcagtctagtcttgaactcctgaccgcgggtgatccgcccacctcagcctcccaaagtgctggcattacaggcgtgagcgagagcacctggccctcatttgtttttcaaagaactcagtggatgtggaagggacagggaaagagattgaatttagggctggctaacaggggcccagagcgatcagataatattgttattgttattactgttattactaccactgttggagcctttattgggtgcttcaccaggcactatgctaacaatcccatttaatcctcacaacctccataggagacggttaccattattacctctattgtgtagatgaaaaacatgcggtattaaaggttaagtgctgcctaagatcacttggagctggcatttcaacacccaggtatatctgattctctaagcccattcttccgctggaggtaggggcacagttaagaaggaggaaattaatcctttgttgaatttttgaaaggatgatacgttcgcatagtccaaaactcagaaagtccagaagggaaatatctccccccaacactgtgcctctatcctgagttttttaatgaatccttacaaacgtgttttatgtatgttaccataatacgtacacacacacacatatacacctgccccctctctccacacaaataataacatactcaagatactcttctgtacctttatggtacaagtaccctaaccgccacttaggacttggccaaggccacagccaagtatgggcagggcgggcacttggcctctgagatctatgtccagtgctcgctcctcacagtgctccccaactcacccacaacagccgactcagccccagtctgcctctaacaaccacacacaaaagcagcaagaaatggccatgctgccttctgggcaggacactccatcctacagaagggacctttaggctcactcctccatctgcgaagctgggctcccaagggacggggccgtgtttggactcaccctatccgccttcttcttctgtgtagcgacagcagagagagcctgctctaactctcctgcaaacttccatgaatcatgcaggcggctgatcagatccctggcctctcctggaatgagagacattcagatgtggcccaaaggactccccctaaaggcctgtcaaagtgccaggttgaaggatgatggggtgccagattcccaccttccaactgcttgacagcatgctggctgtagtaaagtgccatctgaagctcagttttctgacatgtaaggattcgtatggtttgaacctgggcctttgggagaaaagacaagcaaatgctgaaagagaagcaaagaaacattctccagagggcaggagggaacttcacaccctccactcacctctagctccctccttagggcttcctgatgttggtggcttgccttctgttcctatagaaagaggaaaacagagctcttgctagggggaggcagagatggcacagcaagagacatgcccccagaatggcaccactgccccagaacaggcccacccatgggaccagtttatcagggaccctgtggggatggggtggaatcttgggggtgagccttcttccccaggctgggagtgggtgagatgagcctggggcctctacatctgagtgcccccaaacccagcggtcatgtcgtgagcaaagaaatcacacgacttcttccagctgagctcggttctattgtttctgtggggagagtcaaaggaaggtgactgagggtggcccccttgactctattccccaggccaggaagcgataggcaggggccaggaatggatttaaaaggcacagttctcagacccaatgggaacatgaactggtcaactctcctcaactcccaaagaagaaggatttgggtctttttggtttttgcccacagccacagaactcaaagtctgaaactagattctcttgaaaagacagtaacagaaaccttcagaggtggagtgcgagaaaagcccacccttccgccagcttgtgatttagaaaggtgcattcactcagcaaacgttgagcacatacgggccagggacggttcttcacagcgggaatagaggtcagaaaaggcagacaggagcccttggccccgaggtttccattctagtgggcctttaactctcgggctctcagagctaacagaaacctctgatactctctaactctacctcaggaaacgcaagcccaagaaggagagtttacagcaggtcctggacgagggattaacataaaaacacaatgacaaatctcatttaaacttcacaaatgtaaggaaaacaataccactcgtattttacggatgtgaaaagagaggcccaaagagctcaagcaatttgcgctaaatcatatccctagcagatggaggggtaggattcaaacccagaattcttagccagtacctggcagttcttccacaatcttaacaattaccctccaccaccccttgggccctctgtccccaggagcccggccagccaagactcacatcctcaggcgagtggcaaccaccagaagtggttgtctcagggttagtgccattatttattttcttctttttggtgtcgcttgctgctgtaccaacactagggttggtctggggatgatggtctgtcaactgtggaaaggaagagcagtgatactcatgagaactacaagctcctacagtcacatcctgctttacagtttatactaaatactcttatagaccatctgatttaatgccaccaactgtaggaaatgttgtcacaatcacttagtgactgagagagattgataccatggctgaaaaaaaaggcagtaatggaacttaaactcagtcttctgactctgagctctgggattttgccctaaatcagcagctgccagggaccaaaaccagaggcagaggtagaaaagcaaatattaagtaggcaggaactgtgcactatgtggtttagggttattcaccctcacacgtctgttagtgttaaaaagtacaccagtacctctcaaacctttacatcaatgtctcctcatggcagaaggcagcctttctgctaaatctgggaatttaacagaaagaggacaacccaagcctcatttcagagagaagtcttgtatacgcttataaatctatgtgactttcatccctaagtacattaatgttttgtctctcaatagaatcaagggaaactgatgcttcagaaagatgccccatatttatcctgtggcactcaaagtaccccaggttgagatgagatgaggaagactcaagctaagttcagtttcccaagatctgttccacagaagataagcagatctcactccagaaccagtgactgaggggcactctggtcccagaacaatggagaattcaaatctgaggtgcagaactgagaaaaaatgttaaaatctctctggagagtagaagcctgggagaaaaccaaaccaaacccgttctcccattgccacccagagacactgtcaacgtgttgagctcctgggggaggtgtaggcttttcacactgtcaaggtctgtggtaaggaagtcaggcagcctgaaacctctctcttctaggtcccacagtccccattccccttccagctggaaacctgtgctgcaaccagaggaaacagaagtgggcaagaacacttaggggactgggtcctaagaccaaaggccggtcttgtggtagtaatgacagtttgtagcgggactgtgacatcactacattctactcctcggtggagtggttgggggggacacatgagtgcaatgcccaagttgccgctttgagactggggagggggtcacaaaattgggagccaggtccttggagacgtgaccccaaagagccccgggaggtcaggcttggggcggcaggaggtgagggccaattaaggagcaaggagctccaggagtcacatccccaaagtcaccctgtggcaactggtgagggcaggttctggggcacccaggtccttggagctgtgagctcaaggagcccagggaggtcgggtttggggtagcaggaggtaagggcggagtatggagttggaagccccaggagtcacctgctcaaagtcaccctggtgtgccgggcagagcaggggcaggacttatgagggggttgggctggctgacaagattttggtgtggggagcccagaggcactggggtggggggcccagcctggtgtccctcaggagtggcacagactctggcagcagttcggctgtcagagggggcctcgggttgggttggggtgttggtgcgtttacctgttccttggcctcggccaatttgctctgtctggtttctttggacatcataggatgggtagggaggtggggatgggtagggaggtggggatgggtagggaggtggggatgggtagggaggtggggttggggccacatcagcatgatccaggtgaggacaagtatatacctccagtcacctctacgtcgctgtgtgactgagccagaggaggcgtaaccagggctgcactagaatgcagaataggggtgtggccttcatgcttgaagcccattggtcaatgagaaagatgaaaggaaaaggaggtgtggccagacagcagcgtgtcatcaaggacctgtgttgtcacaaggaaagctgcctatgcaaccgctgtccccgcccactccaggagaggggcggggctggctttcactttaaaaactttaaaactttattacctcaattgaggtacaagtcctattaaaatggaaattttatagtgtgcttgatgattgataaagcagactttattatccaacattccaataagataatcacaatgttttctcttttttggaaaaactttctcttattctcctacattagcgtttagttttttttaaaaaaacaaacaaacaagaaacatgtctaatatctttaaaaatacaaagctttgagccaggcatgatggctcatgcctgtaatcccagcactttgggaggctggggcgggtggatcacccgaattcaggagttcaagaccagcctggccaacatgatgaaatcctgtctctactaaaaatacaaaagtagctgggcatggtggcaggtgcctgtaatcctagctacttgggaggctgaggcaggagaatcccttgaacctgtgaggcagaggttgcagtgagccaaaatcatgccactgcacttcagcctgggctgctacagaatgtgactctgtctctaaatacacacacacacacacacacgcacagacacacacacacacacacacacacaaggctttccatttaataagcactcaaagttctttacaaggttaaagcaaatacaggacccttctaaagtaaggctaaatgctaagtgatgggggagagaaaaaggacataaataactcctactctcatgagttaatcactaaatccgatttttctagaatcacctggcctctaagccctgaaaatgaaactgaatttctcactcgatacttggctatgacttgcaatcataaaaaccaagaattgtgttatgtcactgtgtattgcttgttacctgggatcaagggttgactttttcatgatttgctccattacctgtgtgcttcttctcccagtccaaactacgcttttttctagagatctacaatttacagttagtatgtaagggtggctctcaaacatgtagtctccggaccaggagcacctgggaacttcttataaatgtaaattctcaggccccaccctagacatgaatgaatcagaaactctgcagtagggcccagcaatccgtgctgcaataatccctccaggtgctcaggaacctctgccatacagcaggtagaaaaatgtgtttccttctgtagggccacagccagggatactatacgttctgtctcaatatgaaacaatgacatgcaattaaaagacataaatctccttcctacttccaccctccagccagtgtgttttatttttatgagttcaataagaaaacgtgtggcaatcagagatttcatctaaaaaatatatctacaggtatcagttctcatccagcctgatctcatccaatatcatttctatcctcttacatctaaagttttagaaaaggattttcacaacgtaagactcaggcgcactaggagttctatgataaaagaccaagtagatctgaatgtccaaacttactagagaagaaaagtggactcattggctatattttcaaattgcattcaacaggaaattaaaggtttgaattttttccaccttcatccttccaagttaatagaattaaaccagaatactccattcttccaaagcctgtagccaggcaaacttttactgtattacttcttgcttttcaatggatataaagcagagtcctggtaggcacattttgtatacctgcaaagatgcaaaactaaacagttccctcggttcaatattaaaacaaaagtcctgtaaacctcagatggtgagtgtaatacttcagcactagcacgaaagcctcaaatataaaaagataccaagaaccttgctagcaaaccaaagtaagctcttggccgggagcagtagttcacgcccgtactcccagcatattggcaagctaaggtggggtaagtcaggagttaaagaccagcctgggcagcatagcgaattcatatctctacaaagaaaatttaaaaattagctgggcttggcggcacacacctgtagtcctagagctacttgggaggctgaggtgggaaaatcacttgagcccagaagtttgaggctgcagtagctatgatcatgccactgcactccagttggggtgacagagcgagatctaattattacattctctcctgctcctgtttccactaaaatcactaacttaaaatgtgttcattcagcaggataaaaattaagtgaaatttgactttggtgctttgctagcaaaaaataaataaagtgaaatgacaaattacttactgggagaagatctttgtaacctcaatgacagattaaaggtttgtatccttagcctataaagaaatctttaaaattactcagaaaaaaaaatgaatgatttgcagcagaaaatgggcaatggagaaaccagcacttcccacaagaataaaaatggccaatgagcaaatgaaaaagattcaaaagcactagaaatcaaagaaaggtaatgaaaacaatgagattttctgcttaaagaccagcgaagacgacaaatggaagggggaacctggagctctgtccctgttggtgggagcataaactcaaccaattttcctataggatgatttgaacatttcttttaaaaatcctaaaacggttttatattattttcttctagaaattctacttctatgaattcagtgcaaaaatcctcactcgagtccattaaaatatatatagaaggaaatccacctctggggtggcaatgattcacttaacatacatccagctgttgaaagtgatgatgccagggtatatttctccatagaaacatgcttaaaatatagtaagtgacaaaagaccatgtattgtgattctactttttaaaatgtttacagcataaaaagtgtgaaaagcaacaaaccggaatgttttgagtggcaaaattaaagatttttctttacattttgtcatccaaattattacaaaaacaatgtgatttcctttataatcatggaaaagtgttattttcatttatttatatttacatttcttttctttttcttcttttttctcctgtatgtatcccacataggctacagagcttaaatccctgcctcttgagagaaatcagcccattttcaggacatgcaatacacaaagctgccccatcttccctttatttttatttttatcttatttatttatttatttatttatgttgagatggagtctcactctgttgcccaggctggagtgcggtggtgcatctcagctcactgcaacctccatatcccgagatcaagcgattcccctgcctcagcttcccgagtacctgggactataggcatgcaccaccatgcccagctaatttttgtatttttagtagagaggaagttttaccatcttggacaggctggtctcgaactcctgacctcaagtgatccgtctgccttggcctcccaaagtgctgggattacaggcatgagccactgtgcctggcctgtcatattatttctaacatttgagggacatttcaattaagtgaaatttaattcttactgacctgatctcttatcctctgtttaatgataccttccagttgaaaggtgtttcctctgtaatcacgggtgccaaaggaaatacaacatgtattcattaggtggatatccactaaaccacggattcatgcattgtagtccttagaccctcagcatcagaaacacgtgggaacttgttagacatgcaaattcctgggccagccccacacctcctgaatcagaaagtggggaaggacagctatctgtgctttaataagccttgagatgctccctgaagtttgaaaactacagaactagaatacatatggtagtaagtgctcatactttatccaaggtactagggactcttcccctcttttccattctcttttctgttgaaataaaatgagagctccttttgacttaatgggtataagaaagaaggcaatgagatgaccagggtttcaagttagagttcaaaatttaatcagtggacagtgacaggatgcaagccttctaaacagattgctgcaaggaagctgattataatctatacagtaggtatcattagtgtattgatgttaaattttgggggtggattaatggtattgtgattatataggagaagtcctggttcctagaagatatctgcgaaagtacttaacagtgaaatgctctgatactgccaacttactttgaaatgattcagagggaaaaagggcacatatacaatcttccatacgcagaagacagaaaacaagtgtgacaaaacattaactagtgaatccagttgaatagcatacagatgttcactgtatgattttatcaacttttctgtgtttgcaagttttcaaaataaaagttgagggaaagaaacatcaccccaaatctttctatgaaatgggaccatagaaaaagcagagaagtgaacactttgcagaaaagagcactgcacccatccggacagcatggtcaaagtgcaggctctcctccaggaggctcttctctggtctcttctgtgctgtcacttcccccacatgcagccaaggcttttttctaacaactctttttctaaagatgtaatttttgtcattcatctaagaaagagaagaaaagaattagtatacatttagaaaataaaattacacttacatttgtgaaaaagcaaaaaatactttgaaaagtggggaagcaagaaatgtactgttctacaattctgttctgttcttaccatctttttattctgccaatgacttcctattcctgctgtgtatggtggggtgagctgcaaatgatttcttttcctcattgatttaaaatctcatgtttataatgtgccaaactcccccagaagcatttgggtttatttctgggctctattctattcaagtaatctatctgttcacaagccactatcagttttgattattggagcatcctaaagttaagtaattgttgtttttgtttttgagatgcagtctctcactctgccgcccagctggactgcagtggcgtgatctaggctcactgcaagctccacctcccgggttcatggcattctcctgcctcagcctcccgagtagctgggactacaggcacctgccaccacgcctggctaattttttgtatgtttagtagagatggggtttcaccttgttagccaggatggtctcgatctcctgacctcgtgatccgcctgcctcggcctcccaaagtgctgggattacaggcgtgagccaccgcgcctggccctgaatttgcttgagtttttagctctctcacccatttcaggattgtcaccacccatatctgacacgtcctcctcctcctctaaatcttctaggtcctcctggccatcagcctctgtttctgaaccagcctcttcatgctcctgttcttcactctctgggagaagactgatatcttcatctttctttcactaaccgcattctggaagcacggtaaaattgcttcattttgcaattccagttgttgcaaagtctgctcatcatcaaaactttctatcacaagtttttgtaaagagctgccatggattctaccattctctactgttttattaaagtcataaagcacttttgttaaagaagtgaactttggttccaatccatcttgaaacctattgggaggaattaaatgagatttagaattatagataataatttcacagccctcttaattaaaagaaaaataaaaacctcaactcttctgtaaaatcaaatttgaataaagtgtaagtatagattctggccccaacaatatataagctgatgagccacaatgatatataaaacctgtcaaccaagtatttgtgaatcagctgtatagattgttggcaggaaaagcattacaaatctatttgcttggagatatatagtgaattagccttaaattatctactctgctacattatataccactccattcattcattcccttattcactcaatgatcaacatttgctttggctacagtggtcaaggaaaacctctcctagatgtgacatctgagatgaaacttacagacaagtatagtcttataaagattgggaaacatgtattccaggcggaagaaacagcaagaacaaattctctaagatgcaattgagcttggtaagcctgaggaataaaaaagtgagcatggctatagcgtgaaggaggcagaaggtgaagttggagagactgatgggagccaaattctgcagggctcaagggtaagagtttgccgttttaagtgtaataagaaaatgtgagaagattttaagcagaaggatgaaatgatgatttatacgaaggaagaagaaagggaggaaggaggaggaggaaagtagagtgattagaaggttgatgcagcattccaggcaaaagatgatggtgatttaagctggagttagagcagtgaatatgctgagtacagtttggaggtagaactgacaggattgctaaggaattagatacagaatagagaaaagtgaagtcatcaaaatagcagcctagttttatgtgcgagcaactggagagacagaactgccatttactgtgataggcaaggcttgagtggtggagcaaggggaaaggacttcagcggatggcagagtgtaggtgggtagaaacaacattctactgtattttggacacagtgaatttgtgatgctgagaggaccaaaatttaaaaaattgttaaaagccgtacggtgcagatatcccagttgtgcgctactgaattccaactaagctcagtctggagttgcttgtgagcaaggaactcaagggagaggttggagtttgaaacataaatgagtcataattttataggtcatatttgaagttcttcaacaaaatacacataaaacgtttgtgttgggaagagacatgaaagttctaattctcaagaagcttagtggggtagacagacaagtgacaagtttgtgctttcaataaagtatgatggcaggtaaacactgagtgctttaggagcacaggcggaaggagaaaccaacacagttgtgtgtagggggatgggggccgtaataagcctcaaggggagcttataggcgtgaataactgaggttaggttgatttcaataacattcaactgagagatccatactgtaaaagttttaacaatttttaaaattttgatagcctaggtcctctgaaatgtggggaaaagtgatttacatttccccttaccttcccccagctccacaatttgccaggggtctgcaacccgtgtccacgtgcgaccgcagtcgcacccgagcccgggatctgtgcacttacgtgaggatgcactcgggccagccagtggctttgcccacctccctcagacaccgctccggggtccgtcagcgccaggcccatgggccatggctgtctgcaactcccgacacaagctgcaaggcaagagagccgctgggaaaccgcaccgcaaggatgctggcattggaacaggaattaaaagaaatgaaaaaatgtgtaagcaaaaactcagctgtatgtaaaaaaaacccaattccccctgagaatgagaaagagccttagtcctttaaaaaaactacctgttttcctatggctagtgagccttatcgctcccttcccaggcattatcaaaaccctaattccctaactgtgcaactgcaaggtcactaaacaaacaaatgcaagtcacaaaacatatttttcctaaaaacgtaaaaaaaaaaaaaacataatgcgtgcttcaattaaataaccctctgtttctcgcttctgtaatatgcttccccctgcacagatctacccgggctccacaaaatgctaaaagataactctttattcagctcaacgctttgatctgcctggcgtggtggctcactcttgtgatcccaggactttggacggccaagtagggtggatcgcttgtgccttggagttccagacaggcctgggcaacatggtgaaacctggtctttttgttttgtgttgttttgagacggagtttcgctcttgttgcccaggctggaatgcagtggctgggtctctgcttgccgcgacttccgcctcccgggtttcggtcgttgtcctgcatcagcctccagagtggctgggattgcaggcataagccaccaagcccggctaattttgtatttttttttttatttttattttggtacagatggggtttctccctgttggtcaggctggtctgaaactcccgacctcaggtgatccacctgcctaggcctcctgaggtgctaggattgcaggcttgagccaccgctcccggcccaatttgttaatcagaaaggaatagatcgtcctggtgtggtggctcacgcttgtgatcccagtactttggatggcccagcgcggggtatcccttgagcctaggagttccagacctgcctgggcaacatggtgaaacccggtctctctctctctctctctctttttttttatgaggtggagtttcgctcttgttgcccagggtggagtgcagtggctgggtctccgctcacagcgacttctgcctccagggttttagtagttctcctgcctcagtctccggagtggctgggattgcaggcctgaccaacattgctctgctaatttttttttatttgtttttggtagagacggggtttctccatgctgggcaagctgatctcaaactccagacctcaggttatccgcccacctcggcctccggggatgctggaattgcaggcgtgagccagcgcacacacccaatttatttttatttcattttttatttttatatatatatacttttgagacggagtctcactttgtcacccaggctggagtgcagtggtgcgctgtctcggctcactgcaacctctgcctcccaggttcaagcgattctcctgcctcagccgcctgagtagctgagattacaggcgcccgctagcacacccatctaattttttttttttttttttgtatttttagtagagatgggttttcatcatgttggccaggctggtctcgaactccggacctcaggtaaacccacctcggcctcccaaagtgctgggatgacaggaaggatcggcctggcgtggtggctcacgcttttgatcccaggagtttggacgggccgagcgtggcggatcccttgatcctaggagttctagaccagcctgggcaacatggtgaaaaccggtctctctctctctctttttttttttgaggcgtagtttccctcttgttgcagggctggagtgcagtggtgcggtgtcggctccccgcggcctctgcctctgggtttgggtggttctcctgcctcagcctccgagtgactgggattgcaggcgggagccaccatgcccggctcttttttttttttttttttttttttttttctggtagagacaggtctctccatgttggtcaggctggtctcaaactcccgacctcaggtgatccgcccaccacggcctcccggggtgctgggactgcaggcgtgagccaccgctcctggcccaatttattaatcagaaagaaatagatcggcctggcgtggtggctcacgcttttgatcccaggactttggacaaccgagcgtggggaattgcttgagcctaagagttccagacctgcctgggcaacatggtgaaaatctgtctcttattattattattatttttttttgaggcggagtttccctcttgttgcccaggctggagtgcagtggctgggtctccgctcgcggcgaattctgcatcccgggttttggtggttctcctgcctcagcctcctgagtagctgggattacaggcacctgccgccacacccggctaattttttttttttgtatttttagtagagacgggttttcatcatgttggccaggctggtctcaaattcctgacctccggtgatccacccacctccgcctccccaagtgctgggatgacaggcgtgatcggcctggcgtggtggctcacgcttttgattccaggactttggactggccaagcgtgggggattgcttgagcctaggagttccagaccggcctgggcaacatggttaaacccagtctttttttaaattcctttattattattattattattattttttttgagacggagtctctctgttgcccaggctggagtgcagtggcgctatctcggctcactgcagcctctgcctcccagggtcaagggattctcctgcctcagcctcctgagtagctgggattacaggcgcccaccaccacacctggctaatttttttttattttttagtagatcgtggtaactgccttaaaatgatgattgttcagaaagtcagtttaatttagatactaaggatattgaggttatgtaacatttgagcaagttctaaaaaaaaagagaaatagtatatttaattgctaataaagtattgtcaactcacaaatatattcacatagcatacatttcaagagcagaataaccatgaatataaaaggaattagcaaaaacgagacaaaaaagacatgaagaaataaaaacagatggaacaaatagcacaaaatacgatgaaagttataaaagaaactatgccaacaatcacaataaatgtaaatagactgaataattaagagaaaatgactataaaacagaattagggcacgcgtggtggctcatgcctgtaatcccagcactttgggaggatgaggcaggcggagggatcacaaggtcaggagttcgagagcagcctgaccaacatggtgaaaccccatctctgctaatacaaaaattagccggcgtggtggtgaacatctgtaatcccagttactcaggaggctgaggcaggagaatcgcttgaatccaggaggcagaggttgcagtgccgagatcacaccattacactccagcctgggcaacagagcaagactccgtatcaaaaaaaaaaaacacacaaaaaaaacacaaaaaacagaaaataaacagtatgaaaagacatctaaaacataaagtcacagaaagactgagagagattgaaaaaagatacacatgtcatatgtacctaacccaaagaagggttggaagctatattattatcagataaaataggctttgggcaaaaagcaatatgggagattttttaaggtcacaatatgatgataaaaattctaataaaccaagggagaaggtaatctaaaatgttaatgtatctaataactagcactcaaaatacatgaaagcaaaatatgacaaaattgcaaccctcagagggcaatttaaatacatatctcagtatctgataaaagagacaaaaaacaatcagcatagacatagaagatttacatctctctagaaaattaacaagcttgacctaatgtagagaaaaaacatatctctccaaagtgacagcattcaccccccccaagtacatatgtactgagccataaggaaaatctcaacaaattccaaagaagcggaatcatgcatccatctttctctctaaccataatctcattaaactaaaaacaataataaaaagataaagtaaaaagccagaaaggcagatgctaaatgagaaagtgacagaaaagttacagattttgttaagcatacaaagcttctatagggtaaagcagtcaaagggatatgcaaatttacacagaaatccaaccgatataaatccttgaaagatactacatacagatatttcatcagttctcacatgccaaacccagcaaagccaaactttggagcctcccctgcgagcagacctgccacaggaggagaggcagcacaaacctccctttgcagtgaaaatgccacattgtgtgtgcttcttaccccatcacctctttggaagtggccccactcagtgctagctgagaatcgcttccctcataccactctcagtagttcaccccaagacacactggacaactctgtacctggtaagtcattgtgaatccaattaataatggcattcagaaagttaggaatctttgaattattagattcatagtgatattcaaaagaaagaaaacgacatcatttctgttccacgcatgttgcccacattcactgcgtaaaaggcaaagggaactgtgagtacccacaaagaacctgatattgacggcacatacatttcttcattaggaagaataaatttagactgtaacaatttaaaaaaccagaaaatacaactgtacattttagctcttattaaaatccaagaggtttaacttatttgctccttgtttaggtaattagtgtctaaaacatttcaaagataacatatatagtggctacgatttctagtactttttaaaaattcaagcccagtctcttctaattaaatgtataaatgatttatctctgtctttcttaaaaagaaccaagagccccaattaaaaagtaaaacttaaatttcctcttaaaaaattgttacgtcaaaattatcgaataaaccatagttcagaaaataatttctgaattaagaaaatatgaataataaaaccaacagttcatgtgctgaatttcaaatttttattttttattatttttaaaattttgttttaagttctagggtacatgtgcaggagtgttacgtagggaaacgtgtgccatggtggtttggtccacctatcaactcatcacctcagtgttaagcccagcacgcattagctatttttcctgatgctcctcccccacccgccctgacaggccccagtatgtgttgtttcccttcctgtgtccatgtgttctcactgaacctcacatttttaaatacagcatatgccaggtgtcatttcagtacccatgattatacatagtataattatacatagtatatgtatatgtgtaaatatatgtatatgtgtacatatatgtatgtaatatgtgtatgtaaatattatgtaaatatgtatgtatgtaagtatatatgtaaatatgtatgtgaatgtatgtaaatatatacacatgtaaatatgtatggaaaaatatgtatgtaaatatatgtatgtaaatatatgtatatatataaatgtaaaatatgtaaatatttgtaaatgtaaaatatgtaaatgtaaaataaatgtagaatgtcaaatgtaaatgtaaaatgtaaaataaatgtaaaatgtaaaataaatgtaaaatgtaaaataaatgtaaaatgtaaatgtaaaatatgtaaatatatgtatatgtgtaaatatatgtgtgtaaatatatatgtatatgtgtaatatatatgtatatgtgtaaatatatatgtatatataacacagcatacagcatatgccaggtgtcatttcagtacccataattatacatagtataattagactactatgttagctaaaaaatgttgattagatacaaatgtataaatttatcttctctaaaagtggaaattctctagaggctatttccagcttctgtgtggattgtagagcaggctgctacctgtaccccaaaaatgaacaccttaaaaaaaagacaagtttctcagcctccctattgcacacacatatgaaaaatatgttaaattcaacgccaaatattcctgagatcaacacagcagtgatcccaaagagaaaatttctctttgctaatgggcacaaacttgaagggcaaagcagtggaagggtaagtctgcagactcgggtggggctcaagtcagaatcacgtggaagatcattgccacatgtttttgtttttttaaatagcaaacaccaccaagtggagcccgccgggtttagtagatattaaacctctaaggagtggcacatccgagactgaaattcccatcttttgattcccagctcaaggtctctgaaatgccagcaccagctgtgaaattgttcttctgcattttcatggagaccttttcttctatactgccatactcttttttttggaacagttatacctgatcttcctatttttgtgtgtgttccaccgaaagtttttcactctaaatacttccctctttccaactgagcatttacatctgtaacaaggacaaaaacatctaacatctctctcacccttggtttgtgttttgttttgtttgtttttgagacagggtcttgctctgtcacccaggctggagtgcagtggcgtgatcaccgttcactgcagcctcgagctcctgagctgaagcaattttcccacctcaacctctgagtagctgagactataggtgtgtgccaccacgcctggctaatatttgtattttttgtagagatgagtttttgccatgttgcccaggctggtattgaactcctggcttaagtgatcctcctgcctaggcttcccaaagtgctggaaggaattacaggtatgagccaccgtgcctggcctcaccattgttaaaattatggaaatcgtgtttgcaaagcagcttggcctgtttggaaaagggtgtcataatttctcaggtaactccaaaaagagaaagctacgaaaattactttaatacattcattacagtcccagtataagattatagcttcctctcccaaagtgtaaccacaacctgacgcaggatgagttggtttgaaaataccgcatacaatatcctcttgagtagaatcataatttagaactctaaaattgaccagaaacaaaactgtccaagtttgtttaacgtaatgtgtttcaacttatttgactagaaaacccttcattcgtgcaacacttataaatatcccatggcaaatctagttttctatgaataatgaacaaaacatttataatttaaaactaaaattgtcttctaagcagagatctacgtatcaataaaatgaagaaataaaatttccatactgttttcttcccaatacaaggattagaaggaaagggaaaagagtaacagcgagaatcaatagcccatgtctggccaggctccatggctcaatcacacctgtaatcccagcaatttcagaagctgaggcgggaggatcactggcctttagtgatccttgaatgaaactccatctctaaaaaattaaaaatattagcttagagaatcatttgggcccaggagtttgaggctgtattgaactatgactatgctactgcattgcagcctgggcaacaggctgcttaaacctggaggggcggagcttgaagtgagccgagatcgcgccactgcactccagcctgagcaaaggagccagactccgtggcaaaaaaaaaaaaaaaaaagagattctattcacaatagcaacaaaaccctgagaatatatctagcaaagtatacacaaggcctttcatgaagagtattgccatagcctgaatgtgtctcccaaaattcatgtattaaaacttaattcccaagatgatagtactaagaagtggggcctttaagaagtgattaagacatagggtgagccctcatgcatgagattagtgccttccttataaaagggcttgtgggtggtggtaaatctgtcccttctgcctcatgagaacatagcatttgcctgctccagaggaagcagcattcaacgtaccatcttggaagcagagaccaggccctcactagacactgtgtctgctggagtcttgatcttgttcttcccaacctccagaactgagaaaataaacttctgctctgtgtaaattacccagtctcaggtgttttgttatagcactatgaagggactaagacaaatataaaaattacccagggacttaaaggaagaactgactaaactgaaatacatgccatatatattatgaatcgtaggactcaatgctataaacatactacttctcaacaaattaatctataaattcaagaaattcctacacaaatcccaatagaatttttttgtggaactcgagaggctgatcctaaaattcatacagtcacttgaggggccaagaatagtgtaacagggctggcggggctggtggctcacacctgtagtcccagtacttgggaagtcaagactggaggatggtttgaacccaggagttcaagaccagcctaggcaacatagcaagatgttgtctcaaaatattaaaaataaataaataaataaaaagaaggttaagtatgcacattttgttgtgaatttcaattttatagtgatttttttttttttttgagacagggtcttgctctgtcacccaggctggagtgcagtggtgccatcttggttcactgcaacctctgcgtgggctcaagcaatcctcccgcctcactctctggagtagctgggaccacagttatgtgccaccacacctgactaatttttatattttttttttgtagagacggggtttttccatgttgcccaggttgttctcaaactcatccacctgccttggcctccgtaagtgagatcacagacatgggccactgtgcccggtctagtgcgctttttttttttttttttttttttaaccaaacaaacgatgaagtctcaggagtaaaagttgatacacaagtaaattttattggtaatgtttttgtgtggtctttaagcagagggaaaattagtctgcattatggtgtatccagactaaataactgatattaaaatgaaattatccttaggatttgcaatcttagagaaaactttttcattttttttgagttacaaattatcttcacttacatttgagaacagtgagtcacagagggattaagtatcttactcaagatcttgcaagtgtttggtttgaacccaatcttttcactctgcagaactcagagtcactcttatttggaaactttttaactgatgtggatcctctaatatgggcttcctattattcattccgtattagtcagaagttttgcaagcaggcagaattcattttgccaattacgggattttccctcagttgcagtcaaggttcataaaactataactatttatctttaattataaattttgtttttgagacaaagtcttgctctgttgctcagactgggatccagtggcacagtaacagcccattgcagctttgaactcctgggctcaagggatcctccgcctcagcctcccaagtatctgggactacaagtgcatgccatcatccctggctaattttgttaaaaaaaaaaaattgtagagatagggtcttgcttcgttgcccaggctggtctcaaactcctggcctcaagcaagccttcagccttggtctcccaaagggctgagattacaggtgtcagccattgcacctggccaaaactgtaactatatatacacacacacataactacatatatatgtgtgtgtgtgtgtgtgtatgtatgtgtgtgtgtatatatatttttatatataaatagatatatctgaaaggcatcaaaagaaaaaagctgtaacttttagtcttgatcttgatagtgacttgattaggctatctgtttaacatcaaagatgcaaattaatgctttctttgggtgagcatattaaaaatgcagaaaatattggagtagttttttatgttaaataaattgtattctgtgtatttaaggtatacaacatgattttatgggatgcatatagatggttaaaaaaaattactacagtgaagcaaattaacgtatccttcaactcagatagttacccgttttctttttgtttggtggcaagaggagcttaaaatctcatttagcgtgaatcccaaatacagcacaattttattacctatatttctcgcgttgtacattatatttctaggcttgttcatcctacatatctgctactgtgtaacctctgagctatgtccacccattttctctcttgccccccaagtaatttcctaaagtgtctcatataaaaaggcagtagctttcagcttaaactttttctctgtatatatttaagtcaatttctttgaggtatgtttttctctccagaatagttagatgtaggcataccactttaatgttgacactagttcacctagaacttatcttctgcaaatctgtctctatgtccatctctgtctccatctttgtctctgtctttatctctgtctatctatctatccatccatccatccatccatctatctctctatccatctatctgtctatctaactaaagcaaattcatgcccttctcctatttatggaatcgagaccataaacagaggtgagggaaagaatttggcaggaattgcgatgtgtattacctgtggcataaggaaactttacagaactagggtcaaaagtatactttctagttctttcccatggcttttcactttgatgtagtccttatcaggcaactgaggttttatataagtcccctgattcttagaacatgaaggtgtagtattcaagtttggtcccttgaaaccacaatttttgttaaaaaaaattaagaaaattgtataatttcctcagcaaatacatattgatcatctgttatacagccatgagaagtggttctgttgaacacgtttattttatcagatcccaattctaaaccaggcatagaatggaaaccatgaaggtaggatgaaataacttctgaatgtttgaaaatagtgtacttaaaaataaatatcaggtgtttttgttttgttttttgttttttgtttttgagacagggtctcactctgtcacccaggctggagtgtggtggtgccatctcacctcattgcagccttgacctcccaggctcgggtgatctcccacctcagcctcccaagtagctgggactacaggcacatgccaccatgcccagctaattttttgtattttttgtagagacagggtttcaccatgttgcccaagctggtctagaactcctgggcttaagcgatcttcccacctcagcctcccaaagtgccaggattacaggcatgagccaccatgcctggctgaaaataccaggtttttaagtatcagcactgcctcttcaatcttttctattactatgttgtgctcagtggtattttttattgaattagagcagtgctgttcaatggaaccttctttgaggatggaaatcttttatgtctctgctgtgtgggtatggtattagctgggtatggggcacctgcctatagtcccagctactcaagaggctgaggtgggaggatcacttgagcccaggaggccgagtctgcaggttcgtaccactgcaattcagcctgtgtgacagaatgagactcagtctcagaataaaatgaaataaggaaataaaaatgtaattgttgaaataagaaactagtggatggattagacacgagaagaaagaattaattgtttaggcgattctctccaaaaagtaagtcagcatgtcacacagagagacatgaggatggatgatagggcagaagttggtgggcttggaggggagaggaagatcagaatgaggtccaaaatgtgtcttagtgaaatcccaggaggagatattaaaattatattagaaagtgaaagaaatagaagttttatttatttatttatttatttattttgagaaggagtctcgctctgtagcccaggctcgagtgcagtggcacgatctgagctcactgcaagctccacctcctgggttcacgccattctcctgcctcagcttcccaagtagctgggactacaggcacccaccaccacgcctggctaattttttgtatttttagtagagatgtggtttcacctttttagtcaggatggtctcaatctcctgacctcatgatccgccagcctcaggctcctaaagtgctggaattatacgcataagccactgcacccggcccaaaagctttgtgtttttacaaatattacacatgtttcttgtttaagaaaaaaagtcttcacaataacgtaggagaataagagaaacatttttccaaaaaagagaagtcattgtgattattttatcttattggaatgttggataatatagtctgcttcagtaatcatcaagcatgctatggattttccattttcataggatctgtatctcggttaaggtaatactggtaatttttgtactctatgaaaaatataggccaaaatcatagaccttgcatagaagctggatcatgaagacagctctggaggaacacacaggtacacacacacagacacacatatatataaagtatacacatatatatatttttaaaagcttttaaagcaaaagccggccctgcccctctcccagagttggcggcctctcccctctcttagggtgggtggggacagtggttgcctgggcagctttccttgtgagccaaaggtccctctggacacatgatgcctggccacgccccctttccctttcatctttctcattaaccaatgggcttggagcattaaggccacgcccctattctgccttctactgcatccctggttacgcctcctctggctcagtcgcacagctacctggtaggtgactggaggtgttgatcagtgcttggtgggattttgctgatgtggccccaagcccgcctccctccccaccctgcgatggcagaagaaactcgacaaagtaaattggcagcagccaagagaaaggtaaaaacacaccaggtcacggacccccaacccagccatagatcctctccaacgacaagactgctgccagagtccataccactcccgaggttcaccggactgggacccccacaccggtgcctctgggctacccccaccaaagttttgtcagtcagccccaccccttcagcaagcagcccagtctctgccctcaccaatcaccccagggtgactttgggcaggtgaatcctggggctccccgctcctttactgggcccccatctcctgccaccccaagcttgacctcccagggctttttgggctcacatctccaaggacctgggtcccacagccccagaccccaccctcaccagtcatccctgggtgactttaggctggtgaatcctggggctccctgctgctgactcttcccttccctcctgctgcctcaaggtggacctccctaggctgtgtgcactggtgtctccaaggacctgggtcccagctctgtttttccctcccctatcatggagcggtgactcggacatcatgctgatgtggtccctccccctcaccaggaagagtggaatgtagtgatgtcacggtccatccagtaactgtcattactgcaagactggcctttgatcttatgacccagtcccctaagcattgccaccccatttctggttcctcttgtcacagcacaaatttccagctggaaggggaatggagattgggacctaggagcaagaggtttcaggctgcctcactcccttaacataaacattgacagcgggaaaagcctacacttcccctgtgagctcaaaacattgacagtacctctggatggcaactggagaatgggtttgacttggtttggttttctcccaggcttctactttccagagagattttaacaaattttttgtgagttctccacctcacattctaattctccatggttctgggaccagactgcccttcagccagtggtctgtgaagtgagatttgctcatcttctgtggaatagatcttgggaaactgaacttgacagcttgaatcttcctcatattatgtaaacctggggtactttgagtgccacaggatacatatgggacatctttctgaagcatcagtttccattgattctcttgagatcaagagaaaaaacattaatgtacttagggatgacagtcacataggtttctaagagtataccagacttctctctgaaatgaggcttgggttgtcctctttctgataaattcccagatttaacagaaaggctgccttctgccatgaggacacattgatataagagtttgagaggtactggtgcacttcttcacactaacagacgtgtgaggatgtatgactaaaccacatggcatacagttcctgcctacttaatgtttacttttctacctctgcctctggttttggtccctggcagctgctgattcttggtaaaaccccagagtttggagtcagaagactgagtttcaaagttcgtctgtcgcctttttcttttcttctttttttttctagccatgatatcaatctctttgagtcactaaatgattgtgacaacaccttgtacagttgttggtatcattaaatcagatggtgtataagagtattttataaaaactgtaaaggaggatgtggctgcaggggctgatagttctcatgagtattactgctcttgtttctgacagttaaaagaatattggcagagaaacagccctggtgttccagcaggagccaagaggaacaggaaaacaaatggcagcatccatgagacagccacttctggtggttgccactcacctggagatgtgagtcttggctgactaggttcctggggacaggggacccaaggggcactagagggtaattgttaagattgtggatggactgttgggtacctgtgaagaattctgggtttgaatcctgcctctttgtctgctagggatatgaattagggcaagttgctagacctcatcgggcctctcttttcacatctgtataatagaggtggtattgtttcacttccatttgtgaagtttaaatgagatttgttattgttgtttttatgttaatccctagtacatggcctgctgtaaacacccagaacacccaggatatggtcattgctgttcgattttcctcatccccagtctcaaggggaagccaggacaatgagaacagtcacttggcacaggagtcactgaaagggccacagggtgctgtggtggggagataagaaccatgagagaagttggcacaaaggagttatgggacaaagggtccaagataggcagaaaagaaaattgtgccagttgatggggaagaaaagaagtcagagggcttagatactgagtgggacagaacatcttcatgtgcactctcatctcttgtagtcagcaacaggtatccacggggagagccctacatcatctgctaccctgaaggatctggaggtaagaggctctgggcagaggtgcagtgaccctgcaggccagccctccaacctcctcctccaggtgggacggggtgcccctctgccagctgagacagtccacacacaccccagccctaatgattgctctctctacctctccccccactcctcctccacctcctcctctctgcatgcgcctcagagcccgtgccaagaactagcagtagtcccagactcgaggtccgtaaaagtcagtcaactgaagaacaccatcaaatctttggtaagagtccactggggtcccctgattccacgctgccaatcctgggctctagtttccccttggggccctgaagaaaggggacggcggcccctggtgccaagggcgaatagggagctggggcgcccaggcctcacctggagggaccccggagcatgcagcatggctctttttttgctgccctgtttgctgactctcccctctccagacgcccctgctcgagtccttgctacacacgccctgggattgttgcctcttggggaagtgctagcctgactggttgtcaggggccccgtatttctgccatgactcagtccctaatttgctctttgattctggacaagccacctctcctttttgggctcatgtttccagaggaagtagtgagtatcaaaggtctctgttagctctcgagtctgagatttaaaggcctcctagaatggaaacctcagggccaaaggctcctgtctgtccttttccgccctaaatcttctgtgaagaaccgtacttggcccgtacgtgctcagtaaatgtttattgaatgaatgcacttttctaaatcacaagctggcagaagggggggcctttctcaaactccatctctagaggtttatgttactgtcctgtcaagagattccagattcagaccttgagttctgtggctgtggacaaaagccaacaaagacccaaatcctctgtccttgggagcttgaggagagtttaccagttcgagttcccactgggtctgagaactttgcctttaaaatccattcctggcccctgcctaccacttcctgctctggggaatagagttgagggggccaccctccatcaccttaatgtgactctccccacagaaacaacagaataaacaagtggaacatcagctggaagaagtaacatgatttctttgtttgctcgcgacatgactgctcggtttgggggacactcagatgtagaggccccgagtctcgtctcacccactcccagcctggggaagaaggctcaccccccagagtccaccccatcccccacagggtccctgataacccggtcccatgggtgggcctgtcccggggcaggggcagtggtggcattctggggacatgtctcttgcagtaccatctctgcctctgcctggttagatctctgtcttcctcttcctacaggaaaagaaagcaaacaacgagaaacagaaagccgaaagggagctagaggtgagtggacggtgtgcagttttctcctgtcctccggagaatgtttctttccttctctttcagcacttgcttggcttttctcccaaaggttcaaatccagagattgaacatacagaaagggaaactaaatacggacctgtaccacacgaaacgttctctcagatactttgaaggtgggaatctgggtaccctgtcatccttcaacctggcactttgacaggtcttcagggggagtcctttgggccccatctcaactctctcattacagaagagtccaaggatctggccgtccgtctgcaacattcattgcagcgtaaaggagagttagagcgggctctctctgctgtcaccgccacacagaagaagaaggcggagagggtgagtccaaccacctgccccgtcccctgggagcctggcttcgcagacagaggagtgagcctaaaggtcccttctgcaggatggagtgtcctgcccagaaggcagcatggccatttctcactgcttttttgtatggttgttagcggcagcttgggactgagtcagctgctgtgggtgagttggggggcactctggggagagagcacaggacgtagagcttggaggccaagtgcctgccatgcctttacctggctgtggtcttggccaagtcctcagtgggtattgggtacttgtactgtgaaggtacagaagagtacctttagtatgttaccatttctgtagagagaggaaacgtgtgtgtgtgtgtacatattatgataatatacataaaatatgtttgcaagtgttcataaaaactcaggagagagcaacagggtggctgggagatacttcccttctgtaccttctgagtttgggactatgtgaatgtattatcctttcaaaaagtgaacaaaagattaattttccccttcctagctgtgcccccacccccagcaagaaaaatgggcttagagaattggatagatctgggtgtttaaatcccagctctgcctaagtgatcttaggcaagcacttaacctcaaatactccatgttttttcatctacacaatagaggtcatcatagtaactgtctcccatggtagttgcgaggattaaatgggattgctagcatggtatctggtgaagcactccataaaagttcaaacagtggtaataataacagtaataacaatagcaatattatctgatctctctgggcctctgttagccagctataaattcgatctctttccctgtcccttccaactttactgagttctttaaaaaccaaaccacgggcttggaaatgccttgatctttactgaccgagttgtatattgggcctagccctggcccttttaaggggcactgtgtggaatggcccggcctcaccagattgaaacttctcactcttcagcagttctccagccgcagtaaagcacgtatggagtggaagttagagcagtccatgcgggagcaggcactgctgaaagcgcagctgacacaggtgaggtgttcagagggagggatgtggaaggaagatgaccccaggtaaccaggagcaggtgaggaccagtgacagcccttcctaatttctgtgcccattcttgcagttgaaggagtcacttaaagaagtccagctagagagggatgaatatgctgaacatctaaaaggagagagggcccggtggcagcagaggatgagaaaaatgtcgcaggaggtgagatctgacccttcagcccccccacattagataggtcactggatctttctgggcacctgtaaaatgggaatagtagagccagaggtggtcctgggactgggctttgtggaggtgggggcagagagggagatggtagcatgtccagcctccagcccctctctccagggccctttccccctgtgctttgggcaggtttgctcgttgaagaaggagaagaagcatgataaatatcgggtagagaagctggagaggagcttgtccaaactcaaacaccagatgggtaagatggggctggcgtgacctggcagcaggactggcatcagagggctgtgagggtggcttggagtgccccagcgaggtgggtggatggaagggctttgaggcagagggaaagaggtctgtgccaggagacggcaagtcttgtcatctcaatgagcctcagtgtccccatcagcaaagagggcccgttgtcagccacccgcagtgctctttctctgaaagtgctttggaagactggctaccatctgggtgcgaggaatcattagcagtgaggctaagtttgaggagccggagaggagctgtgcgccaagaggagggttttttcttttcttttcttttttttttttttttttggaatccagaggctcttattgtctgcttcctttctcagctgaacctctgcccccggagcccccagcagtgccctctgaggtggagctgcagcacctgaggaaggaactagagagagtggcaggagagctccaggcccaggtggagtacaatcagcgcataagtctcctgaatgaggggcaaaaggagaggcttcgggagcaggaggagaggcttcaggagcagcaggagaggcttccagagcaggaggagaggcttcagcagctggccgagccacagaacagcttcaaggagctggtgcgttgccccagctggggagcctgccctcctccctagccctccaggcctttgtttccccacctataaaatggggcagtgtagccctcaagtgaaatgttactcctaaaggcacctgtgagccagagccctgctctggtggctgtgggagacaggggatgatttttctaacctgcctccacccttcccggtgccatgggaggcagtcaccaagttctggggtctccagctgcagtgggtggctgctgattgcttctctctgtccagaacaatgagaacaagagcgtactacagttggagcagcaagtaaaggagctgcaggagaagctaggcaaggtgaaggagacggtaacctccaccccatccaagaaggtctgggaggtgggtgggcaccagcctctggggaggggaggtgccaggccagcggtagctccagcccgggggcaggtgaccccagcaccctccagggcagtcctgtggctgtttcttgcttcctgccctctgattttagaggtgggtagccctgggctcctcccaggtctggacatcatcattccagctagagacatggagcccccccaatcacaggggaagagacagagtggtataacagtcttcttatgccagatgcggtggcttacgcctatagtgccaacactttgggaggctgaggcaggagaatcacttgaggtttggagtttgagatcagcctggccaacatggtaaaacctcatctctactaaaattacaaaaacaaaaaacaaaaaaagaaagaaaaattagtggggcatggtggtggcgcatgcctgtaatcccacctactcaggaggctgaggcacgagaattgcttgagcccaggaggtggaggttgcagtgagctgagattgcaccactgcactcctgcctgggccacagagtgacactctgtctcaaaacaaaacaaaaagactccttagattaaaactggattccagcctcagttccactggtcaccattcaagtacttcgcatctctaggtctctgtttctttaacttcaaaaggaagttagcattttccttacagaggtgctgaggattaaatgagataatacatgggaagcattaggcctgtagcacatttagcagatggtggttggctcccatacttttctaccattctgtggcctacagttgaaatggtgggaagaggacatgagatttgaggctggggaaggaggcatggggttctaggaaagcaaggcagtcacttaggcctgaagtaaggggccaggggcctgggcaggcgacagagccccacagtgccctcgctaccctattaatgggcccagaatctgcaaaccagccaccacgtgccctcacacccagggtcttcctgcaggtggagctgaagagccaagaggctcagagtctgcagcagcagccagaccattacctgggtcacctgcagcagtacgtggccacctatcagcagcaggtggccgcctatcagcagctgacctgtgagaaggaggcgctgtacaggcagtgactgcagcagacccagctaatgaaccagttgcagcagcaggaagcttggggcaaagcggtggccgagatggcctgccaaaagttgcaggagacccaggggagggagctgccgaggatggggctgtgagggggacgacctggcaaactctgtgccttctcactctttcctggccccttaggagcgtctggaagctgccagccagcagaaccagcagctaacggcccagttgagcctcatggctctccctggggaaggtacgggagaccgctcagaggaagaggagagagccccaggaggaaggggggactgctagcagcatagtattcaggagttggaagagacctttagaacagctggtcattatactaaccgggtgcctgcactaagttcagcatcaatatggtgacctcctgtgagcggggggccaccaagttgcctaaggatggctgaactggccgaggtcagaaagggagcaggtcagaactcccgcaccgaccagtagtgggaatgtgcctgggcagtatagcaagatcttggttcttcaaagtaaaaataaataacagcagctcattcctctctggggagggcctggctcagggttacacaatgagggtggaggcagaggtgggcccacaatacttcccttgttgagttgtctgaggacccctctggccaccacccccacccccaggagatggaggaggacatctggacagtgagggggaggaggcacctcggcccattcctagcatcccacaggacctggagagcagggaggccatggtgagcctgactccacctgaacccattttgcctccttcctctgtggtccctccaagacccctttatgctcttcgtttccctgccttctgatttctctggaccctcaccccttctgggagccagtggtcagacaccatttcacctgtgaccaacatgtgcagtctctggggccccaagggaaggggctgcgctccacctctctgccccatttgttctgtgtatgcccctgcaagaatgctcacatcttgccctcaggtggcatttttcaagtccgctggagctagtgcccaggagaagcaggcacagttacaagagcaggtgaaagagcagagggtgtgctgccagcgcctggctcacccggtggcctcggcccagaaggagccagaggcagccagaggccctggagccccagggcctgggggcgagtctgtgagtggggagacccaccgggccctgcaggaagtcacggagaagctggcccatgccggaactcacctccgccttctccatgacttgaaaatgccacctgagggcaggtcgctggcgagatgtgaccccattattttggctccagagcggctttatggaccacctggaggagaaggcagacctgagtgagctggtggagaaagaagaacttggattcttccagtactacagagagagatgccatcagtgagtgggaggccagggcatggcagggggagctgcagggctgttggaggggccccagcgtctgagccctgtcctcccgcaggaaagtttatcaccctataacaaagccagggggcagtgccaaagatgcagcaccgggaggaggacaccatcaggctggccctggacagggaggagatgaaggtagagtgtgcaacatctctgcgggggtgggggtggctgtgacggtgagcgctggcagcagcgtgacagctgagcacccctccctccaggtgaagctgctggagctgcaggagatggtgttgcagctggtggcgactacaagggacacagcaaattcttggtgactgcccagaaccctgctcatgagcccagtccaggagccccagccccccaggagcttggggctgcccacaagcatggtggtgagtagagccctcaggcggggtgggcaggcaggagcaggggggctctcactgagctcagatccccgcctccctctctccaaagatctttgtgaggtgagcctcactgacagcgtggagcctgtgcaaggagaggccagggagggttctccccacgacaaccctactgcacagccgatcgtgcaggaccaccaggagcacccaggcttgggcagcaactgctgtgtgccattcttttgctgggcttggctgccaagaagaaggagataaacatcaccatcgtcaaagagctgctgaagaaatttttaaaaaagaaacaaagttatggggttaatctcctacacaattcatttacttcgtttgaatgttatagccacttatgattatttgtgtttctaatttatagtttaagtttatttgtaaatagttaaaagagagtgggtctctgtggctttcactgatgttcactctggcatactttcgcaattttctttttcaatttcataattgtaggtcattagcatgcatattgagtttgcccttacgtggtgggagttcaaacacacaaagacccactatttgcacaaaactattcttgctggtttggaataggctgccatgtgtttttaatgttattgcagcatgtatattcattacagaattcagataaaatgtgcctatgttctgctgttgtttgatctaatcttaatcacagtgagctcttcattagcacaatatgtggtttgccccaagtgtgcactatttaatactttgtaatatgccaccaagagtactgacatttagagttgtttaaaggccgagaactggaaacagcctttccctcattttctgtgtattggtgatgggagtaataacattttgggggagctttttaaatttcacagaagaggaaagttgcctgctctggcaggtatgtgcaagatagagtgtgtttcatttgttctgttgccaagaattagtgctgtactattgtagttcctttaggatttgtatgtgctctgggctcatgaagatattgcatcatgagcttcagcagttgtactcttttttgatgacctaaaaagggcttatttctgaggaatgaaaggttcccatcattgactacggatgtggaaaacctttcctagcttagagcatttgtatctatattttaaagtcagagttcatgttacctgttttaatcacatgactgcatgtcccagtacacaaaagggcactggttggcattcttcttaatgtatttagtaaagatcagaagaaatcctttaagagttcaaatgtccctggaacaggcatacaggctctagtcaagaatgaattagagtgaaggaaagctgtgtgacacctggcattcctctgttcatggagcttctttgaggcttgaagattgattttaccatctagaccactctgcctattcttcaaccaccttggttactttgacataggaattgacttcttttccttgaatggaaaacactttgaaataataataaacattgttataaactaatatatgtgagagtgcttagttgaaacaaaaaggagttttagtagacagtattatactatctttgaaaatcaaggagaagtttatgcaacttaaaatgtgtacaaactgcagtgcaatctactgttggtgaatgtcagtgtattatcaggaaacatgtctatacaatcacagagttatatttcctcacaaacttctttgtgaagagtgaaatgtgtttctgtacctctgggtttcacttacgggcatattttgtgcagtatttatgtgattgtgcctatgcatgatgaatgaatgaatttcagttgtacattgcctaaatcataacttgatgatgcttgggaaagactcaacagttaaaacttcatgaagttctaatgtctgtgttccaaaacacatcacattattaggatgtagggagatatgtatgtgtgctccctggggtggggatttctagttactagaccatctccatttttagcatttggcatcctcatgatacttttataaatacgacattaacaggagagcagcagtacgattttgccgatggaataacagatttgccggcaatcactgaaagagtgcaaacatcgggtccttgtgacttcaacggactcttccaaattgtatgaatgtatcaatgtattagataaacccagtttcagaatgataaagaaaaaatgttagaccaaataatgcggctagttaacagtggtacgatttctcgcccgtggctttaaaatgcacttaaagtcctgtccttgccttttattttctgaacttgatgtttttgcattctttgagttcagtttaaagacaactacgagcatctgtaaccaatctgacaataatgtgttcatcaggtgcctgtggattaaatcacatactggcatatttaagctgaatgtcaatctggaaaataaattgactgtattaacggaaataccactctttgtgtagatatttgtcgtatattgaagaaaaagctaaaaagaatggaaatcgcatgactataacttaagtctttcttcaaagtgcatgcagtcttttgcgatacctcattcagccaagtattggtattcttcctcattcggtataaggcagctttcaatttgcttagagggcaacattggaaggttagagttcatcagaaacagaattctaaaatgtgagttcaattcaataaatttgaatttctgtaggaagaatcaaatcaccgatttaaagattgcaatatataataatcatttttaaagtattggattaaatctgataggttttccagaaatgaacaaaaatcagctctaaaaccaaagctgatttttagaaaatttgaaaatgtaaatcagccctatccatactatagtttctctaaaactttatctgaaagagtcattttaaaataactattaaacaatgtaactgctatcttaatgttctgaaataagttaaaacattttaaaatatgaatactgtaaaggaaataaacggtgggaaggaaaagtagagaaagaaatgccaattccagtccaaagctttatttgccaagttttcttagaatgaattttaccaatttatgaattcttgtaagcggaatgtaaaacggaaatactgaaagacttttgcctaaagtggcattattgactgctggtgtgatgctactgtaatgtaataaattattaagttgttgcaaagtgctgtttttgccttaaaattttattctgtgtgtcttcaaaaatatagtattaaaggtattgatactgtgcaaatgctgggcatgcttggcatgagataatgtttcatttttacaaaattgtaatataactatgcaagggtttattaaaagaacacaaaataaaaaagttatgggattaacaaaagttatggggtgaaaaagttatgggataaaaaatgtaaaaaagttgtggcaaaaaaatcttgtgaccaaaaagtagaagaaagttttatgaaaagttaccaaaaaaagttatgaaaaagaagttatgggatttaaaaaaaaaggcatgggataaaaataaaaattaaaattaaaagcaggcccctgtcagcaaagcctggagaagtggggccggggtctccaccaccacactgtccctatctccccttcccagtcacccctttacaattagggtagcaggacaagacctctgtctaacgaggaaagacaaacagaccctttgccaccttgaccagagctgagtccttaaatttctggatgatattgttatttaagagccagaggctggtggagttggtttgtttggaggaggcctcatggcctccttactctcaccatagcaacttttccctcagtgggggctccaatcttcttattcagagaggtagctgaggcaggacagtggggctaactgtggaccaggcgaaggcacgggctgctggggtggccccccttccccggtgtatatattgtgtctgtgtaaggttttgtatattccagagggtagggccacccctgtatcatacctagcggtggttggaggtggcacatggggaggaggttctaataattatttgtggctgggaaacttacttattgctagcataggacagaggaagaaggcagggatggggtcatggcttcccagtggtgtgatcacagttcactgcaacctccaactctcatgctcaagtgatcctcccacctcagcctcccaggtagctgggagtataagcatgcactactatgcctggctaatttttaaattttttgtagagaaaaggtcttgctatgttgcccatgctggtcttgaactcctgggctcaagcgattctcccatcttggcctcccaaagcactggggttacaggcatgagacattgctcctgtccataagattttctctttattactgttttgttgttggtggtggtgttttgttttgtttttattttttgacagagtctcggtctgttgcctaagctggagtgcagtggtgcaatctctgctcactgcaacctccgcctcctggttcaagcaattcttatgcctcagcctcccgagtacctggggttataggcataagccactgcgcctggctaatttttggatttttagtagagacagagttttgccatgttggccagattggtcttcaactcctggccttaagcaatccgccctcctcagcctcccaaagtgctgggattacaggtgtgagccactgctcctggctaagatcccatctctatttaaataaaaaaagaaaattcagaatctatggaacacagaacaccaaaggccagttatttacctctctgaggtaatctgtgtaaacaatttgatatatatcctttcaagttcatacttgctatgcatacatatatatatacacacatacattgacatattcccccttccctgctgtcatgctattagtcttcttttttttgtagaaattggaccaactctatgttctttgctggcccgtatttctcctattcagtgatgtgttatgaatatctgtttaagtcaatgtatgcaactctttaatatcattttaaaaggttacgacatacgatcatatgaaggcattagaatttattccaacagttcccttttgcacatttaataatttccattgatttgccaggaagaacattctcgtgtcatggctaaatccttttgtatggacatccttaattattcccttaagataaacttttaaataaagttgctagattagtctcgtttcttaagttcttttttggtagtttatatgtaacactgtagttttatatgtacttacaaatacctatagtgccagtagaaaatgggataaaattaaactctttcacatatgccaaatatattttgatttagcgctttattaagtgcatgattacagtctctgtatcttttgatttacctttctatctttacaattttcagccgagatacttagaggtcacatgataaattaaggttttctttttttaataatctccatctttctaaatatggtgagtcacagtcagctatttttggattgttgaaagctgtgactgttctaaatcggagcccagaaatcacgccacttaccaaatatgctttgtcttccaacatcagagtgtctggtagaaggtgactgttcttggaatttaaaaaatctgaacaggacaagacaagaatctggacactttttctgtttctgataatatgattgagtaggtagacacgctggataatccttgcaaagacatacttgaacttcccaaaaaaaaaaaaataaaatccagaatctctaagaatgaagatggagtgaaaatcagaagggctgctgagagaataatggggaagcagccccagttatcaagggacatgtccatgtgttcaatagaaagtttcagatgtaaaaaaaagttgagaaaaataatatatatattatatataataaatgatataattgccctacatatacacatcatcaacaatttttcattcatggtatggacagtttttttttttggttgctttttgtttgtttgtttgtttttaaaggtgggattttgctgtggttgcccaggctggagtgcagtggcatgatcttggctcactgcaacttccacctcccaggttcaagcgattctcctgcctcagcttcccgagtagctgggattacaggcacccggcaccacatccggctaattgttgtatttttagtagagatggcgtttcaccacgttggccaggctggtcttgaactcctgacctcaggtgatccacctgcctcggtctcccaaagtgctgagactacaggcgtgagccaccacacctggccacagccagttttgtttcatttatattcccacttcatttatatacattccttcttcctctgaattattttgaagtaaaacctatacatcctatcatttttaattaccttatatgtatctgtagaagacaaggaattcttaaaaataaatatattcacaatgccattaaatatcaaaaaattaatattctgaaaatagccacaaatccagagttgacattttgttgactttctcataggtgattttttttctagtttatctatttcaatcagataactgtttgctcatatttacattccttactgaacaatgtctaaacttaaactgacataaaatggagatgatcttctaaccagatgcttagtgtaagaaaaaacttcaaactgcaagaggagtccctccaaatacagaaaggaccagtattttaagaggtatgttaactaaaatgtggcaatgtaaggagcaaagcaggaagaacctttaagtcctaaacttacaagtcaatttcatagtcagtttccctggtccttccacaacaacctcccccatctgttttctctacaatggaggtaacaatagtagctattccagagcaggaaaaggcttagagcagtgctagaagagggtcgtggctatataaagtttagctatttgtatattgtaacaaactaactttttttggtcaataatagatttctgttggaaaagtagcagcctcctgtctggggacacctgcagttccactaagtgaacattggtgtctgctaacctttgcctctatttctctcaatatactgtgaagctgttcctggatttagcaattttatatacttctttttattattctttttttcctttcccttttcctgagacacagtcctgctctgtcacccagtctggactgcagcagcgccatcatggctcactgccacctccaccccgggctcaagcaatcctcctgcatcagccttcagagtagctgggactacccaggggggcccaccaggtctggctaatctttgtggtttttgttttgtttttccgttaagggactgggtttccggccaggcacagtgactcacgcctgcaatcgcaccacccctggaggccgaggccggcggatctccccaggtaaggagcaggagaccagcccgaccaacatggagaaaccccatctcaacctaaataaataaataaataaataaataaataaataaataaataaaagtagccaggcttggtggctcacgcccttgatcccagccactcaggaggctgaagcaggagaatcacccaaacccgggaggcggaggcccggcgagccgagaccgcgccactgcactccagcctgggcaacaagagggaaactccgtctcaaaaaaaaaaaacaggtttcaccatgttgcccaagcgggtctggatctcctaggctcaagcgatttgccacactcagccgtccaaaatcctaggatcacaagcgtgagccatgacgccaggccgatctattcctgtctgattaaaaattgggccggttgcggtggttcacgcctgcgatcccagcaccccgggaggctgaggcgggcggataacctgaggtcagattgaggccagcctgagtaacatggagaaaccccatctctaccaaaaaaaaaaaaaaaaaattagcagggcatggtggctcacgcttgcaatcccagccactcgggaggctgagccaggagaaccacccaaacccgggaggctgaggctgcggggagctgagaccctgccactgcactccagcctgggcaacaagagtgaaactccctctcaaaaaaaaaaaaagagagagagagagagactgagtttcaccatgttgcccaggccggcgtgtaactcctaggctcaagggatccgccgcgctcggccatcggaagtcctgggatcacaagcatgagccgccacgccaggcccatctgttcctttctgattaataaattgcgcccggcgcggtggctccctcctgcaaccccaccaccctgggaggccgaggcgggcggatcacctgaggtcgggagtttgagaccagcctgaccaacatggagaaacccgtctctaccaaaaaagaaaaaaaaataagctgggcatggtggctcacgcctgcaatcccaccaccccgggaggccgaagcagacgggtaatctgaggtcaggagtttgagactaccctgacgaagggagaaaccccgtctataccaaaaaaaaaaaaaaaatacaaaaagagccaggcatgttggctcatgcctgcaatctcagccacttggtaagctgaggcaggagaaccacccaaatccgggaagcggaggcagcggggagctgagaccgcgccactgcactccaaccgggcaacaagagtgaaactgccgcaaaaaaaaaaaaaaaaaaaaaaaaaaaaaaagagagagcgggtttcaccgtgttgccccggcctgtctggaattcctaggctcaagggatccccggccctattcctttctgatttatagattaggccttgcgcgctggctcacgcttgcaatcccagcacctccggacgccgaggcgggcggataacctgaggtgggaagtttgagaccagccttatgaacatggagaaaccccatctccaacaataaaaacaaaaacaaacaaaaaacaaaatgagctgggcatggtggctcacgcgtgcaatcccagccactcgggaggctgtggcaggagaaccacccaaaccctggaggcggaggcccgttgagccaagacctcaccactgcactccagcctgggcaacaagagcgaatctccgcctcaaaacaaacaaaaagtgaccaggtttcaccatgttacccaggcaggtctggaactcctaggctcaagcgatccgccgcgcttgccgtccaaattcctgggatcacaagcgtgagccaccatgccaggccgatctagtcctttatgattaataaactggaccgggcgcgctggctcacgcctgcaatcccagcatccccagaggccgaggaggcgggcagataacctgaggtcgggagtttgagaccagcctgatgaatatggagaaaccctgcctgtaccccccccgccaaaaaaaagagagaccgggtttcaccatgttgcccaagccggtgtggaactcctaggctcaagtgatccccagcgctcggccgtccgacgtcctgggatcacaagcgtgaaccaccacgccaggctgatctattcttttctgattaatcaattgggccttgcgcgctggctcacgcctgcaatcccagcatccccggaagccaaggcaggcggataacctgaggtcctgagtttgagaccagcctgaccaacagggagaaaccctgtgtgtaccaaaaaaaaaaaaaaagaaaattagccgggcatggtggctcacacctgcaatctcagccactagggaggctgaggcaggagaaccacccaaacccaagaggtggaggtggcagggagccgagactgcaccactgcactccagcctgggcaacaagagcaaaactctgcctccaaaaaaacaaaaaaaagagagagaccgagttccaccatgttgcccaggccagtctggatctcctaggctcaagtgatccccagtgctccatcatccaaagtccctggatcacaagcgtgagccaccacgccaggccgatctattcctctctgattaataaattaggcggggtgcagtggctcacacctgcagtcctgtagagggatttttaaggaattagatagactcatggggtttaggaggacatttattaattatttaggtgcaccggcccagtcggattaacatttaaaggattgagcactgaaccaagagttacctttcaagcattatgtggggcgaagggggagatctgtgcagggagaagcatattatagaagcgagaaacaaagattgttatttaattgaaacatgcattatattattttttactatttaaggaaaaatatgttttgtgacttgagtttatttgtttagtgaccttgtagttgcacagttaaggaattagtcgggcatggtggctcacaccgcaatcccagccactcgggaggctttggcaggagaaccacccaaaccccggagacggaggtctggcaagctgagacctcgccactgcactccagcctggacagcaagagcaaatttccccctaaaaaaaaatatatatatatgactgggtttcaccatgttgtccaggccggtctggaactcctaggctcaagcaatctggctctggatgtctttaacttgtgattgaaagcgtattaagatgttgggtgtatcaacagtccggaggacaagaaggaaaatcctggcatgtgaaatattctgcaacaagaaaagcaatcggagaggtgactacattcactgcagctgttttgccctcttcttccccacccgccccccccgtctctttcctggaagttccctagtaagaagtaaaagagataatggctttcgagtgcatgtttttcctggaattggaaggaattttaacaaaggagcccttcacaatgaaacccccccacacccctgcttttcacctgaagtaggacaagatcgtcgcccccaccatcattctccacgtgaccccaggtggggatgggtagtggacactactgataagctcttagcaatttccctatttgtggactctgaagctccttagcttgacaactgatgcataagttttcttttgtgggataagaataggagaataggtgaccttttccccctgaattcccatcctggggccagggaagagagcccaggatcccttctcttggccttcacactgtgggaaagagtacctagagttaaaagcctgataaatgccctcgaacagctttgaaaatcacaaggtcaggagatcgaggccatcctgcctaacacggtcaaacccgtctctactaaaaaaaaaaaaaaaaaatacaaaaaattagccgggcatggtggtgggcgcctgtagtcccagctaccggggaggctgaggcaggagaatggtgtgaacccgggagggggaccttgcagtgagctgagatcgaaccactgcactccagcctgggcgacagagcgagactcagtcttaaaaacaaacaaacaaaaaaaaaaaaaaagaaaagaaaagaaaaaagaaaatcactcggcgtgagcgcttgccccctgaacaaatgtccaagtgtatcactatgggaatgcctcttgggtcacagacacagaggtaattctctttgtaaatagattcatgtcatttgtctcgtttctgaacagtttcaaaagaattatttggtgaagtcagtttcctaggagaatccatcacatttccccagaggtatttccacccttgcaaaccattagataaagaacaggtcacgcacagtggctcacacctgtaatcccagcactttgagaggccaggcgggtggatcatgaggttagcggatcgagaccatcctggctaacagtgtgaaaccccgtctctactaaaaatacaaacaattagccaggtgtggtggcaggtgcctgtagtcctagttactcaggaggctgaggcaggagaatggcatgaacctcggagacggagcttgcagtgagccaagattgcgctactgcactccagcctgggcgacagagtgagactttgtctaaaaaaataaaaaaacaaaaacacgtaaagaacaaattagtcctcgtggtaggccacccccaccccatctccagttcaccacttcaatcatacgactttctcagtggacttgaagccaagctttcacatcagagccctccaaccaagagcctgactgtataactcctaagaacaatcaagtaagaatgtttttctttccattcctcacatctggtatctgttgccttgtgaatagggtgcccatcagcaggaagggttagaactagggtaagtgtgtagggagcaaggcttgaaaagaaacagatgaggaaagagtagcaaaatcaagactgtcccaggaagtgagtgtcagtcaaaggttttgaaatccctcaaatagttacttctgctgtcttggttttgtccacctcccttcttttttcacatacctgccaccctaaaaagtaatacctatgcctaacatagagctaaccagttaaagaactgctagtaactttagaaaagagtccctttcccatcagaatcagaacaaaatctttttaaaaaaattatttttggccaggcatggttgttcacacctgtaatcccggcactttggggggctgaggtgggcggatcacttgaggtcaggagttcaagaccagcctaaccaacatggtgaaaccatgtctctgctaaaaatacaaaaatcagccgggtgtagtggcatatgcctgtaatcccagctactcgggaggctgaggcatgagaatcacttgaacctggaggcagagggtgcagtgagccaatatcgtgccactgcactccagcctgggtgacacagcgagactctgtctcaaaaaaaaaacaaaaacatatatatatatatatatatataaatatatatatatataaatatatatacatataattttttcaggcaggggcaatggcttatgcctgcaattttaacactttgggaggcagaggtgggaggatcattttacctaggagtttgagaccagcctgggcaacatagtgagatcttgtctctacaaaaacagttttagtcaggcgtggtggtgcatacctgtagccccagctacttaggaggctggggcaggagaatcctgctgctgcattttgtgctacttttaaaaatatttggtaaaattcaggagtaaagccgtcgggtcttgggcttttctttcccgggaaacttttttttattttttgagagggcgtctcgctctgtcgcccaggctggagtgcagtggcctgatctcgactcacttgcaggctccgcccctcaggttcacgccattctcctacctcagcctcctgagtagctgggactagaggcacccgccaccatgcccagctaattttttttttttttgtattttttttagtagagacggggtttgaccgtgttagccaggatggtctccatctcctgacctcgtgatccgcccgcctcggcttcccaaagtgctgggattacacgcgtgagccactgcacccggcttttcctgggaaaattgtttccgtctcactacttattggtcttttcaggttttggatttctttgtggttcattcttgctaggttgtatgtatctaggaaagtatccatttattctagattttctaatttattggtctatagttgctcatactagcctctaatgatccttagaatttctacagtatcaatgaaaatgtccccattttcatcttgattttatttatttagggttttttgtttttttttagtgtggctaaaggttactggtttggtttatcttttttaaaaaacgaacttttcgttttgttcatattttgtattttttcatttcaatttcattaatttttgctcttatctttattctttcctttcttctatacttattttgggtctggtttattcttgcttttctagttcttttaagatgtatcggcgccacgggccccgcagagccagggcggctcccgccggtagcctgtgtgtgggccccggccagccgcgcccccagtccatatcgcccttcactgccccgaggctggcgcggctatggggcgcggggccggcgctgctctggggcgttggagccgcgcgccgctggaggagctgctgccggggcgggggtctgggcggctcggggggccacgcgggcctcggacggctcccggggctgtgggcttgggcccggcagctgcaggtgcggggctcttgccggccgggcgctcctcggctcccgcgcgccgggttcccgggcggtcccaccgccactgcctgggcaggggaggaggcctggcggcgcgggcgggcggcgccttcccgggacgaccagcggctacgacccatggcgcccggactctcggaggccgggaagctcctggggctggagtaccctgagcgccagaggctggcagctgcggttggatttctccgatgtccggtgttatctccatgtctgcccctttcttcctggggaagatcatcgatgccatctataccaaccccactgtggactacagcgacaacctgacccgcctctgccttggcctcagtggcgtgtttctgtgtggtgctgccgccaatgccattcgtgtctacctcatgcaaacttcaggtcagcgcgttgtgaagaggctgagaacttcgttattctccattctgaagcaggaggttgctttctttgacaaggctggcacaggggaattgattaaccgcctctcatcggacactgcactcctggggcgctcagtgactgaaaacctctcagatgggctcagggccggggcccgggcttctataggcatcaggatgatgttttgtgtctcacctaatcgggccacctttgttgtgagcgtggtgcctctagtgtcaatcattgatgtaatttatggacgatatctacggaaactgaccaaagtcacccaggattcgctggcacaagccactcaggaggaacgtattggaaatgttaagaactgttcgagcttttgggaaagaaatgactgaaatagaaaaataggccagcaaagtggaccatgtgatgtagtcagcaaggaaagaggcattcgctcaggctggcttctttggagaactaggctgtccggaaacctgattgtgctttctgaacctgtacaaaggggggctgctgatgggcagtgcccacatgaccatgggtgaactctctcccttcctatgtatgctttcggggttggaataagcattggaggtctgagctctttctactcggagctgatgaaaggactgggtgccggggggcgcctctgggagctcctggagagagagcccaatctgccttttaaggagggggaagggttatcttaaatgagaaaagcttccagggtgctttggagtttaagaacgtgcattttgccgatcccgcttgcccagaggcgcccatatttcaggatttcagcctttccattccgtcaggatctgtcacggcactggttggcccaggtggttctggcaaatcaacagtgctttcgctcctgctgaggttgttcgaccctgcttctggaactatcagtcttgatggccatgacatccgtcagctaaacccagtgtggctgagatccaagattgggacagtgagacaggaacccattttgttttcttgctctatcactgagaacattgcttatggtgctgatggccttcctctgtgaccgctgagcaagtccagagagtggctgaagtggccaatgcagtggtcttgatccggaatttcccccaagggttcaacactgtggttggagaaaagggtgttctcctctcaggtgggcagaaacagcggattgcaattgcccgtgctctgctgaagaatcccaaagttcttctcctagtgaagcaaccagtgcgctggatgctgaaaatgagtaccttgttcaagaagctctagatccactgatggatggaagaacagcgttagttattgcccatcatctctccaccattaagaatgctaatatggttgctgttcttgaccaaggaaaaattactgaatatggaaaacatgaagagctgctttcaaaaccaaatgggatatacagaaaactaatgaacaagcaaagttttatttcagcctaaggaaacaattactggtaaacaacatgagagactttaatgcaaaacagtattgtagaaaaaaaaaacacctcagagactgcatgaaatatgtaaaccatatatcaagttatttgaaaaatagctattttttccaaagcgtgtaaaatattgctttgaaatgtacctgttctcaagatctttttattcagagttttaaccattgtaactttttaaatgtctgtagcactgaagttattttcaggttttgtattttctttcattgtggaatattttaattaatatagcatggcacctcattttcttttgcctgctgttaaagatggaagctgttgtcaaatgacaactttaaaaagggaagtataaataaaaagcctgattattttaggccagtttgccaatcactgtgtaattcctctggtagtattctacctactttaagtctaattttactagatagagtaatggaaaatgaaaatctaaccctttattccgataatctcatgaagcaaacctaactatttaacatcagctggaaagaagggaacatttatattgcccgtctcctgtgtcttcaaaggtgtgagagttgaggaatatgtgttcctacgggaactatgtttgaatatgtgcagttttcaacattttggcaaatgaaagcctgacaagtttttaaaagggcagaagctttattttttgaacagaaaaatctattttttaaattcacatgtttgtatgagtacttctgggaagcaagggatgaactgctaggtattattaagaacgaatgatttttgcatttaagttgtttgaaggcatgtattttgaaaaatatctgttacaaatttataatttcaagacatactaaatcttataatacttttggaatttcattaataaggctaaaatctgaggaatgtaactaattttcagccttaagacacttaagtttggaagtccttgctattcaacagaataacaagaaaccttcagaatgtatcactctcccaaaaagaagatattaataagcccttttcttttattcatggttatagtttttttatagtctcaaaattcctaaagcaatgctgacagccattgaatttgccatattttgtattcagtgctgttaatgtgctgttgcctcaagaaaaagtgctttttctccattgatgaggctagaccctaagaggtaattaagtcaatgtaaatcaaatggaagttttgccatgaactaagcatttattagttccctgattagactggaagaagaaaccgctatttcatgacaagcatggaatattatattttcttcttcataattaatgaataaaattgatatgagcgaatgaatgtagtattttttgaattagtaaacagtacatctgtgacaatcattttaacaagctctacttgtgttctttataaagtgtgattttcagaaagcaaacaaaacacaattaaaaggttgaatctgaggaaaataatgcttgtaccatagaagtatttacaaaattgcatttcattgttatgttttattttctgatacctgatgttcaattatatctgtaggtaatattttatatcatagattaaaatttatagtgaccttaaaaaaagatgtatcatcaggttatttatttgaggtttttcacttttttgatcttggaaattataggtatacatttccctcttactactgctttttgctgtatcccataggttttggtatgttgtgttgccgtttttatctgcttcaataaatttttcaatttcttctgaatttctttgttgaaattgtaaggatcattagaggctactgtgagcaaccataggccagaaattagaaaacctagactatatggatacatatagatacagaaaaattcacattatgaatttgttctcaaataagctttggtaatttgtctctttaaagaactttaagctgccaaattcttgagtatggaattgttcataatagttattatcatttaaatatagaggttctgtaatgatatttcttcttttatcagtccttttttcttagtcttactagtatgtaacaactttactgattttttcaaaggaacttttcactttgtgaatttatttactttcaatttcatttatttctttcattacctgttattttattttttcaaattacgttttatttgtttattttttcattgacttttaaacctacgtatttttctaatacaagaatttcaaataataaattaccctctcaatttaactctacaccacaaatatgaagcttttattatcataattttgttttattttatttttttaattggcacataataattgtgcatatttatgggtacatagtgatgtttcaatactcatagtgtatatatttaattaccctgatgaggtgatggtaattagcatatccatcattgcaaacatttatcatttctttgttttgggaacattcaatatcctttgctaactatttgaagctatatgttattgttaactattgtcataccataatggtatagagcattagaacttattcctcctatctagctttaattttgaatcttttaacaaatctctccctatccctcccttcctcttatactttccagcctctagcatcctctgttttaacttctataagatcaaaatattttagcttccacatatgagtgagaagctgtaatgtttaactttctcttcttggctcatttcactcacataatacactccatttctatgcacgttgcttttatggccgaatagtacttcattgtgtatctattccttttcccctcctgtcccctcccttcccctcctctcccctcccctctccttcctttcccttcttgagatggagtcttgctctggagtgcaatggtgtgatcttggctcactgtaacctctgcctctcggattcaagtgatcttccacctcagcctcccgagtagctggggacgtgccaccatgcccagctaatttttatatttgtagtagagatggggtttcaccatgttggccaggctagtctcgaactcctgacctccagtgatccacccatcttggccttccaaagtgctgggattgcaggcgtgagccaccgtgcccggcctatataccacattttctttaaccatcatctgttgctggacccttaggttgattccatatcttgcctattgtgaatagtgctgcaataaacatctaggtgcagatgtttatttaatacactgttttccttatttcatattttttctaaattatcttttgatttcttttatgaactatgagttaaatagtgtttcatgttatttacaactatttgggggtttcctaggaatctcttatgtcatcaatttcaaattaaattttattgtgatcagagaatatattctataaaatctaaagcttaaattcatttaaacttactttttgattcagcatttggcctatgttggtggtgctttcaatacacaagaaaacaatgtatattcagcatttgaaatgtagtttttataaatgtcaataagatcaaggtgatttataatgaagttgaaatgttctatagccatacgaatggtttgtcttactgttcaatcagtgatgaacagagggatgttaaaatctttaattattattgtcatttatccatttctcccttcaattctgctttttccttcatgaattatgaggctttgttattaagttggtgtccctttcataattatgaaatgggggcatttcataattatggacatctatgtcatattaggacaataatgtaataaccaattcatcagaggacaataatataagcaatattattgtcctctgatgaattggttatttcataattatgaaatgcccccattttctcttataatgcaccctcttttccagtctacattgcattttgctaatatagccacacaagcttcctaatgcttgctgtgtatatggtttatcttttcttgtaggtttacttttcatctatctgtgtctttatgtttaatatatgcttctggtagacaacattagttgggtctcattcttttgtctaatatgacagtctctaccttgtaattgaataatttagttcataaatatgttaaatgaaatgtgttgccacttttaaaaactgtacaatctcttgtttctcttctcgtatttttgtttaattgtattttaagtattcattttaaattgcatagatgagttagttgcaacgcttttttgtattgagttatttgtattacaataatcatcaatttatacttaactaatctaaattttacttagaggtaatttttgacaacttcatatataatgtaaaaaactgatgacatctgttctatttttacattctctccagtgattgatagtgttgcctactttgtcaaatcaaaacaaggcaacattttcctaaaaagtgatctgtgctccacctatcctattcatatgcacagaagactttcagggcagaaaactattctgcatgatactacactggtatatgaatttgcctaaactcatagaatgtatgacagcaagcgtggaccctaatataactatggaccttggtgataaggatgtgccagtgcaggttcatcagcggtaagtaatgtgccactccagaggagaatgacagcaaggggtcaggctgtgcctgtgtggacacaatgatgtatgagaaatctttgtatctttctttcaattttgctgtgaacttacaactgccctaaaaataaagtctattaaaaaaacccaaaacaacaacaacaaaaactgatgatggtaacatttcctttactccccctctgtcttttgtgattttttttagtataagtttttctatccacatcataaagcccacaataaaatgatatctttttaaatttaaatagtcagtttcccttcaacaaaatcgacagattaaaaaaaagtatttcctgttactcatatacttaccatttctatgcttttcatttcctctaatctggagtttagattcgatgttatttcccttcaggccagaaaacttctgctagcatgttttgtagtacagatttgctggtgacaaattggcccatttaatttttccgaaaatgtcttaattttaccttcaactttgaaagatactttaataatatatagaaacgaacctgatgctctgtcatctccaaatactttagtagactgattctcaaccagggggagttttgccctccaggaaacatctgataatatctcaagatatttttagttgttagcctgggcaaaggtgtgaggaggatgctactgtcatttagttattaaaggcaaaccaagtcgctaaacatcctgcaattcacaggaaatgcccccaacaaagaattatgtggcccaaatgtcagaagcgatagtgccaaagttgaaaaaccttgctttcatatatattttctacaaacacaattgtgtctatatatgtatatacatatatataattctatatgttacaaatctattacagtaatatatgtgcccccccaaatgcaatacacgcacagtacaacgaacaaaaccagaaaattaatattaatatattgctacatctaattatcaagtccgcattaaaatttcaccaatagtcagccgggcacggtggctcacgcctgtaatcccagcactttgggaggccgaggcggatgggtcacgaggtcaggcgatcaagaccatcctggctaacagggtgaaaccccgtctctactaaaaatacaaaaaaaaaaaggaaaaaattagccgggtgtggtggtgggtgcctgtagtcccagctactcgggaggctgaggcaggagaatggcgtgaacctaggaggcgaggcttgcagtgagcccagactgcgccactgcactccaggctgggcgacagaccgagaccccgtctcaaaaaaaaaaaaaaatttttcaccaatagtcccaataatgtttcatagcaaaaggatcaagttcagaatcatgcattgcctttcattgtcatgtctttttaatgtccttgtatcaagaatagatctttagacctaacttaaccaagatttctggcccatattttcttctttttttcctttgctttgcttctccttccttttctcctttcctttctccttcgctttccccttcctttttctcttccctctccccttcccttccccctccccttccttctccttttctctttcccttactttttccttttcccttccttcttttttgaatggctccctttaggttttctgaggtttccttgtgactagagtcaggcaatgcattttggcaagaatatcacagaattgatgctgcgtttttttcattgcatcctatcaggtggtacatgattccagtttgtctcactactgacaatgtttattttgacaggttgataatggtggtatatagtaggcttctatcttgttattctctatttctagattctgttactttattttatgttgtttttcctaaagggtaataggaattctctctgtttctttgtttttgtttatttccctatttttattccttactatacttttagtacatagtacctagtgcaaaatactaatatatgttgaacaccaacagttgttgaacaaatgtctgaaactgactctgtcctgctaccacaaaaacatatatatatatatttttttcctatagggataccatcaactctacatagttgtctaagccaagacctcctgctaggactgattaaagcccgtgcatcctcattatccagagcctgtgttgctcctctagagctatagccaggctaaccattccttctggttaatatctgaaaggaagaatcatgcagcaagaagagaactgtgagggaataaaaatggcacaaacccagcctggatttctctctccccttttaatgatgaatgaatgaaaaaaattcatcattagctgtagttagtttctattacataaaaaggaagctgatgaaacatataactgagttatatacccacatccaattggttctgtttctctggagaactctattaaagaagttattgagtattgtttacatgtacactgacaaatatgtctaaaggttatgtctgaacacctataaatttatatcaatgattctatatagttcattcttattacacttgattctaattcttatgaagttgatgtttggtagaatgaatgataaaaggagattctgtcccctattgaagtgtttgtgtagttacacgccagagttttggagattgaggaaaaggttgagcttaaataattttatgggcaaactcaatgcttgaatgtaagatagtactttgaaagatttggaggatttcataatgacttttacttttgctaattattgatacagtcacttgtaaataagtttacttaggtaagctcaaggaaatcatgctttttctcaggcttattttaaatctgaatatttttactgtctttgcttttacaagaaaatattcatcattgtattttttgtcttaattttcaaagtcaaatgttaattgtttttgtgggattactttggcaaatatgggagatccccaaacaaattttaaaaagttttttcggccgggcgctgtggctcacgcctgcaatcccagcactttgggaggctgaggcgggcggatcacgaggtcaggaggtcaagaccatcctggctaacacagtgaaaccacgtctctactaaaaatacaaaaaaattagccggacgtggtggcgggcgcctgtagtcccagctactctggaggctgaggcaggagaacggcgtgaacccgggaggcagagcttgcagtgagctgagatcgtgccactgcactccagcctgggcgacagagcgagattctgtctcaaaaaaaaaaaaaaaaaaaaaaaagttgtttctgttctcctttgttttctactttctcttaaatagaaatatatttcttgtacaaataaatgccatgaattaaaaaaataataaattatgattttccttcgtgaggatcagttctcctagacattggtttagctaatgccagctatttggtataaaaatctgtatcagtggagaggtaaaaaagagctaaaggaagcataagaaagacaaccgcatctttaggaagttcctctttttcttttcttttttttttttttttttgagacggagtcttgctttgttccccattgttccccaggctggagtgcagcggcgcgatttctgctcagtgcaaactccgcctcccgggttcacgccattctcctgcctcagcctcccgtgcagctgggactacaagtgcccgctgcggcgcccagctaattttttgtatctttagtagagacggggtttcactgtgttaaccaggatggtctcgatctcctgacctcgtgatccacccgcctcggcctcccaaagtgctgggattacaggcgtgagccacagcacccggccaagaaggttctcttaaaaggaatcacttcttgttttcttacaagttataacctcactaccctagagtcacattttttaataacttatgaattttctgaaacttcaaataccctatggccccatggtaaaacatcagatgacatttgcctctcatttaaaccatttttcttttcctctttcttctttatttttcttatactctctcctcatttctttttctctcttcctatttctctttttctctctgcttcttcctacctcccctcgtgactttgtctcctcatcccatcaccgtgctacttagatgccacatcaatttgactagcctcaaatttacaatgaatactttttaaattcatgcttctgaaacttttaaaggatgaagaggtataaatgtctcacataataatttgtttgatggctgaaatgaatggcatttctcaaaaaggccaagggactgaatacagaaatttaaacaataactttccgttagtgatacggtttggatgttttgtcccctccaaatctcatgttgaaatgcgacctccagtgttggaggtgggcctagtaataggtgtttgtttcccaagggtggatccccatgaatggttttgtgctgtcctcctggtaatgagtgagttcttgctctatgaattcacgagagatcttgttgtttaaaagagcctggcatctcccttgctccctctctccccatgtaatatgccagctccccctttgccttaagccatgattgtcagcttcccgggcctcagcagaagctgagcagatactggtggcctgtttgtacagcctgcagaccatcagccaaatactcctcttttctttataaattacccagtctcaggtattcctttatagcattgagatggactaacatagtcagttttgacaacatgaacctttcatattaaaatttaatttctaaattcactcatttactgtgattggtttatagcttttctgtaataatgaatcttacgtgtgactttcaatgtgctttaaaacttgattcactttttagctctatttttggaaactaccagcttccactgttgaggcaaaagtgtcatcattgaggctctcctgctgaggtagctgttgtctgatttcccttcagttctactgctgtcccagtggaaaaagggaatcttcaccacttacatgacatgtttgcctgaactctaatcttccacacttgctgtagaaaagagtaaagtggcagttcagggcagtttaccaatttagaaatggtgtccgctcagtattttcctctgtgtcacttactaaaacatataaaagaaaccatggacattaaaagaaagagagaggtttaatgtgatattttaattctaacaaggatttatgggcacatgaatgctcaaaatcacatacccccttagtgtttttcatctcacacatatcacatcagatacatatcacacatttcaggcacatatcacacagaacttaccgtaattaaattatcagtttttgaaaaatattatcatttgctctctttttttctatataaataaatttttttaaaatatgattttcagttctgggatacatgcacggaacatgcaggtttgttatataggtatacatgtgccatataggtggtttcttatttgtgttttcatcttatggctttggctagaactagataataaaagtatgcatcaatttaagagttatttttaatcatggtaaggacatatctataactactttgttaaatttcatcagtcatgcatgttaaatatcattaaataaatatcaaaaatgggctgctgtaccagaataccatagacttggtggcttataaacaacagaaaggaatttctcacagttctggggtctgggaaatctaagaccaaggtactagccaatctggtgtctgggaaaaacttttgttctagttcaaagaaggctgccctttctctataacctcagttggggaaggagcaagggagttcagggggctgctttagaagggtgctaaacccattaatgagggctgctctctcatgacttaattagttcccaaaagccccaccttcaaaaaccctcacattggcggttagcatttcaacatatgaatttgagagggatgtaaacatttagtctgtagcagtaaatgtacaatataaagtaaatagctttattgttgtgttgcattatattaatatatattttctagtattaaatctttgtatgccaaatcactggggtgggtgatttcttagtaagtgtagaattcagttcctttttctttcagttaagaatattttaactatgtttataagggatactgtttagtaattttattctttttgtattcacttcatcaagagttagtaatagttatatttgctttgtaaaatgaactgaaaggaagccactttttataactttatccatatttcctagtttggggtccattttacaagatgttttaaacagatgcttattaaaaacactggttatagggactttaataaaaatttttaaaataatgttttacatttcttgcaaaaattgatgcctgcaacctatttactgtttttaaaattaaattaagattcatttaagcagtacatgtttattttagtgaaacacgtatttaattttctaagatagtattttttgtctttaaaacaatttctgcatgttttgtttttttttcactttaaattttatgttttctcagtttttgttttatcacatttgctatatttttctgtatcatgggttatttgttaaagaatgaacttgtgtatgtttataaattgttactgtttttgtttataatttattgccttctaacttaatatgtaattagcattccttttaattttgcttgtatgctttgctgtaccattttgaaattcttgagttaaatgcttaactagtttttatcaagtttaaatattaaattaaatatgtcccatcagtttagtcattttaatattctcactcatcagacattttttgggaacaccatatgccttttcatgcagtcagtttcaagaaaatgaaaattactttttatatgtttatactcaaagcttggctagagataagtctccccttccttaagttggggagaaagtgatttcttccaggctatagtcaaaagagatacaattatagtaactttttgtgtttgtttgggttgtttctgtttgtttgtttgtttgtttgtttgagacggaggttggatcttgttgcccaggctggagtgtagtggcataatctcagctcactgcaacctccgcctcctgggttcaagcaattctaaacatattttagcacaaaactgtttaagatttcaatttatatctttttattatgttccatatactcttttgatacattacccattatgttgattattaacgtacactcaagtcaagatcttttattatgtgaggtcatcagtcaatgataacagatattgatgaattagtctcctcatcagaaattgagcaacattttcattcaagacgacacatgggcctttaaagcatattcaataatactgagtctcagtcttctcctgctattttctgaatgtgcatttagacctttatacatctatctatctactgacccatttattaaattttcagcatttactttgtactccaaggaccagaaccatgtttgtcttgttcactgctgtactcctattgcaaggacctagaacatagtaggagctcattaaaccctgaggattcaaaataagtgaatagaggttgtagcaggaagaagtctaagatagcccctatgaccttcattacctcatgttaccctgttgatacctcacacggcaaaggagtcttgcacatgtcactaaggctaataatccgtcagtcttaagacggggggagtatctgggtaaacctaacctaatcacaccaaaacttcacaatcagggagttttctacaactgagagtagaatgggaagtcagagagtttcagagtccaagaagcatttatagcacccttattgactttgaagatgctttgcttcttcttttgagttcagtttgagattatctttctaataattgattagattttattcttgtaaaaaaagagataatttaaaggaatctatttttaaatactctgaggagggtgatactaggggtgctggttgtcctgttttaactttgtcttaatttctaatgtaattaaattttgagtaggtaatgtgacctgtgtggtttttattttaaaaaatatattgaggttttatataatctatttttaaaattttcaatggaaacttgaaaaaatactgtttcacatattctcgtatatatatattaaaaatctttttttatttattttttatttttatttttttttgagacggagtctcgctctgtcgcccaggctggagtgcagtggcgccatctgggctcactgcaagctccgcctcctgggttcacgccattctcctgcctcagcctcccgagtagctgggactgcaggcacccaccaccacgcccagctacttttttgtatttttagtggagacagagtttcaccgtgttagccaggatggtctcgatttcctgacctcgtgatccgcccgcctcagcctcccaaagtgctgggattacaggcgtgagccacttagcccggcctaattatttgttttttaaaagacggtacataggaagaagtaaatcaggaaaagtggatagtgattggtggcagtagaagtgagtcagtgttacagttactattgctgcttaagaaacttccccaaatggcctgggcgccgtggctcacgcctgtaatcccagcagtttgggaggctgagacgggcggatcatgagttcaggagatcgagaccatcctgcctaatacggtgaaactctgtctctactaaaaatacaaaagttagcctggcctggtggtggtgggcgccttaagtcccagctactcgggaggctgaggcaggagaatggcgtgaacccgggaggcggagcttgctgtgagccgagatcgcgccactgcagtccagcctgggcgacagagggagactccgtctcaaaaaaaaaaaaatttaaaaaaagaaaaagaaaaaagaaactaccctaaatttaataaggtaaaacaacgaccacttcattatatctcatggatcctataggtgagaaattccagcaggattcatctgagtgattcttcctctctcacatcattaactagggtgactcagtgctagtcggctggcaaacaagtcagtctggaaggtgcaaggtgctttttttctgtcttataaattgatggagttgtctggaaggcaaggctcagatgggaaggactcttagttatagtgcctgcacagggtaaacttttttttttttcttttttttttgagacggagtctcactgtcccccaggctggagtggtgtgacccgatctcggctaactgcaaactccgcctcccgggttcacgccattctcctgcctcagcctcccgagtagctgggactacaggcgcccaccaccaggcccggctaattttttgtatttttagtagagacggggtttcaccgtgttagccaggatggtctcgatctcctgacctcgtgatccacccgccttggcctcccaaagtgctgggattacaggcctgagccaccgcgcccggcctgcacagggtaaacttcttatatggctgctggctttccgcagatcaaacactccaagggaaccaggtggaaaatgcctggtctctttttatctcactttaaaggtcaggtagaattatttgtcatactctattgattgtagcagtcacaagcacgtccagatttagggaagggagacatagacctattttttgatgagaagaatatcaacctgtttttggactatgtttaaaactgccacacatgacaattacacaccaggtagaaggcatttggggacagacttgaaggaaatgaggaggaatcgtgctctgctgaaacaagagcattccaaagagagaccacagcttgggcaaaagccctgagtcggaatcatgtggacttattcttagaacagcatcgaggaagccattatagctggagtagaatgagaagggggaagagtattagtagatggtggcagagaaataaacatgagaagacggatgatggaacgagcaccttgtacgtcattttaaggactttggctgttcctcaaactgacatgggaccattgaaagatttttttattttttattttttaaatttaacttttaagttcagtggtacacgtgcaggtttgttatgtaggtaaacttgtgtcatgggggtttgttgtacggattattctgttacccacatggtaaacctgctacccactagttgtttttcctgatcctctccctcctcccagctttcaccctccttttcaaaataagacatacgtgcagccaacaaacgtagaaaaaaagctcagcatcactgatcattaaagaaatgcacatcagaagtacaatgagatactatctcacaccattcagaatggttattattaaaaagctaaaaaataacatgctggcaatattgtggagaaaaggcaacatttctacactgttggtgggagtgtaaattagttcagccattgtggaagacagtgtggtgattcctcaaacacctaaaagaactaccattcgacccggcaatcctattactgggtatacacccaaaggaatataaattgttctgtcataaagacacatgcatgcatatgtttattgcagcgctattcacagtagcaaaggcatggaatcaacataaatgcccatcaatggtagactggataaagaaaatgtggtatatatacaccatggcatattatgccaccataaaagatgagatcacaccctttgtaggaacatggatggagctggaagccattatccttagccaactaatgcaggaacagaaaaccaaatgttcccacttagaagcgagagtcaaaggggagaatacatgaacacgtagaggggaacaacattgaaagatataagcaaagaagtgatatcatctgaattgcatttctgagatttctctggcacttgtgtaaaaaatagctgaaaggaatcaacggcagaagctgggagaccagttagggagcttttgcaataaccataagaggaaatatgtgtggcttagactaggaatcgtcaggttgggagtgctcatattcaaatgtggtcagaatccggacattttgagtgagcctacagaaagctttaatactgtctcaaactaaaggatatagaaggttttccctttctcttgccctgaaaccttctgtatcctttattttgagatagtattagaattcttactatcttactgacaattctcactatcttgttttataacttggaacatgattataattatagtattgttaaatattttatttttattttataattatactttaaaaatattattttggtaaataatcataaaatatgaaaaataaatctttccattaactgaatcaattgtccccttgcaggattttggcttcacaacttcctaatccttgaaatattaattttgattatttttctaatatgtacccatatgtctttgagtaaatttttattggaaggacaaatcagtgctggatatacagatgccattgcttcgtactcaggtaaagacaacctgatatttatgatcctcttgatcatatttttattctcttaaaatctttatgtcttctaataatgttaacagagaagaaaaaaagtcttatctaagcctgactttttatttttaaggaagtttttttctttatttgtaaaattcaggagtttggctagttgttatttaaatatggagaactcttccttgtttcttccccctccctgcctagaaactggttggtgcttttattattcgtacttcagtgatagctttgattattgtttcagatctccttgcccttgtgtctttccccagtacacaaactattctcgaggtggaacctgtggtctctggcatacccatccgccttcttctctgtcattagttcatctcttcctttgccctccagagctctgattcaattgctgcttgaacttttcagtgtgtcagtttctttctccacggatttccctgtggatggaaaatctgcccttgcactttagttttcatagaagcctcatctcagctatctcccattttgtgatatgagcctcttttgttattgtagccttcatctcctatttcctaaattccatgtgtttctacatactgttcatagacaaatagtttaaagcaatgttctatagtttcttgtggtttgaaagtcatatatttttaaatacgttttctccccctgagaattcagcatacagtttcatttttcttgtacgcaggatgatttttaggattttttttctgttatattttttccattctggttacctagaaggtagtgattattaccccaaaccagggtttgatactgtgttagtccactttcatactgctatgaagaaatacctgagactgggtaatttataaagaaaaaaaggtttaatggactcagttccacgtggctggggaagcctcacaatcatggcagaaggcaaaggaggagcaaagacatgtcttacatggtggcaggcaagagagagagcatgtgcaggggaactcccctttataaaaccatcagatcttgtgagacttattcggtttcacaagaacaacacagggagaaacccatccccatgattcaattacctcccactgggtccctttcatgacatatggggattatgggagctataattcaagatgagatttgggtagggacatagccaaaccatatcattcttcccctggcgcctcctgaatctcatgttctcacatttcaaaatcaatcatgccttcccaacagtcccccaaagttttaactcgtttcaacattaactgaaaagtccacagtccaaggtctcatctgagacaagtcccttccacctatgagcctgtaaaactaaaagcaagttagttacttcctacatacaatgggggtacaggcattgggtaccccccaatgtatttacacctgttccaaatgggagacattggtcaaaacaaaggggctacaggctccatgcaagtctgaaatccaatagggcagtcattaaacgttaaagttccaaaatgatctcctttgactccgtgtctcacatgcaggtcacactgacgcaagtggtggtctcccatggccttgggcagctctgcctctgtggctttgcagggtacagcctccctcctggctgctttcactggctggcattgtctgtggcttttccaggtacacagtgtaaactgtttgtggatctaccaattgggggtttggagggcagcggccctcttctcatagctccactaggcattgccccagtagggactctgtatgggagacagagcccacatttcaattctctactaccctggaagaggttcttcatgagcccctgctcctgcccccgcaccccaccagagcaaacttctgcctgaacatccaagtgtttccatacattctctgaaatctaggtggagggtcccaaacctcaattcttgacttctgtgcgcctgcaggctcaacatcttgtggaagctgccaaggcttggggctgcaacctccgaagacgtggcctgagctgtagcctggtgtctcccaccccagccatggctggagtggctggaatgccgggcaccaagtctctaggctgcacacagcagggggacctggacctgctccaggaaatcatttttccatactaggcttttgagcctgtgatggaaagagctgccgtgaaggtgttaaggtctttaatgttctggagacattttccccattgtcttggtgattacatttggctccttgttacttatgcaaatttctgcaggaggctttaatgaaagtcggtttttcttttcttttctttttttttttttttttggattgggagtctcactctcttgcccaggctggagtgcagtgccgcaatctgggctcactgcaagctccgcctcccaggttcacgccattcctcagcctcccaagtagctgggactacaggtgcccgccaccacgcctggctaatttttttgtatttttttagtagagacacggtttcaccgtgttagccaggatggtctggatttgctgacctcgtgatccgcccgcctcagcctctcaacatgctgggactacaggcgtgagcccccgcgcccggccaaaaaatcttatacattataatgctcaaattttatcctttaataagtcataacggagaaacatgctaatgatttcacaattaaatgtgacgttcatttagtgttttgctttgtaatattaaatattttattgttttccatgtgataccttttcctttaaaattctacttaatctacttaaatctacttaaatcgatgatgttataaatagtctttgatttttactttattaatctttgtacattttaatatcgttaaacttacaggaacagtttgtacacttcatggaaatagagtagagtaatagagtttgattatttgttttgttttcagctgagggttttttttttttggtaatttcagtcttagagtctttcttttcagcagttagtggtataattcatatttgtttctcatagctgattttttgttttaacttttgtgaacttgcttatagtttctttacaactattaggctggtgcaaaagttattgaagttttcactaattattattattattattattttgaggcggactctccctctgtcgcccaggctggagtgcagtggcgcgatctcagctcactgcaagctccgcctcccgggttcacgccattttcttgcctcagcctcccgagtagctgggactgcaggccccggtcaccacgcctggctaattttttgtatttttagcggagatggggtttcaccatattagctaggatggtctcgatctcctgacctcgtgatccgcccacctcagcctcccaaagtgctgggattacaggcgtgagccactgcacccggcctaattatttgttttttaaaagatggtacatacgaggaagtaaatcaggaaaggaggatagtgattggtggcagtagaagtgagtcagtgttacagttactattgctgcttaagaaactaccccaaatggcccgggcgccgtggctcacgcctgtaatcccagcagtttgggaggctgagacgggcggatcacgagttcaggagatcgagaccatcctgcctaacacggtgaaaccccgtctccgctaaaaatacaaaagttagcnnggtgtaaataccgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntagatttgcatttctctaatgcaggtctatgagtttcttattcatggtcactaaaagatgtttatcatgaattgaaatctccagataagagtaaagcaatgcctaattcatagttacgcacttatcaatttatttattcatattattcattatcattatgaatattcaacacattaataaaagagtcacatgtgcaatctacttggggtattgggagagtaaagaataacatagtggtgctacaggtaatttaagagatggtttctctctctctctctctctctatgtgtgtgtgtatatatatatatatatatatatatatatatgacacaggtataattattttccttctactatttgttattgatgtatactgccaaatccctaacggatactggaatacttaactctaagctccccccacgcctacaaaagaagtgggtacaaggttagtttttaaatcaaaagatttattaatagtatttttatcatgtccaattgatattatcattatcaaaaagtttaatcacttattattacttgaaggacctcgttaggaaatattcgatccactctccagcgatttgggaggtttaggagacagagtctcattatgtcacctaggctagagtgcagtgagccgagattgcgccactgcattccagcctgggcgacagagccagactccgtctcaaaaaaataaataaataaacataaataaataaataaataaataaataaataaataaatgtcttacttcaatagcttttggagcacaagtggtttaggtaacatggataatttgtatagtggtgaagtctgagattttattgcacctgtcacctgagtagtgtacattgtaccaaacatgtagcttttttattccacacccacctgccaacttcccccttatgaatttccagagcccattatatcactcagtggagagtcttcaacattcagggtggaatcttcagggtgtggccctctatccattgctttccaacgtttgtactctctgctttgtgaatagaggcctgttctccctgtctgccttgttcacgtacctttgccgttttccttgctgggatgacatcctttgccctgaagttctcattaaccataccatagatgtcctcttcttacctcaatacatccaaggctacctcaagttataacttctcctttagtttttccctagtgtctgagttcaaatgggcttctctatatccagaatatctaccacctgtcttatctttcctcacacgtggcacgtgcagttccttccatctactttcataatgttgtattttaacggttcagttgtgtttatattacactcttctgtcaggcaaacaagggtatttatatggctgaaatctacggtattttttaaatgtagtaaaatgtaatgaataagcatacaaatgaatgagttaattaatctgttatattcttggttaagtaatgagcattatgaggacaaaaattgagtcttacaccttcttataatcctaaagacctagtacaggacttggaatatagcattcacttaagacatctttgtgactaatgaatttaaatatttttattaattctaagttgacgtatgattgtaatttggggaaggtagtgaaatttcaaatggctttcaccacctgtgaaatgaccctttttacctaccacatgatttaccagatctttgtttaggtgaacctaggcgaaagcagattgtttcctctacttaggaaatacttcgcacattttcgttgcttataaatttgatgattttaatttgtacagttataatttatgatattgacttgtacagttatatatattttacatataatatatattatatattatatatagttatactatatataattttattttctaaagtaaagaatatcattacacattaacaaaatagatataactgttttctttctactatttgttactggtgtatactgcaaatccctaatggatactgaaattcttatctctaagcccctctatgactatgaaaagaaatgggttcaagtttattttaaaaatcaaagagtgtattaataatattattgttatcatgtccaattgatactatcattattaaaaagtttaatcacttatttcttgaaggacctaattaggaaatatatatgtgtgtgtatatctatattctatctatatatatcctatatctatattccatatatattctgtatctatattctatatctgtattctacatatattctatatatagtctatctatattctatctatatcctatatatagactatctatatcctatatatagtctatatatattctatctatatcctatatatagtctatatatattctatctatatcctatatatagtctatatatattctatcgatatcctgtatatagtctatatattttctatctatatcctatatatagtctatatactctatatatcttatatagtctatatatattctatatatatcctatatagtctatgtatattctatatatatcctatatagtctatgtatattctatatatatcctatatagtctatgtatattctatatatatcctatatagtctatgtatattctatatatatcctatatagtctatgtatattctatatatatcctatatagtctatgtatattctatatatatcctatatagtctatgtatattctatatatatcctatatagtctatgtatattctatatatatcctatatagtctatgtatattctatatatatcctatatagtctatgtatattctatatatatcctatatagtctatgtatattctatatatatcctatatagtctatgtatattctatatatatcctatatagtctatgtatattctatatatatcctatatagtctatgtatattctatatatatcctatatagtctatgtatattctatatatatcctatatagtctatgtatattctatatatatcctatatagtctatgtatattctatatatatcctatatagtctatgtatattctatatatatcctatatagtctatgtatattctatatatatcctatatagtctatattctatatatatcctatatagtctatgtatattctatatatatcctatatagtctatgtatattctatatatatcctatatagtctatgtatattctatatatatcctatatagtctatgtatattctatatatatcctatatagtctatgtatattctatatatatcctatatagtctatatgtatattctatatagtctatatatattctatatgtgtatcctatatatattctctatacatattctatatatatatacacacacacacacacacatatatagtagcctgatatttaaaaaataagattgggactgcgtaaaataagctcacccagacaataggggtacagacatatgtataattcagcaagaactggtaacaaagtgagatatgtcaactctttgtagcatattgttaagtagtattaaaaaacaagtaatttttggttgggtccattgagagaataacattatttttagaatgatctaatggcacaataagcattttagcattttacctgcaaaagcattatagctgtgccagtttctgttccaagaaaaaaatacattggtgtattctctaaaggaggaaattctgacctcaactatgttcagatagctgtggcagataatactctgatcaggtactaagtcatatatctttcacatttccctttgctagttatactcagcatgtggttggaaatggaatcaaagcccagtctggaaatcctgaagtcaaagtcaaaggaactgatcctgtgataaatcagattattgataaactgaagcatgttattcaggtaagtcctgatcctatattttttggtatagccaataataaataataagtggtcactttctgttatacttgataaatttgttaaccctatcaggtaatcctgcctaaaatattgtaacacattatttgtatcaggacttttgggaatatttagtttaatgatttttgtatgcagtcaatatgcagtggtattttaatgttggacaatctgtatatgtgaaaagcaagcctcagcctcagcatttcaataatgagaatctcaggacatgcattgtcttcagtgaataagtttgaacgtgggaatcactgtgaccattaaagaaaacacatagaagaccatagaagatgccagagttttctttcaggtaattctctgaatgttgctatgaaggtttttgcagcatttcaatacaaattaggtcatagatgaataatatgtacttctaatatttatttcctatatcaccttttatatgttatcttataatctacctaatggttgtttatgaaatacttctgttttatcttcaataatatttttcatcaagtgagtgtgtattgctgtttttaatacatgacaaatgaagcatgaacatatttatcaaaataatatttcattgaaatagtctattaattagaaccaaacatgatgttgcatgttgtaaatattactctgcattctgcatctattgatgtttggggaaagaaaggctatttttttttttagttaatagtcattttataaaaatttatatttgaatatactttcatttttcctaagcagaactttgcatggctagttgatgcttatttctagtatcgtgcatcagaaacaatacctaaatagtacagagtttttattgcatacaacatattccagagtcagtagtaggcttctcataattgttctgcaaagacaaagcttaagtttatgcagagccaattcctgggtttccatttttcacgagtccctatctctcaaggagaggatatgtaagaaggacttgggggttggtgtccaataccatagacttctcccttctgtgaggcaacaatgcttattctaccattgatacctatagaaaacagctctcaccctggctggcaaaaccaaaaataaattctactggaaaagtctaagagaaaagtggtatcatgactactgatgagttaaaccttccagcctctgctgagctggtccagttggtacctcacagtatcgtccactgtagtataatatgtacagctagattatttgaaaattcgaccgcataattgataataaaaccaaaagagctttaatattaatgttctctcattgaggagtgagtacaatctcactgtgaggacacagtgaaatcttaggggtttcttaagtggggtaagcattccacagaggatggaggaagaaaaactagaacttaaatatatatttattccatctcattcttttatatttctttggttgtagtaaggtatataaaatatgtaatgtattagtgcaatagcatatacatataatttataaatacataaatatacatattaactggacatttgttcagattgtttttctaagatatatacatgatgaaagcagaacagaaaccctgttacagataataaggatagagctgttccatgagaagtgcagttataagaaaacacattcacagaggaacacatagatacccaagatagaaaggattataaaaacccttaggaggagggctcatatatttattacccattcagcaacccccctccccatttcttgtttcgtaggtttcaaagccttttcaaggtggcagagggaagtcatcctgcctttcttttttagcttctgtgtgaacttgagtcccattctttattctttataggagtgtgcagatctccaattattcatgcttaagtttcattctggggttgcaagagaatatcaaatgcagtgctacctttgaggtctatcattttaagatctgctagatttatatgatagaaatgtagatttttatagaggacagcagaaagtcatatcttgcacaggtgtcactgaaaatttacctttaatatctaagaatatgctctttcatgaactgctctcctggagatgaagagaagtgttttactttgccaattttttttttttttttttttttttttttttttttttttgagacagagtttccctcttgttgcccaggctggagtgcaatggcgcgatctcggctcgctgcaacctccgcctcccggattcaagagattctcctgcctcagcctccagagcagctgggattacaggcacgtgccaccacagcccggctaattttttttgtatttttagtagagacagggtttctccatgttgctcaggctggtctcgaactcccgacctcaggtgatccacctgcctcggcctcccaaagtgccgattacaggcgtgagccacggcgcccggcctactttgccaaacttttgactactgatggtgtacgcgtgccctggcagggatggccattgtgctgtcagtatcaagggatggctaacagcacccaccacaatgtcagctatgaaaggattcagaaaatagccttctgtaagtcagaatttattaattaaggagtagggccatggaagatgtcaacataggaataggtttcagattctaaactgtagatttagatgatcacttcttagtgtttgtataaaatttactttattttttattataacatgaagttcgctttccacctttatactatgaaaaatgccgtgtctcacaatagggacatacctgtgttaaagtatatggaagtaaatcagccacaatagcaaacattgcctgcatggactcacccaaaaatgcctttctcggcctgccattgatctgaacctcatttctaccttgcattgtctgcaattagagtcactaaggaagtagataaagatttttacttggaaaatgtcactttttaatgttttaataattaattcgttcaagatactcaacaaatgctcactgagtttctagtacggtcctggttctgtacaggcactgaggttaaagttgtgaataaagcagacacaaccctgctctcatgggctttccattgtaagaaaaaagtaaataaacaaaccaatgaaaccagtattgtagctgacacatgttatgcacaaaaccaaacaaggtgaggtaaggaaagatatttaagaagagtgtgctggtgaaggccactcaggggcagatgtttgggttgatgctgaataaggagaagaaaggagtcatgggaaaacctgtgagaactgtgtctggggcagaaggcaaagtaggtgtaaaggccctgtggcaggaataagtttattttattcagagaacagaaggccaggtggctaaaacagagtgagttaaagggaggagataaacatacatcatgttttggggagtccagtaggctctggtaaagagtttatattttctcctaaatagactaagaagtcattttaaaactgtaagcagaaactagctgcgcgcagtggctcatgcctgtaatctcagcactttgggaggctgaggtgggtggatcaccttaagtcaggagtttgagaccagcctggccaacatggtgaaaccccatctcttctaaaaatacaaaaattagctgagcacggtggagcgtgcctgtaatgccagctactgaggaggctgaggaaggagaatcgcttgaacccaggagtcggagcctgcagtgagccaagatcgcgccactgcactccagcctggatgacagagcaagactccttctcaaaataaataaataaataaaaatacatcacaaatttaataaataaataaataactgtaagcagaagctgatacaatttaatacatgttttatgaggacttcactatgaaaactggaccctgcgtacaagaatggaaaaaagaaagtaacacagacagaaggccacataattggagctagaataataagagtggataagctgagaagtgcatagatttagacaaatattggaagcggggtttttgggatttgttaatggattggaaatttgggagacggaagaaagatgatagcgaggtttggtgggatgatagtgtcactaagtgagaaaaggaattctgagagaggagcaggcctggcggagggtccctgggattgattagaaatcagtggttttgttaactgtgagatgcttgttagatgcccaagagggatgtgcagaactcagggagaccacacaactggaggtgtatgtttgtaagcatcagcacgtggatagtatttaagccctgagattgtataaggttgtcacctttcctttagagtataaattcacaccaaaactattggtggagatgataggacaagggaatcatacaaaaaaaattgtactgcaaaaagctatgaatgaataaaacattttattaaatgtatttggcaccttgtatatacctagttgatctaggacagagaagatacttagtaacattcattttttcttactgtaagaataatgacccaggaggcggaggctgcagtgagctgagcaggccactgcactctagctctagcagacagagtgagactccgtctcaaaaaaaaaaaaaaaaaaaagaataatgaatgctcatcagagggaattgaattttattattctaggaaatctgatggaaaaagtgaaaaataaatattgataccatttataaaacaatgaaaagacttataagagaagccatctaggcttttctctatacttaattatacatataaatacatcagtactttacttcaaaaaataagatcatagggtacatttgattttatgatctgaactgctcacctgaccacacaaaacaaatactttaccatgacattaaatagtctgctctctggttgttagtgctggcatactattctatcatatggaaaaattacagttttccttcacccagtcaccgaaagtggatatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatttatcaagtataacagaaagtgaccacttattatttattattggctataccaaaaaatataggatcaggacttacctgaataacatgcttcagtttatcaataatctgatttatcacaggatcagttcctttgactttgacttcaggatttccagactgggctttgattccatttccaaccacatgctgagtataactagcaaagggaaatgtgaaagatatatgacttagtacctgatcagagtattatctgccacagctatctgaacatagttgaggtcagaatttcctcctttagagaatacaccaatgtatttttttcttggaacagaaactggcacagctataatgcttttgcaggtaaaatgctaaaatgcttattgtgccattagatcattctaaaaataatgttattctctcaatggacccaaccaaaaattacttgttttttaatactacttaacaatatgctacaaagagttgacatatctcactttgttaccagttcttgctgaattatacatatgtctgtacccctattgtctgggtgagcttattttacgcagtcccaatcttattttttaaatatcaggctactatatatgtgtgtgtgtgtgtgtgtatatatatatagaatatgtatagagaatatatataggatacacatatagaatatatatagactatatagaatatacatatagactatataggatatatatagaatatacatagactatataggatatatatagaatatacatagactatataggatatatatagaatatacatagactatataggatatatatagaatatacatagactatataggatatatatagaatatacatagactatataggatatatatagaatatacatagactatataggatatatatagaatatacatagactatataggatatatatagaatatacatagactatataggatatatatagaatatatatagactatataagatatatagagtatatagactatatataggatatagatagaatatatatagactatatacaggatatcgatagaatatatatagactatatataggatatagatagaatatatatagactatatataggatatagatagactatatataggatatagatagaatatagatagactatatatagaatatatgtagaatatagatatagaatatagatatagaatatatatggaatatagatataggatatatatagatagaatatagatatacacacacatatatatttcctaattaggtccttcaagaaataagtgattaaactttttaataatgatagtatcaattggacatgataacaataatattattaataaactctttgatttttaaaataaacttgaacccatttcttttcatagtcatagaggggcttagagataagaatttcagtatccattagggatttgcagtatacaccagtaacaaatagtagaaagaaaacagttatatctattttgttaatgtgtaatgatattctttactttagaaaataaaattatatatagtataactatatataatatataatatatattatatgtaaaatatatataactgtacaagtcaatatcataaattataactgtacaaattaaaatcatcaaatttataagcaacgaaaatgtgcgaagtatttcctaagtagaggaaacaatctgctttcgcctaggttcacctaaacaaagatctggtaaatcatgtggtaggtaaaaagggtcatttcacaggtggtgaaagccatttgaaatttcactaccttccccaaattacaatcatacgtcaacttagaattaataaaaatatttaaattcattagtcacaaagatgtcttaagtgaatgctatattccaagtcctgtactaggtctttaggattataagaaggtgtaagactcaatttttgtcctcataatgctcattacttaaccaagaatataacagattaattaactcattcatttgtatgcttattcattacattttactacatttaaaaaataccgtagatttcagccatataaatacccttgtttgcctgacagaagagtgtaatataaacacaactgaaccgttaaaatacaacattatgaaagtagatggaaggaactgcacgtgccacgtgtgaggaaagataagacaggtggtagatattctggatatagagaagcccatttgaactcagacactagggaaaaactaaaggagaagttataacttgaggtagccttggatgtattgaggtaagaagaggacatctatggtatggttaatgagaacttcagggcaaaggatgtcatcccagcaaggaaaacggcaaaggtacgtgaacaaggcagacagggagaacaggcctctattcacaaagcagagagtacaaacgttggaaagcaatggatagagggccacaccctgaagattccaccctgaatgttgaagactctccactgagtgatataatgggctctggagattcataagggggaagttggcaggtgggtgtggaataaaaaagctacatgtttggtacaatgtacactactcaggtgacaggtgcaataaaatctcagacttcaccactatacaaattatccatgttacctaaaccacttgtgctccaaaagctattgaagtaagacatttatttatttatttatttatttatgtttatttatttatttttttgagacggagtctggctctgtcgcccaggctggagtgcagtggcgcaatctcggctcactgcaagctccgcctcccgggttcacgccattctcctgccttagcctcccgagtagctgggactacaggctcccgccagtacgcccggctaatttttgtatttttagtagagacggggtttcactgtgttagccaggatggtctcgatctcctgacctcatgatccgcccgccttggcctcccaaagtgctgggattacacgcttgagccaccgcgcccggccaaggcatttaaaaaatgaaaacaaaacactatcacctgagtcatttgtttgcttacattaaatatcataatacttttcagcaaaaaatattatcattttaatgtaactttcgttccctgtatttgagcggagtactgcactatccataaacaccctctgaattttctacagtaatggaaaaaaatctttgaaaaaaataaaagaaggttctatgtttgagaatatggctatatgaaaggggtttcaagaaatatccagttcttcccaagacgatgtacttccagtgaccagttttaagaagtggaacaggccaggcgcggtggctcacgcccgtaatcccagcactttgggagtccgaggcgggcagatcacgaggtcaggagatcgagaccatcctggctaacacggtgaaaccccgtctctactaaaaatacaaaaaattagccgggcgtggtggcgggcgcctgtagtcccagctactcgggaggctgaggcaggagaatggcgtgaacctgggaggcagagcttgcagtgagccgagatcacctcactgcactccagcctaggtgacagaatgagactctgtctcaaaaaaaaaaaaaaacaaaaaaagtggatcgaatatttcctaacgaggtccttcaagtaataataagtgattaaactttttgataatgataatatcaattggacatgataaaaatactattaataaatcttttgatttaaaaactaaccttgtacccacttcttttgtaggcgtggggggagcttagagttaagtattccagtatccgttagggatttggcagtatacatcaacaacaaatagtagaaggaaaataattatacctttgtctcatatatatatatatatatatatatatatatatatatatatacacacacacacacatagagagagagagagagagagagaaaccatctcttaaattacctgtagcaccactatgttattctttactctcccaataccccaagtagattgcacatgtgactcttttattaatgtgttgaatattcataatgataatgaataatatgaataaataaattgataagtgcgtaactatgaattaggcattgctttactcttatctggagatttcaattcatgataaacatcttttagtgaccatgaataagaaactcatagacctgcattagagaaatgcaaatctaaaccacaatgagataccatctcactccagttagaatggcagtccttaaaaagtcaggaaacaacagatgctggagaggttgtggaaaaataggaatgcttttacactattggtgggagtgtaatttacttcaaccattgtggaagacagtgtgtgaattcctcaaggatctagaactagaaataccatttgacccagcaatcccattactgggcatatactcaaaagattataaatcattctacgataaagacacatgcacacgtatgtttattgtggcactattcacaatagcaaagacttggaaccaacccaaatgtccatcagtgatagactggattatgaaaatgtggcacatatacaccatggaatactatgcagccataaaaaaggacatgagttcatgtcctttgcagggacatgcatgaagctggaagccatcattctcagcaaactatcacaagatcagagaaccaaacgccgcatgttctcactcataagcaggagttgaacaatgagaacacatggacacagggaggggatcatcacacactggggcctgtggggtgtgggggtgtaggggagggataacattaggagaaatacctaatgtaggtgacgggttgatgggtgcagcaaaccaccatggcatgtgtatacctatgaaacaaaactgcaagttccgcacatgtaacccagagcttaaagtataatttaaataaataaataataaataaataaataaactcatagacctcaaagtatgggaagcctaactgcctacggccacttgctgcttcactctaaaatctgtttctgcatctgcccctcagtcaatgactgaggcccacagggtggctaatgcagatccctctttaggagacacagggcttctctgaggaccagtcttggctcaggattccctgaagccttttctcacccttccttagactgtacattacgctccaatgcttccactcaaccttcctttcctctttccttcattctaggtcagacttgcctcatagctgagacctcttccaggcttactcagcttcctctccattttctctcacagggatttcccttaataaaatcctcttgtgtttaactcgttttcaacatctacctcttggaggacctggactaacccaccacataatgtttgtattataattacttccattctacaggttgagaatctgggatctggagaagttaagcaacttaagttactcaagtaaggccacacaacgtatataaagtgtgctgcaaggagttaaacccagggaacgcacactccaaaacagaaccatcaacaagtaccaatcctgaaaccaactaataaaaggtaaagatacaattagcttggtgcaaaatgttatttttctctctaattacattttctaaggtttcactgtttgtgattaagaagggatgaatgattttcatcaaaactctgctcaacaagccgggtgtcgtggcatgcacctgtagtcccagctactgaggaagcagaggcagggggatcacgtgagcccaggaggttaaggctgcagtgagctgtgattacatctcgttgaccatgtgaccctgagtgtaactcatagacctcaagcctgggcaacagagcaagactctgccttaaaaagtaaaactaagcaaaacaaaacaatcctgaacaaatggttgcacataaccagctaaacagtaatataacagttgttggcagggtgagaagaaactagcagactgtaggtttgtcatactgtttttttgtttctccagaaacacagatataatataggcaatgaaagctgagactcatctcttaatttcagttaagctattaattgatttacatcatttacttacaggtcagaaaagtttctttcaaaaggcaggaatgttgtttcatgttaatctaaggacttgcttaccttttgtttctgttcttaatgatcacagttactaatacagttaaataatatttagataaaatacattacaattatagctgatcaaaaatctcattccaagctgttatattgttgactatctcatgatcactcttcttatgaatcatgtaaatagggaaaaatactgcaaagtagacccacgttacttcaaatgaaatatgatttaataaaatcagttattctttgccaattttgtaatgttcaaaataaccacaattgaaatagtgatacatacacatcagaacagttcaaatgaaagagagaaatgataccaagtgttggcaaagatgcggagcaactagaactctctcccattgtggatggaaatgtaaactgatggacaccaccattttccatgtatgctaaatctgaccatattctatgaccctgagcatatacccagcaatatttaccaaaagacaaatacatgaatgctcagagaggcaccattcaaaataaccacaaattgaacttatatttgtataatgatatagtatatagcaatgagaacctaacaaattacaactatatgcaaaaagattaacaaatcttataaactaaatattgaatgaaagaagcaagatacagaacatattctacgatctaattcactaaaaattgtaaaactcatcagttatgttccaaatcaccataagagctatcctatgaaatagtgtctagaagaagtaataatataaaatttcctgatttgagtactggatacacagaagggctaagtttgtttaaaaacaaaagaagtattgagctgtacagttaagatttgggtattttactgtttgtatgtattttcagcgttagaaaattatgttaaaaagtctttatgctctttttcttaatatatttacaatagacaaattttcattaagccacagtataaataaaaaagacccacacaggtatttttaacatggatgaagtggttctgccatcattaaatgagtactttaggatgcaagtctgatataaaaacttacttccctgaagactttaattttgcatgcaaaatacacggtttctaaattaaatttttttgtaacaaagcgtttttgagttcccctcatgaaattttaataaatcattaatttcttctttttctctttcatgcacaagcagtggataaacatttcaaagatccctacagaagtttcttcccttgaaatactgttcacatgacaatgagaaggatggaataaaacacaaaaaaggtaagcaatttttttttttttttgaggcggagtcttgctctgtcgcccaggctggagtgcagtggcgcgatctctgctcactgcaagctccgcctcccgggttcccgtcattctcctgcctcagccttcgaagtagctgggactacaggcgtccgccaccgtgcccagctaattttttgtatttttagtggagacggggtttcaccgtgttagccaggatggtctccatctcctgaccttgtgatctgcccgcctccgtctcccaaagtgctgggattacaggcttgagccactgcgcccggccaacaggcaaatttttcgttggggaagtagtagaccaaccatctgtgcttatttcttctaaacagagctgggaatgagtgacagcagttgaacaggaacacttgctccccaagcactacttgtttttcatgaagaaggaaaaaaggcaaaagccctgctacatttacattcgcaaaattgttttcaaatgaggattaacaagatgttagttccctctctgttgaacacataaaatattaaaaggcagtgctaatacatctatatacagcacatcaggaggaaggaggaagtcatttctcctgactttaccaacttgtcttatttgaaactgataccgtgccctattggctgataggagtttcactttatttagaatacaatagaatttggctcagattcacaccaaaagtatagtattttgatgtgcacttacacgatttcaggggaaaacaatatctggaatgtgaccctggaattcattacaagtcagctaaagggatctctcttagaattttttcataattggactgggacaggatgtaagaataaatcattaacagtagatgaggaaaacacttgacgagagctttctcgtcttaccattactgctctttctatcagaggttaaagacagaatggggaccatgttgtggttgttattcttgttgtttgattggtttgtttattatgttcttgcaggacttggttatgtggctggatatgaaaattctttccatttccagagtcatacatctcctaatttctaggagattaaatactggttttatctttggctccagtaaaaatgttgctatcttggattaaaagaaggttgggaaatacgttgtgtctattcaccagtgaatgggaaccccttctacaacaacaaattttccattcaaaccatttctaggcctcccttcctggttctgatagcaaatgtgaaagcaagtactagagatttgggttttgtaagtttcctcaaatacttgggaaatactggattccgttgccaagtgttgccttttgtacattcagcttctacacagcacgttttctctatgttgaaagtcctaatccttgaaatctcagaatggaaaagagttatatgactaattttatgtgccaggattatgggaataaactttcatggaagataggaagcttacagggcatctagagaaaggagacatctgtagaatcaattcagaatgattaagccccttgtgatctcactatctcacttcaattgttaagccacaaaactctttttaagttaatctctaacatttatttggctttataattacatataaataatgtctaaatttgacacctatgtttccaaacttaataatgaagtcaaaataaacagaattaaggagagcttattacgatctttattgttatttatatataacaaatttcctattaagaatataatattttatgatatcttatggatgtcattaacattgctttaataaaggtattatcatgctttgtacagcaaccaacacgaaaatgttactataccactgcaataaatagaataaaaacatgttcagaaagacttagaaactcattaaagaatggatgttaatcacttttcaccctaactcctcatttggcaaggcatgaatctatgcattccagtttagacaggtggcaagtaagtagtcccattgcatttcataaaataagcagctgcgtgaatttgaaagatactatttccacatgaaaagctaatgactgcacatgtaaaatcagtagtgtttaggaagctgtcatttaaaaaacaacaaactacctaattaaaaagtagcacaaataaacttttccctatgtaaaaaatagaacattgcttagccttttcttaaacccctccccaattcttaccaagaaaggataaatacctttattatagtcaaagctctgtttttatggtttttgaattttttaatctaaaattcaaagcaaataatcaatctttaatttatatttatcccaatttgattcaaagtgacggtccaaaagtaaaatgatcaattataactataatcaatcacaaataatgctatgtgagtttgaaatgttaatctaagttgccttttccaggtatgcattttaaaattaaactcttctcagtaagatcaaggctatccttcatggatttatgatgtttgataatcaccacgttgtactgatttgctgtctcacttcactgtttgatatcaacatatgaaagtaaaaatgctatttaggggataactattatctgagcactaataaattaaacgctattttaagccaacaacaaaattgtttagggtacaatttttatttaaccaactgtccattataaacattataaaattctgaaagatcctagaatcttatatagcttttttgtattttttcaaatgtaattgacaccagcatgaattaaatttcatatttaaaaagcttctgactacattacaacatactttaaaattacttgcaagatatgataattctaagattacccacatatcatgcaaatgaaacagccaggtacttcctaccaacacatgatacaataaaatccagaagaacttctgaattagagtgtagtagttgcctagggccatcatacctaattatcacacacttggtgggttaagaggacagaaatatattctctcatagttctgaagcctggacctctgaaatcaagatgttggcggggccacactccccctgaagaccctagggaagaattctccctcgcttcttcctggtttccagtggctcctggcaatccttggctttctttgatttatgactgcataactccaatttctgtctccatcttcacatgaccttgtgtgtgtcttttcctgtatgttataaggacatttacactggatttagggcccaccttcacccaggatgacctcatctcaatcactgggttaattatatctgcaaagaccctacttccaaataaaatcacattctaaagttcctaatggacataaattttggaggtacggtatttaaatcactgcacagaacatgtaaagacaaaaatctggaagctacctgaatgaaaatggatattcccttgaacttcgacaaaatcatattctatttttccatgagaaacattttattaatctaaaacaatattcatatttcacaagtacacctcttaaattatagcttggacttaagaaaaataattagctttggaaattatcagtacatgatatctagtatttcctatatttttaagaacttctacctcctagcaaaaataaacaatgcaatggataatttctgtgttctaaattcacacacacaaacaggaaagggactttaaaaatgatgtgttctcttttaaagcagaagcccaaccacctgctctgaatctaaaagtttcctgaaagcaatgaagggctagtttattatgaaggtgttgatagctgattctgtggagactcacacagaaacaaagaataaattttaatcacacttaatgctaatgtggtagtaaggttgtgacaatattcaaatatgactaatttcattgaattaactacactcgggcttagcttagttgtccaaatttattacaaatagctcaaactaaataattcaactcttctgttttctatttattttttgttgatgcttaagagtaaaaagatatttcaactgaattttttttttttttttagcaatcagttctcttgttttatcaccataagactgtaaacggccgtaacaggtcactgaatctagcactgccttcaacaagaaatgcacctagagcaggaatatagtacttggcactcatctctagacctataacctaacagatttttttttttgtctgtctttggtgaaagtaacgtaaatttagagctggaaaggaccttagaggtcatctagtcccacccaagcatctttgaaaacaaaataaagaagtgtgttggcctgatgcagtggctcacgcctgtaatcccagcactttgggaggccaaggcgggcagatcacaaggtcaggagatcgagaccatcctgcctaacatggtgaaaccccgtctctactaaaaatacaaaaaattagccggacatggtggcaggtgcctgtagtcccagctactcgcgaggctgaggccagagaatggagtgaacccaggaggcagagcttgcagtgagccgagatcgtgccactgcactccagtctgggcaatagagtgagactccgtcttaaaaaaaaaaaaaaaaagaagcatgtttatttcatcattttgtacttatacactgtgtatttccagaaaagcccctgagacagcttagaatgaaaggcacagacactataaaacaagggcaaaatgacagaataatgaagagaaagaggtgacaattacatgggacaacctagggaaggaaacactacccttcagcctaaaatttagtcctaagccccttgttcttaaaggccaaaaggaaaaccagaattcaaataggtattgttagttaataaaatagtatctggatatatcagcaactattttttggtaactctaaactcaagcaaaatatatgtcttcaagcaacagacaatggacaatataataaaaataatcttccatagcaatttccaaacttttaaagatgtaagaacaaatgatcttttcttacaggatgcttagttgaaagctgcccgcatgatggtattttaaactacatgatgttaaattccctgcatgatggtattttattgggacctggttatatgatttggtgaagaatgtaacctttgagaacttagaagagtgaatggttaatatttctctgaatttttttgtttttaattgatattttattttatccctcatagacaatatatgcctgggaaatacactgaagtatagtaaaaaagaatctaagggttaaagtgttgaggtaaatgagaaagcagaggttgtgtctgaagaaccgtgtggtcgcactgcaccacacagcaaacagaaatatgggtgagcacaggccgggcgcggtggctcaggcctgtaatcccagcactttgggaggccgaggagggcggatcacaaggtcaggagatcgagaccatcctggctaacacggtgaaaccccgtctctactaaaaatacaaaaaattagccgggcctggtggtgggcgcctatagtcccagctacttgggaggctgaggcaggagaatggcgtgaacccgggaggcggagcttgcagtgagccgagatcgggccacaccactccagcctgggggacagtgagactccgtctaaaaaaaaaaaaaaaagaagttcaccctatgcaggcactataactacgagtccctcccatctgagccttgccttccagacaaccccaccaatacataagacagaaaaaaagcaccttgcaccttccagactgacttgtttgccagccgcatagcactgagtcaccctagttaatgatatgagagaggaagaatcactcagacgaatcctgctggaatttctcacctataggatccatgagatacaatgaagtggtcgttgttttaccttattaaatttggggtagtttcttttttcttttcttttttcttttttttttttgagacggagtctcgctctgtggcccaagctggagtgcagtggcgcaatctcggctcaccgcaagctccgcctcccgggttcacaccattctcctgcctcagcctcccgagtagctgggactacagtcacccaccaccacgccaggctaacttttgtatttttagtagagacggggtttcaccgtgttaggcaggatggtctcgatctcctgaactcgtgatccgcccgtctcagcctcccaaactgctgggattacaggcgtgagccacggcgcccgggccatttggggtagtttcttaagcagcaatagtaactgtaacactgactcacttctactgccaccaatcactatcctcctttcctgatttacttcctcgtatgtaccatcttttaaaaaacaaataattaggccgggtgcagtggctcacgcctgtaatcccagcactttgggaggctgaggtgggcggatcacgaggtcaggagatcgagaccatcctagctaatatggtgaaaccccgtctcccctaaaaatacacaaaattacccaggcgtggtgaccggggcctgcagtcccagctactcgggaggctgaggcagaaaatggcgtgaacccgggaggcggagctttcattgagctgagattcggccctgcactccagccttggggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncggcggatcttatatcatcgccgctctggtcgaattcgcctcagcctcccgagtagctgggactgcaggcacccaccaccacgcccaggctaattttttgtatttttagtggagacagagtttcaccgtgttagccaggatggtctcgatttcctgacctcgtgatccgcccgcctcagcctcccaaagtgctgggattacaggcgtgagccacttagcccggcctaattatttgttttttaaaagacggtacataggaagaagtaaatcaggaaaagtggatagtgattggtggcagtagaagtgagtcagtgttacagttactattgctgcttaagaaactaacccaaatggcctgggcgccgtggctcacgcctgtaatcccagcagtttgggaggctgagacgggcggatcatgagttcaggagatcgagaccatcctgcctaatacggtgaaactctgtctctactaaaaatacaaaagttagcctggcctggtggtggtgggcgccttaagtcccagctactcgggaggnttgtaaaaggacggccagtagaccggcagatcggatatcatcgccactgtggtggaattcccacaccactccagcctgggggacagggagactccgtctcaaaaaaaaaaaatttaaaaaaagaaaaagaaaaaagaaactaccctaaatttaataaggtaaaacaacgaccacttcattatatctcatggatcctataggtgagaaattccagcaggattcatctgagtgattcttcctctctcacatcattaactagggtgactcagtgctagtcggctggcaaacaagtcagtctggaaggtgcaaggtgctttttttctgtcttataaattggtggagttgtctggaaggcaaggctcagatgggaaggactcttagttatagtgcctgcacagggtaaactttttttttttcttttttttttgagacggagtctcactgtcccccaggctggagtggtgtggcccgatctcggctaactgcaagctccgcctcccgggttcacgccattctcctgcctcagcctcccgagtagctgggactacaggcgcccaccaccaggcccagctatttttttgtatttttagtagagacggggtttcaccgtgttagccaggatggtctcgatctcctgacctcgtgatccacccgcctcggcctcccaaagtgctgggattacaggcgtgagccacagctcccggccaagaaggctctcttaaaaggaatcacttcttgttttcttacaagttataacctcactaccctagagtcacattttttaataacttacgaattttctgaatcttcaaataccctatggccccatggtaaaacatcagatgacatttgcctctcatttaaaccatttttcttttcctctttcttctttatttttcttatactctctcctcatttctttttctctcttcctatttctctttttctctctgcttcttcctacctcccctcgtgactttgtctcctcatcccatcaccgtgctacttagatgccacatcaatttgactagcctcaaatttacaatgaatactttttaaattcatgcttctgaaacttttaaaggatgaagaggtataaatgtctcaaataataatttgcttgatggctgaaatgaatggcatttctcaaaaaggccaagggactgaatacagaaatttaaacaataattttccgttagtgatacggtttggatgttttgtcccctccaaatctcatgttgaaatgcgacctccagtgttggaggtgggcctagtaataggtgtttgtttcccaagggtggatccccatgaatggttttgtgctgtcctcctggtaatgagtgagttcttgctctatgaattcacgagagatcttgttgtttaaaagagcctggcatctcccttgctccctctctccccatgtaatatgccagctccccctttgccttaagccatgattgtcagcttcccgggcctcagcagaagctgagcagatactggtggcctgtttgtacagcctgcaaaccatcagcccaaatactcctcttttctttataaattacccagtctcaggtattcctttatagcattgagatggactaacatagtcagttttgacaacatgaacctttcatattaaaatttaatttctaaattcactcatttactgtgattggtttatagcttttctgtaataatgaattttacgtgtgactttcaatgtgctttaaaacttgattcactttttagctctatttttggaaactaccagcttccactgttgaggcaaaagtgtcatcattgaggctctcctgctgaggtagctgttgtctgatttcccttcagttctactgctgtcccagtggaaaaagggaatcttcaccacttacatgacatgtttgcctgaactctaatcttccacacttgctgtagaaaagagtaaagtggcagttcagggcagtttaccaatttagaaacggtgtccgctcagtattttcctctgtgtcacttactaaaacatataaagaaaccatggacattaaaagaaagagagaggtttaatgtgatattttaattctaacaaggatttatgggcacgtgaatgctcaaaatcacatactcccttagtgtttttcatctcacacatatcacatcagacacatatcacacacatcaggcacatatcacacagaacttgccataattaaattatcagtttttgaaaaatattatcatttgctctctttttttctatataaataaatttttttaaaatatgattttcagttctgggatacatgcaaggaacatgcaggtttgttatataggtatacatgtgccatataggtggtttcttatttgtgctttcatcttatggctttggctagaactagataataaaagtatgcatcaatttaagagttatttttaatcatggtaaggacatatctataactactttgttaaatttcatcagtcatgcatgttaaatatcattaaataaatatcaaaaatgggctgctgtaccagaataccatagacttggtggcttataaacaacagaaaggaatttctcacagttctggggtctgggaaatctaagaccaaggtactagccaatctggtgtctgggaaaaacttttgttctagttcaaagaaggctgccctttctctataacctcagttggggaaggagcaagggagttcagggggctgctttagaagggtgctaaacccattaatgagggctgctctctcatgacttaattagttcccaaaagccccaccttcaaaaaccctcacattggcggttagcatttcaacatatgaatttgagagggatgtaaacatttagtctgtagcagtaaatgtacaatataaagtaaatagctttattgttgtgttgcattatattaatatatattttctagtattaaatctttgtatgccaaatcactggggtgggtgatttcttagtaagtgtagaattcagttcctttttctttcagttaagaatattttaactatgtttataagggatactgtttagtaattttattctttttgtattcacttcatcaagagttagtaatagttatatttgctttgtaaaatgaactgaaaggaagccactttttataactttatccatatttcctagtttggggtccattttacaagatgttttaaacagatgcttattaaaaacaccggttatagggactttaataaaaatttttaaaataatgttttacatttcttgcaaaaattgatgcctgcaacctatttactgtttttaaaattaaattaagattcatttaagcagtacatgtttattttagtgaaacacgtatttaattttctaagatagtattttttgtctttaaaacaatttctgcatgttttgtttttttttcactttaaattttatgttttctcagtttttgttttatcacatttgctatatttttctgtatcatgggttatttgttaaagaatgaacttgtgtatgtttataaattgttactgtttttgtttataatttattgccttctaacttaatatgtaattagcattccttttaattttgcttgtatgctttgctgtaccattttgaaattcttgagttaaatgcttaactattttttatcaagtttaaatattaaattaaatatgtcccatcagtttagtcattttaatattctcactcatcagacattttttgggaacaccatatgccttttcatgcagtcagtttcaagaaaatgaaaattactttttatatgtttatactcaaagcttggctagagataagtctccccttccttaagttggggagagagtgatttcttccaggctataatcaaaagagatacaattatagtaactttttgtgtttgtttgggttgtttctgtttgtttgtttgtttgtttgtttgagacggaggttggatcttgttgcccaggctggagtgtagtggcataatctcagctcactgcaacctccgcctcctgggttcaagcaattctaaacatattttagcacaaaactatttaagatttcaatttatatctttttattatcttccatatactcttttgatacattacccattatgttgattattaacgtacactcaagtcaagatcttttattatgtgaggtcatcagtcaatgataacagatattgatgaattagtctcctcatcagaaattgagcaacattttcattcaagacgacacatgggcctttaaagcatattcaataatactgagtctcagtgttctcctgctattttctgaatgtgcatttagacctttatacatctatctatctactgacccatttattaaattttcagcatttactttgtactccaaggaccagaaccatgtttgtcttgttcactggtgtactcctattgcaaggacctagaacatagtaggagctcattaaactctgaggtttcaaaataagtgaatagaggttgtagcaggaagaagtctaagatagcccctatgaccttcatttcctcatgttaccctgttgatacctcacacggcaaaggagtcttgcacatgtcactaaggctaataatccgtcagccttaagacggggggagtatctgggtaaacctaacctaatcacaccaaaacttcacaatcagggagttttctacaactgagagtagaatgggaagtcagagagtttcagagtccaagaagcatttatagcacccttattgactttgaagatgctttgcttcttcttttgagttcagtttgagattatctttctaataattgattagattttattcttgtaaaaaaagagataatttaaaggaatctatttttaaatactctgaggagggtgatactaggggtgctggttgtcctgttttaactttgtcttaatttctaatgtaattaaattttgagtaggtaatgtgacctgtgtggtttttattttaaaaaatatattgaggttttatataatctatttttaaaatattcaatggaaacttgaaaacatactgtttcacatattctcgtatatatatattaaaaatctttttttatttattttttatttttatttttttttgagacggagtctcgctctgtcgcccaggctggagtgcagtggcgccatctgggctcactgcaagctccgcctcctgggttcacgccattctcctgcctcagcctcccgaatagctgggactgcaggcacccaccaccacgcccagctacttttttgtatttttagtggagacagagtttcaccgtgttagccaggatggtctcgatttcctgacctcgtgatccgcccgcctcagcctcccaaagtgctgggattacaggcgtgagccacttagcccggcctaattatttgttttttaaaagacggtacataggaagaagtaaatcaggaaaagtggatagtgattggtggcagtagaagtgagtcagtgttacagttactattgctgcttaagaaactaacccaaatggcctgggcgccgtggctcacgcctgtaatcccagcactttgggaggctgagacgggcggatcacgaggtcaggaaatcgagaccatcctggctaacacggtgaaactctgtctccactaaaaatacaaaaaattagctgggcgtggtggtgggtgcctgcagtcccagctactcgggaggctgaggcaggagaatggcgtgaacccaggaggcggagcttgcagtgagcccagatggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatcatacaaaaaaaattgtactgcaaaaagctatgaatgaataaaacattttattaaatgtatttggcaccttgtatatacctagttgatctaggacagagaagatacttagtaacattcattttttcttactgtaagaataatgacccaggaggcggaggctgcagtgagctgagcaggccactgcactctagctctagcagacagagtgagactccgtctcaaaaaaaaaaaaaaaaaaaagaataatgaatgctcatcagagggaattgaattttattattctaggaaatctgatggaaaaagtgaaaaataaatattgataccatttataaaacaatgaaaagacttataagagaagccatctaggcttttctctatacttaattatacatataaatacatcagtactttacttcaaaaaataagatcatagggtacatttgattttatgatctgaactgctcacctgaccacacaaaacaaatactttaccatgacattaaatagtctgctctctggttgttagtgctggcatactattctatcatatggaaaaattacagttttccttcacccagtcaccgaaagttggatatttaggatgcgaccagtttttcatgataataaagactaataggaatagcagtagacataagatgtttttggcatcttttttttcttgtaatacgttctacatattgaaactaataattgtattttgctacatattgccacgtttttctcaaggaaaattatagctaacagaaagtgtcagctttctctgtgtgttaagggtgtgggtggaagctcggcagtgacgctgagacatattggtatggaacatcattggactctctagagatcaaggtagcagtcctgtagaaatgttagcccgagctgtgtgtcacctgggagtactccaaggacggccaaaagaaatattttagttagaagacaatttataagaaaagtttagaggcttcctagagaggtcatagcatacacaattttatttcatcctttagggcaagccgtatatatatgttctgcgcacatctcctcctgcaccctcctcaaaaaaaaaaaaaaaaaaaaaaaaaaaaaagctgagatctgatgtaaatagatagctgtgaattatagcttggtccttaaggaatatctcagaaacttcaatgttccttcaccccctccgcaaacccttctgaattgagaatgggaaccttggcaacagaggggagtcatgcacctcccttttccatctgtgactctggcatcttcctccaggtcagccatggtgcaaactctcacagttactttctggcagtttcctgcattccaaacctgtttctgaaatgggcaatatttgtccccttgaaaatcacctgtgataaatgtggtatagcccacggccagtgaaaattttcctacagggagacatattcctaagtgttaacattaactttttcagatgtttgagtcagactcaattgccctttcatattatagattgaaaacaacacttggttgatgttagtatatctgattgaggaaatatgagagcctttttaatttagatttgctcgcctagaaaactcactttgaaacttcttggtcatgttatgtttgcttatggcaaagttatcagcaaaaaagtcactgttatgcagcaatttatctttaaacactaaatgacatctatcatttttcaaagaaaatagtgtcagcagttaaaatcctaactgcttgagcactgttagttgacaattataatgccccattgcttagaaattaattgacctactttcaataagaaacataaaaagtaatatcacagcaattttctggatctattttattccaaaaccaataaatgttacagtgttgttaaaagtaatagatttaaaaacattttattttcttaaacttaacaattcaaataacataaaataatattacgtttctattaagtattcatttttatacagaccaaaagttctttagaaaatgtcttcatgtataatataaatttgatttttagatgtgagaaaagcaacaatcataatcgttgcctaaatccacaaaataagtagatattctataatatgtatttcagtaatcacaatgtattggattcaggcagagatgagagacactctgattttagcagaaaaagactgtgttaaattacctctttgccttttctcactctgttcctaggatagcaatataataaatagtaactttagaactgggatacactgagaaaatgtcctaatttaaatctcaatagatgattacacaggtagtgtttacacacacacacacacacacaatgacaggagtttttaaagatattagtatctcggaatttttgaattctgaaaactgtccaagcttttatcattaaatcacttgttatgaaacccattttagaaacacgctttcctatttttaatagcctatgatagtcatacagaatgagttaatcaaaattgattggtcaattgctaattgcaaattctttgaccgtagcatgtcagctgattctatgaacttctacagactctttcccttggtccgggagttgccacaacactctgactcctttccccacaactccattacatgatattgtcacctccccaggcttacgatactaatattccagagagatgaacagtccttgattttgaatagcaatgcagtagtgaccaaaacagatttagttttggttcagaagaaagtgctggatatgccctcagtaactttccatggtcatctaattcagcaattagtttgagtaaattcaatggaaggctgctttctggaatgggtagtgtaatgtactgacttccctattagacatttcatttaaaaaaatcaattgtccgcataaaacaaccatttcaatcagtgtacattcaactggaaaggaaagttagaggactttttttgaaagtaatgggattggggttggccgttgctaatttctttttgattaaagcgtatgtaattgttttgtgttggataaaaatttgactttttatttgcgcggatgctgctgatcttatatgttatcatttcccattcagacttgagctgtttacctgccgggttttctgttcataaaatgttgaaaggacgttaaaatgtagaacttttacattttttatttaggtgactaggacaaattctggtaatttgtaggctacaacttaaatgtatttctgcttaaaatattttgaaatatggtttatttcacaaatgaggttccaaactataaccagctctcactaaattcttatttatttatttatttatttatttattttgagacggagtctttctctgtcacccaggctggagggcagtggccggatctcggctcaccgcaagctccgcctcccgggttcacgccatcctcctgccccagcctcctgagtagctgggactacaggcgcccgccaccacgcccagctcattttttgtatttttagtagagatggggtttccccgtgttagccaggatggtctggatctcctgacctcgtgatccgcccgcctcggcctcccaaagtgctgggattacaggcgtgagccaccgcgcccagccaaaagatcatttttaaattatgtatctgggaatatattatcaaaccaggcctgaaacttattaaaaagatggtaaaatctaatttaacttcatttaatactccttttctcttagtcttataaaagcaaatgagcttgttggcttttcattatgaaaatataattttaatttataagacatatgtaacaaagcaagatagctgctaaattcactctatcctagtaacttcctattgcatacattcatttttaatgtaataagaaaatcctttcaaaatgcttaaaagaatcacattacccaagaagaggctcaacatttctagaaaataaatatgttcttaagacacttaataattcttgaaatgaagacctaattcttcagggctttaaaatatttgatgtgcactctttacatatatagagagtttaaatttaataatttcccttcttaaaaaagaagtgaaacataccacaaacatatcaaagcaagttattcatacttctcatttaagtaactgtattgtcatagcaaaattattttatatcatcaaacagcacaaaagccttattagaatactaatttcaatgtctgtttcacagatttgctcagaatagattttttcatgcttctgcactaattcattgaaggacaatgttttaccgattcctgaaaaaatatcattatctgccccatagtggtggctcatgcctgtaatcctaacactttgggaggccgaggctggcagattgcttgagcccaggagttcaagaccagcctgggcaacatggtgaaaactcatctctaccaaaaaaaaaaaaaaaaaagtaaaaagttagccgggcaaggtggcgggcacctgtagtcctagcaactgaggaggctgaggtaggaggatcacctgggcctgggaggttgaggttgtggtgagccatgattatgccactgcattccagcagtgggtgacatagtgagatcttgtatcaataataataagataaaatagaaaataaaaatatcattaactgacattttaaaaagtatatttcccaatggataaatatactttgtggattaacaagagaaaaatttcaagatactgtaaatttaaaacaaatctttatgtataataccatcgtaatgtctttgaccaggagcaatctatcatgtgagataaaaaatattaaatatgcatttattgaataaatgaatgaaaatcatgattaccttgatcactatatttaaaatttaaatgaagcaggaaagtaaatcttcctaattatcatatacttaacataactgtttaaaatcactctaataacaagtaatatgttaattttgaattataattttaaaatgcctgtattgtttcattcactcatccttccattagttcagtgaacaaatattgattacttacccactatgtgccaggtatcatcatagattcagggagtacaaaaatggttaaacgaagggatcagctggagtgaccgttttctagaaacaatgcctatttcagttatgaactagtctgttttgaagaaagtggtgagggaaagctgaaaatcctattttcactttattcaacaaatcttattgaggtcttattatgaatcaggggctctcctaggtatgggcatacaaaattgattaagactgtgcttgcttgcagaaaacaaacaaaaaagcatctctataataaaaaggaaaaagaggaaattccctttgtaggtttcatagtttatagtgatactgctgatgttgtctcagagaattagtcacaattataggaactcagaaggcattccgttgagatgaaatagagactaaagtagcagagattacttagtgaaataacaattcgaacatagttataattcattttagaagatattatggctcacacatagtagatgtgatgactgaataacaggaatgtggaacgatggcaccttggtagccattacccattgccaacatgattctgcattaaaaaatctgtgcaaaacggccgggcacggtggctcacgcctgtaatcctagcactttgggaggccgaggagggcggatcacgaggtcgggagatggagaccatcctggctaacacggtgaaaccccgtaactactaaaaatacaaaaaattagctgggcatggtggcacgcgcctgtagtcccagctactcgggaggctgaggcaggagaatcgcttgaacctgggaggtggaggttgcagtaagctgagatcgcgccactgcactccagcctgggcgacagagtgagactccatttcaaaaaaaaaaaaaaaaaagaacacaactttggagtatattaataaacattgtgttttttaaaaaaaaaattttaatctttaatttccgttttcacatatttcttcttgcttccaaaaggaaaggagtgggtagctctgttgtacaccgtccacggcccctggatccgggcggggtcccccgggccacctgggggtccacatgcagcccccgggaggccggtgcggggtgaggtccgggggccgccttattgctgaagtccggccggttggggccccggcggccgctaggcgctctggctgcgcagctcctgggagatgaagcggcgcaggcgctccaggtactggctgtagagctggatgtctttgtgcccggcgccctccacccacagcggctccacggccttggggcagcgctcctagagcgccagcccctgcgagaagtcgatcacctcgtctttcgtgccgtggataatgagcacgggcgacgtgatcttggacaccttctggattctgcgggaggggcgtggggcgggtgagacctctccgggcccgggccccgccccgccccagtccccgacccagtccccgtccccgcccctgtccctgccccagcctgctcacttggggaaggcgtcgaagcagtaggtcttcttggtgtcgggaaggcgacgctcaggtccaaggtgagcggcgagtgcagcaccaccgcggcggactcgtagcgcgaggccaggtccacggtgggcaccgtgccgatgctctgccggtacaggatgatgctgtccgggctgatgcggtacctggcggcaccggagcagggtcagccgcggcctccgactcgcgcgcacccctcccgccagcgggcgtccccgggcccagctccagatgcgactctccagtctcccggctcagcctagtcagtgggtcaggcccaggctccacagcagtcccaagggccacccccagtcccccaagaccgcagcggtgggcggagccggcggcgtggtcctgttccctggcgctatggttcactggcgtttcctagccaggatctgctggatcctggctagggagtccccctcgggctagggtaggggaagccctggcgcctctccttctcctggtcatccctgggcgcacactgggaactgtgtgcccccccacatcctgaatgcttcatgccttcctgcccaggttagaaagccgttcctggtgcactggccggaacagggtacactcttcctccctgcagcccttgcccacccccttggccatgaggaattcaggcagctgtgtccccacatgtctccacccaattttggactctcggagtcccatgctcaatgaggtgccagcccaacccaggtcaacatcgagggtggcggctgcgggggcagcacctcctcccaccagcgccttcccttgggagtggacaagtcctcggccacctcagcaccaccagctcccacccagggccacccccaccgccaggtcactggtgtgcggcccctggcccagctggtccagcaccagtaccaaggcctcctcgtgcccagtcccaaccacgcgggacccacctgccaccctgtcgatgccgcaaccccagaactctcctcccacacgctccaggctctgatcccaggcagatgccctcctgcgaggcaggagcatgggcaggtgtgcgtcccatctgcctggcattcggactccaccagcagggctgtacccctccttggcctggaatcccagcctcctggcagcactccacagctcactgttcacccatgccccaaaggatgctgcctggctggtgcctgtggccccagctctgcctcagcctccttggcctgctccctggcagccaaggccagtagtgtgctgagccagcccagccctgtcacctgctccaggcaggacccccagctgccacctggatgtcaccactcagacaatcaaacaagacacatcctcagtggaggccctgagcgcgatctggcctccccctcatggctctgggccgaggttcctgcaggacaaagcagcagcaggacagatggccgagcagacagagctcagagctggccatggcgggtgtgactctgccagtgccctgggcagtagagacaggaggggtccgaggaagctgcatgaagtggtgcttggtttctgcgcccacactgccaggaggcccccagagccagggtggtgccaggggacccagctcccaggcccacagaagggactgcctgggatatcgccaaggcatcgaggaccccacctccccagggcctctgacttctcagagctgcgcctggcccctgcaggagcggggcagaccagtggggggcagggccaggacgagacagccccagcgggtggcaagcaggaaaggcctccagaggcccacgcgggtcttctgatccagagcagcactggcccgggcggtgggcggtgctcaaacaccagtgaagggcccaggaaagtgcagggctggggacctggatgtttaggagggctggatctggaatggaggctggcccagacctcaggtgtgtgctgggggtctgcacctgacccagcaggccctgccccgggatggccgagctccacagccacagggcctcatgggccaggcctcgggacctcgatgcagcagcctcgcctcacctggccccaagtgctgcctcggccattgggctcccagccacacgtgcacagaccccccccagacaccacccaccccctcccgccgggtggcgtccacgcccctgtgacaagctcagccccttcctgtcctcaggccaggggatcccagagagcctggctccacaggccagggtgtggggggacctggccacacctcagccatgtggaggcggcacccgcacgcctgagctcacctttccggctctctggccgcatgcgtccactgtggctcctctcctgcagggccgcccaccttcctcccagggaagcccgcccctccccccggcccccggcctggtcccctctccggtgtgcccaggctgagctgcccccggggtcgccctcacctggtgcgcagggcctgccgggcggcgtcgatgtcggcgtagaggttcgtctcggagggcctgcccgagctggcaccgtagccggagtagtcgtaggagaagatgttgcagtggaggcgggaacacaggccaatgtagaagctgctcatctggcccaggtccacgcgttgccttccttgttcatgcaccgctggtcagacgcaattcagctgatgtaggctgggcttggctagcattggcttgaagctgcagctggtgtccagatctgttccatgtatttgtgatcctcctcagccctcccgggtacttgaagcatgttattgttgtggccaaagtcaggagtgcaacctgcctgtgcaaaaacatgccaggcttctgttgccttaaatcctctaagatacccctttggcttaagcagagtcacacagcaaggatcaaagtcaaggagtggggaattatatctgtcccttagagatggagataggagagagtgtgaacaaatgcaggaaaatgatctcatctaccagagtgtccttaaagattttaacataataaattcagtattgtttttgtttgtttgaatgaagctttgcatggacacagtacagtacaaaagtactatttgaactctttctccacattcataaaattgctacatagtttctaccatgattatatttttatgatccatttttgtgtacagatctgaaaactttatactagaatttattagctgaggaaaggaacatgcactgacatcatcatacacaaatatttctcaacattttaatgcttgtggtattgttaatgtttctgtggaaaattacttaaaatcatagaagtgatttctaagtcagttattgatttattctgatgaattataaaaatcagactaaattagtaatagagaaattacacttgaaatactagtctgagctacaaatgagatggatttttgtgctcatcatttgtactctagttatgtttgttgagattgggttatgaaaacatcattataacattatcagcagaaaagcctgttgtgctataattaaatcatctaaacaatcatttttgtggtcttaatatcctggatttctcaattgattgtagtagataagagttctctttaaatactacttattatcggtagcttgcttttctgtgaaatctagaaaatttagaattctgcattaacatttaataaaatacctgctatcctaatattgatgcattatatttatctatacaacatgcaacaggagagaaatatcagatgaattagaatatttgcagcctatggcaattatctgtagccacatttttttttgtcttcagaaaaatgtagatgattttggaaatggattagttctagtctcaatctaggaagaattacttatggaagttttgtgtacaggatactgatgttttcaaatataacgcattattattttagtttagtttcttttgccacatacttagaaattgttcaagtgaacaggctattaaaacgaatggtatagataaatggtatagataggcattgtaaacatcccacttttcccaagccatgaattttaacactggattaaggagatgaaaatggagccattgggaatgtggattctttgctaataattatttttcttctttaaaaagattcttcaaaaggcaagaacatggaagtatttcaggagatattcttgaggtatctaaaatacatactcttcctatcaaaatcaataaatagatggatgtaagtaagataaagtcagggcaactgattttgcatgtgagtgtacacacagacacatatccaggttttctccatctgttctcagttgctgaattattagactcagctgaccgcttgactgtgtttaatctgataaacagactcttaacaagaagaacaatgttttaaaaactggactgttcctcctacttctcagcatgcatcagccactctctttccccatcctatctcctgccaaattggtctctacttatctgttccacttggagacactatttgatgttgttgtaaatgacataaatgaatattcactctacctgctttcatattaattcagttttcataggatggtctctgtgggatcaagcaaaaggacttagtggaatatctcttatgactccataaagtaaagaatgtggtgagtttagcagagtgcaccttcctttactaaatgtgaatgatgtgtcagtatagggggccagagtgaaaagtcctaacatatgcttgtttgggcagccaacaattggtcacattgcacatttcatgttacaaaggagcctcatggtagtataaatgagggtcaggaaaagacacttaactgtgctctgggctttaaaatggagccagggcaagaattctggaatttgacaatgtcaggaaggaaacctctgtaagcaggcacgcaggggactccagaaatctcttctttgccactacaactctggactttcagaaatacacaccccattctcctgtattaatacacacttcatgttcacaacatcaaaaaccaattttaaaatagtaaacctaaggtagatggaaaggcattatagcctcagcatgcccgagatgtgaggagcaaatcagaaagatgtgagtgtgacgagaaagggacatcgtgctaaccaatcatttaaaatttttactccaaagaaatggcaatatttcacaggttttttctcatcaccaatctcacaaatatacatgttttttgaaaattttcctctcaattcttctccttgacagtgaagtccagaagaggttggtttagatctaactcttttcagcctcaatactccataatcactttggcttttttgattatgactggacggcatgtactattattttaatattaaatatttaggaaataattttaaatgttatccttaaataactatgggctttattcatttactgtatgtatttctcaaacattcataagaacttaaggattttaattcaaatggtccctaaagtagaaaatgcactcacagattctgcatatgtcttttaagaaacagaaacgtgccatttgttattaaattgagtagactttgtatcctttagaatttgggcagagttttcttgctatattgtagagaacctatcaaccatatcttaattttcttctttttgaggtcttcaaaattaacattggcattggtccactaattccttgttttctatttttggatgagtgtgcatagattacctccatcttaattttcaacataaacttttagcagactctttcacctttcattgccatgtaagcagatgtgatttttattcttttttccttttcattgaacagttacttcatttgaaatttttcacttgatttaatttaactttattttttggtggtagatacatctgttgccacctgtgtctggttggcattttaatgtgttgcctcgaagctgtaaccacaatagtggcacattttcctgctgttcctttattctttgttccatgtgtatctattttcaataaattgcattggtatattatcatagattttctttttgtctctcagattttctgttgtaattatttttatttatgcctttggaaatattttatgattgttacataaaacagcagagctctttcagaaagttttcatggttttccaaatgtacattcatatagattatttagtagttattacacaatgatctttggagcaataaatgctgttacgtaagaacaattcccaaatgtaatttgagttataagctagcctttgatggcctagaattgatgtacctttataattctaatctgcatgcaaatttaagaagaccaaggattgaggattgggtgcataattttcagggcccagtaaaaagtgaaaatgtagaaccctttgataaaaacttacaaagaatttcaagatgaccataataggccatgcacaaggcctttgtagatgggtagagtgaccatgaagccatgggcattgtttggttttgtttaatcttactgtttggttgtaaagcagatttttaaatcaagagaaaaaagaacaccaaagaagatctctgtcaaaatgtttgaagcattatagaagattagatccatataaatgaaagggataaagaaaaagcacatatccaacctcaaatataaagcatggaattctcatatgaactccattatagcacttgatatttcagctctattttcatttttgaacaactctagatatatctatatattttagtctaaaatttaatttttataaattgtaagtacttccccaaattctaccttagataaacaattcagagataactctgtttcctattctattaggtggaaccatatgaaattgtcagtattcagccttttttgtcctacaaaaaaatgacagttttgtgtttccacctaacacatggcagcccaataaatatgtgaaggtcaggaccacagagctaccacactaaacaatactaaatgcatacacataccctttccaaaacccggcaggtcttcttttccccaagtgaaacattctttgactcttcacccattattcatgtgagaaattttccaggcacttcaacatgtcagctcagtgactgtaacaattaggtttattaattctcctctcacaatttgacattctttattgaaaagcatgatttaaatgttgactaatagtctgcatagtgaaacatttttactagttccaatgacctaaaacagtgtaaaccatgattcagaaatttattttcttaaaaacttctaaacaaaatgtctgctaggataaaccggtgcaatttctatgtgaaacctaagaatttcaatgacacattttcatccttattgccatcaaataatccctttaatagtgccccatctttcttactccttcatatgattttctatattattattttccatcactcattctgttaaaactataatagtttcttcagagaaatgacagattttcccacttcagaggcatttctgcattgagctctcataaacctctctaacatggtgggcaatagactcaataacatttgtgtataaactcagttgtgaattacaaaaggctcatctataacgtcaaaaagcaactcggtaaaaacaattctattgaagatagtatgatctaaatatataattttaggatggcttcaactgagacaaaaatagcatcgatacagtgtggagcaatgaatttctaaaatttttatcagcttaacatttttcatcagcacaatttatacagaagcccaacatgagacattcttgttcacatggaatttctctgcccgctggagccctgtagaaatcccactgtgttggtaaacagcagtagcaacaagaagatactaaactggaattctcagtggctcaaccaaaccaaagtttgttggttgctcccataaagttcaatgtcagtcagaataaactcctctagccttaacctatgacacacatggcacataaccttccaagtactggcagtggaaaaggagagaacttgggaatgaggcaggggcttcatggtgaacatggtgaaacctcatctttaccaaaaatacaaaaattaggtgggtgtggtggagtgtgcctgtagtcccagctactcaggaggctgaggtagaaggatcgcttgggcctgggaggtcaaggctgcagtgaaccaaggtggtgccactgcactccagcctgggtaacagagtgagatcctgtctcaaaaaaaaaaaaaattgtgaaggtgaaatttaaatacctttgtgcatagctatcagttattctttgttttaatatttagtttattgtgaaatataacacgtatagaaacatacataaaacaacacacagggccaggcccggtgggtcacgccttgtaatcccagcactttgggaggccgaggcgggcggattacttgaggtgaggagtttgagaccagcctggccaacatggtgaaaccccatctctactaaaaatacaaaaattagtcggatgtggtggtgcatgcctgtaatcccagctacttgggaggctgaggcaggagaatcgcttgaaccagggaggcagaagttacagtgaaccaagatcgcgctactgcactccagcctgggcaacggagtcagactgtgtctaaaaaaaaaaaaaaaaaaaaataggccgggtgtggtggctcacgcctgtaatcccagaactttgggaggccgaggcgggcagatcacttgaggtcaggagttcgagaccagcctgaccaacatggagaaaccccatccctactaaaagtacaaaattagctgggcgtggtgttgcatgactgaaatcccagccactttggaggctgaggcaggggaatcacttgaatctgggaggtagaggttgttttgagctgagatcacgccattgtactccagcctgggcaacaagagcaaaactccgtctcaaacaaacaaaaaacaaaacaaaaacaaaaaacacagtgtaacatgttattatgaagtcactgctcagggaccaacttggccgctcctgtgcctctagagggaagctccttcccactgttctttagagttttatatgttaagtacaggagtcaacaaactaggcctatgcaccacatctggcacccagcctttatttattttttgagatggcgtctcactctgtcatcctggctgcagtgtggtagcacaatctcggctcactgcaacctccgcctcccagattcaggcaattctcctgcctcagcctcctgagtagctgggattacaggtgtgtgccaccacacccggctaatttttatatttttggtagagacggggtttcaacatgttggtcagtctggtctcgaactcctgacgtcaggtgatccgcctgcgttgccctctcaaagtgctgggattacaggcatgaggcatgatgcctgacccagccttttctaaaatgaaggtttcggctggcgcggtggctcatgtctgtaatcccagcactttgggaggccaaggcaggtggatcacctgaggtcagtagttggggaccaccctggccaacatggtgaaaccccgtctgtatcaaaatacaaaaattagctgggcgtgatggcaggcacatgtaatgccagctactcgggagcctgaggcacgacaatcacttgaacccgggaggcggaggttgcagtgagccaagatcacacgattgcactccagcctgggcaacgagcgaaactccatctcaaaatacaataataaaaaaaaggatgtccttttttgtctctcaaccccgttttttatttttttttattttcagacagggtctcactctgttgcccagggtggagtgcaggggcccgatcttagctcactgcggcctcaacttccccagctcacaggatcctcccacctcagcctcccaaacagctgggaccacaggtgggtaccagaagttattaggatagagtgaatttagcagctatcttgctttgttacatatgtcttataaattaaaattatattttcataatgaaaagccaacaagctcatttgcttttataagactaagagaaaaggagtattaaatgaagttaaattagattttaccatctttttaataagtttcaggcctggtttgataatatattcccagatacataatttaaaaatgatcttttggctgggcgcggtggctcacgcctgtaatcccagcactttgggaggccgaggcgggcggatcacgaggtcaggagatccagaccatcctggctaacacggggaaaccccatctctactaaaaatacaaaaaatgagctgggcgtggtggcgggcgcctgtagtcccagctactcaggaggctggggcaggaggatggcgtgaacccgggaggcggagcttgcggtgagccgagatccggccactgccctccagcctgggtgacagagaaagactccgtctcaaaataaataaataaataaataaataaataagaatttagtgagagctggttatagtttggaacctcatttgtgaaataaaccatatttcaaaatattttaagcagaaatacatttaagttgtagcctacaaattaccagaatttgtcctagtcacctaaataaaaaatgtaaaagttctacattttaacgtcctttcaacattttatgaacagaaaacccggcaggtaaacagctcaagtctgaatgggaaatgataacatataaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcctccagctcctgcatcttatcatcctgctcaaatatcttatactccagccacatcaacacctctgcctgcttgacaaactactgctccagaaacaccatttaatccttcagatactgcatcatcacatcctatggaatcaactgctcctgctgcatctgatcaaacacaatacacatcttatacattctggatatagagaagcccatttgaactcagacactagggaaaaactaaaggagaagttataacttgaggtagccttggatgtattgaggtaagaagaggacatctatggtatggttaatgagaacttcagggcaaaggatgtcatcccagcaaggaaaacggcaaaggtacgtgaacaaggcagacagggagaacaggcctctattcacaaagcagagagtacaaacgttggaaagcaatggatagagggccacaccctgaagattccaccctgaatgttgaagactctccactgagtgatataatgggctctggaaattcataagggggaagttggcaggtgggtgtggaataaaaaagctacatgtttggtacaatgtacactactcaggtgacaggtgcaataaaatctcagacttcaccactatacaaattatccatgttacctaaaccacttgtgctccaaaagctattgaagtaagacatttatttatttatttatttatttatttatttatttatgtttatttatttatttttttgagacggagtctggctctgtcgcccaggctggaatgcagtggcgcaatctcggctcactgcaagctccgcctcccgggttcacgccattctcctgccttagcctcccgagtagctgggactacaggctcccgccagtacgcccggctaatttttgtatttttagtagagacggggtttcactgtgttagccaggatggtctcgatctcctgacctcatgatccgcccgccttggcctcccaaagtgctgcgattacacgcttgagccaccgcgcccggccaagacatttaaaaaatgaaaacaaaacactatcacctgagtaatttgtttgcttacattaaatatcataatacttttcagcaaaaaatattatcattttaatgtaactttcgttccctgtatttgagcggagtactgcactatccataaacaccctctgaattttctacagtaatggaaaaaaatctttgaaaaaaataaaagaaggttctatgtttgagaatatggctatatgaaaggggtttcaagaaatatccagttcttcccaagacgatgtacttccagtgaccagttttaagaagtggaacaggccaggcgcggtggctcatgcctgtaatcccagcactttgggagtccgaggcgggcagatcacgaggtcaggagatcgagaccatcctggctaacacggtgaaaccccgtctctactaaaaatacaaaaaattagccgggcgtggtggcgggcgcctgtagtcccagctactcgggaggctgaggcaggagaatggtgtgaacctgggaggcagagcttgcagtgagccgagatcacctcactgcactccagcctaggtgacagaatgagactctgtctcaaaaaaaaaaaaaaacaaaaaaagtggatcgaatatttcctaacgaggtccttcaagtaataataagtgattaaactttttgataatgataatatcaattggacatgataaaaatactattaataaatcttttgatttaaaaactaaccttgtacccacttcttttgtaggcgtggggggagcttagagttaagtattccagtatccgttagggatttggcagtatacatcaataacaaatagtagaaggaaaataattatacctgtgtcatatatatatatatatatatatatatatatacacacacacatagagagagagagagagagagaaaccatctcttaaattacctgtagcaccactatgttattctttactctcccaataccccaagtagattgcacatgtgactcttttattaatgtgttgaatattcataatgataatgaataatatgaataaataaattgataagtgcgtaactatgaattaggcattgctttactcttatctggagatttcaattcatgataaacatcttttagtgaccatgaataagaaactcatagacctgcattagagaaatgcaaatctaaaccacaatgagataccatctcactccagttagaatggcagtccttaaaaagtcaggaaacaacagatgctggagaggttgtggaaaaacaggaatgcttttacactattggtgggagtgtaatttacttcaaccattgtggaagacagtgtgtgaattcctcaaggatctagaactagaaataccatttgacccagcaatcccattactgggcatatactcaaaagattataaatcattctacgataaagacacatgcacacgtatgtttattgtggcactattcacaatagcaaagacttggaaccaacccaaatgtccatcagtgatagactggattaagaaaatgtggcacatatacaccatggaatactatgcagccataaaaaaggacatgagttcatgtcctttgcagggacatgcatgaagctggaagccatcattctcagcaaactatcacaagatcagagaaccaaacgccgcatgttctcactcataagcaggagttgaacaatgagaacacatggacacagggaggggatcatcacacactggggcctgtggggtgtgggggtgtaggggagggataacattaggagaaatacctaatgtaggtgatgggttgatgggtgcagcaaaccaccatggcatgtgtatacctatgaaacaaaactgcaagttccgcacatgtaacccagagcttaaagtataatttaaataaataaataataaataaataaataaactcatagacctcaaagtatgggaagcctaactgcctacggccacttgctgcttcactctaaaatctgtttctgcatctgcccctcagtcaatgactgaggcccacagggtggctaatgcagatccctctttaggagacacagggcttctctgaggaccagtcttggctcaggattccctgaagccttttctcacccttccttagactgtacattacgctccagtgcttccactcaaccttcctttcctctttccttcattctaggtcagacttgcctcatagctgagacctcttccaggcttactcagcttcctctccattttctctcacagggatttcccttaataaaatcctcttgtgtttaactcgttttcaacatctacctcttggaggacctggactaacccaccacataatgtttgtattataattacttccattctacaggttgagaatctgggatctggagaagttaagcaacttaagttactcaagtaaggccacacaacgtatataaagtgtgctgcaaggagttaaacccagggaacgcacactccaaaacagaaccatcaacaagtaccaatcctgaaaccaactaataaaaggtaaagatacaattagcttggtgcaaaatgttatttttctctctaattacattttctaaggtttcactgtttgtgattaagaagggatgaatgattttcatcaaaactctgctcaacaagccgggtgtcgtggcatgcacctgtagtcccagctactgaggaagcagaggcagggggatcacgtgagcccaggaggttaaggctgcagtgagctgtgattacatctcgttgaccacgtgaccctgagtgtaactcatagacctcaagcctgggcaacagagcaagactctgccttaaaaagtaaaactaagcaaaacaaaacaatcctgaacaaatggttgcacataaccagctaaacagtaatataacagttgttggcagggtgagaagaaactagcagactgtaggtttgtcatactgtttttttgtttctccagaaacacagatataatataggcaatgaaagctgagactcatctcttaatttcagttaagctattaattgatttacatcatttacttacaggtcagaaaagttcctttcaaaaggcaggaatgttgtttcatgttaatctaaggacttgcttaccttttgtttctgttcttaatgatcacagttactaatacagttaaataatatttagataaaatacattacaattatagctgatcaaaaatctcattccaagctgttatattgttgactatctcatgatcactcttcttatgaatcatgtaaatagggaaaaatactgcaaagtagacccacgttacttcaaatgaaatatgatttaataaaatcagttattctttgccaattttgtaatgttcaaaataaccacaattgaaatagtgatacatacacatcagaacagttcaaatgaaaaagagaaatgataccaagtgttggcaaagatgcggagcaactagaactctctcccattgtggatggaaatgtaaactgatggacaccaccattttccatgtatgctaaatctgaccatattctatgaccctgagcatatacccagcaatatttaccaaaagacaaatacatgaatgctcagagaggcaccattcaaaataaccacaaattgaacttatatttgtataatgatatagtatatagcaatgagaacctaacaaattacaactatatgcaaaaagattaacaaatcttataaactaaatattgaatgaaagaagcaagatacagaacatattctacgatctaattcactaaaaattgtaaaactcatcagttatgttccaaatcaccataagagcgatcctatgaaatagtgtctagaagaagtaataatataaaatttcctgacttgagtactggatacacagaagggctaagtttgtttaaaaacaaaagaagtattgagctgtacagttaagatttgggtattttactgtttgtatgtattttcagcgttagaaaattatgttaaaaagtctttatgctctttttcttaatatatttacaatagacaaattttcattaagccacagtataaataaaaaagacccacacaggtatttttaacatggatgaagtggttctgtcatcattaaatgagtactttaggatgcaagtctgatataaaaacttacttccctgaagactttaattttgcatgcaaaatacacggtttctaaattaaatttttttgtaacaaagcgtttttgagttcccctcatggaattttaataaatcattaatttcttctttttctctttcatgcacaagcagtggataaacatttcaaagatccctacagaagtttcttcccttgaaatactgttcacatgacaatgagaaggatggaataaaacacaaaaaaggtaagcaattttttttttttgaggcggagtcttgctctgtcgcccaggctggagtgcagtggcgcgatctctgctcactgcaagctccgcctcccgggttcccgtcattctcctgcctcagccttcgaagtagctgggactacaggcgtccgccaccgtgcccagctaattttttgtatttttagtggagacggggtttcaccgtgttagccaggatggtctccatctcctgaccttgtgatctgcccgcctccgtctcccaaagtgctgggattacaggcttgagccactgcgcccggccaacaggcaaatttttcgttggggaagtagtagaccaaccatctgtgcttatttcttctaaacagagctgggaatgagtgacagcagttgaacaggaacacttgctccccaagcactacttgtttttcatgaagaaggaaaaaaggcaaaagccctgctacatttacattcgcaaaattgttttcaaatgaggattaacaagatgttagttccctctctgttgaacacataaaatattaaaaggcagtgctaatacatctatatacagcacatcaggaggaaggaggaagtcatttctcctgactttaccaacttgtcttatttgaaactgataccgtgccctattggctgataggagtttcactttatttagaatacaatagaatttggctcagattcacaccaaaagtatagtattttgatgtgcacttacacgatttcaggggaaaacaatatctggaatgtgaccctggaattcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagtcttattacaggtaggaaactgaggttccaagggggtgggaagtcctcctaagaggaggggtcagactggaagctacacaaaaagaggcagaaatgtccctccgcctcttaatcggagcctggggaaacaaacacactcgtgcaaaatctccaaagaggtgagctcttcaccctgtcaattttatctgcctcgtgaaccccagggctcaggctccaggcccgggctagctcacacaacagcagaagggccttaggtctgggcactgagccaaaaaaagggaggctgtggtccctgctttggttaccctgccgggtctgagcgccaaatcggatctcctacttctctctccctccctccctctgttcctggactgggggcaggcccttctgctaacagaaagccttccagtcggagaaagctctggcagcctgccgcgataaagggccctgggggcgtgaggagagcaaggggctcaaaatcagaacccagcgtgacgacagtgcctccatgactgtgctcccgcaatgcgcaggctccatgtcctggcgcccgcccgcccatggacccggcgggggcttccaggctgggctcagccattacgccggcgtgcgggggaggaaactcgcctcccgggcactcggttgtctcctgcccccgcccctccctccgatccgggcccatctctgacgtagtgtgaccttgctcatcccttccaggctgtgggcctgttttccctgtgcaagatgagggtcctggctgtcctgaggacgctgtccgggcgccgccaggggtgaccgaattcagctctgctaagactgttgggaaatgaactccctgtcggcgtgtggcagcccgcctgcgccaagcgccacaggaaaagggggcgctcctgtccctttgccgccccccaaaatttttctgggaacggaatccactgactcgcccctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatccatcttgaaaagataagctttctgtttgtctttaaaatatgacccacaatatgcctgtttttaaacagtgaatgatgctctaaaatcacaatataaattcaggcagtgctccttacatggaaagtttaagtacttctaacactgctctttttcacttgttatgaaaacacagaacaattatctaagcatctaattattcaggtcctttgtttctcctccaatctattagttttatagtaattttagggcctgtgaggatgaagctgtctgtgacagctaccacaaaggttactataggtggacaaatttcaaacaagtttatcaccactaccatccccaccataaaactgtctcaatcaagggcaacacaattcaatattagccaagacaacctctttacctgtcactgcttaagaaaaggatttttggtcttatttagaaataactttccgtacctatttttctccataaatccactgagaccaatgtgtggctctatcgcaagcaccagcaagcaaaactgcctgctagaaggttcagtttttgtatctttccaaatgtagaacacagctatcttcaaggatttcataattttttgaaaattgatgcacaaacttcttgaaagttcagagacacagcagctgtaattattctgaaggctggttacgggacacattaccttcatactttgctgtttaagaaatgtggggtggagaatcaagtaaactgatagaatttccatataaaattctaagtgctctgagaacaaaagaaacttaaaatacacacacacacacacacacacacacacacacacacacacacacacacacggttttccctactaatcattttacaactaaacaaccaagttgctaaaccagagcccacaaaagcagagtcaaagttctaacacttggtaaaagaaaaatgcacacatacccctgtgagctaaaaaaaaatgcttaagtattcaaagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaacagccgttgaaattggagattggaggctacagtttattgagacctggtttggtgctgttagggagctagaaggctgactgcagggcctgaagagtgggagagacagctcctttagggcctgaagagtgggagagatgtgaggatggggagacagctctttcaagaaattccgctgcggttgagaacagagacactcagtggggtcgaatgagggttttgttcccatagtagaggcttgaacacatttacaggccaatgggaaagatccagttgagagcgggtagttgagccttcaggagagaaaagggatgttccatggggcaaactcctgagaagggggaggagatggaaggaagcttctgtggatgtagcagatgcaggagggtttgtgtagttttagccgggctcgagccggtggctgacgcaggcaggaacaatggctcacccatgttttatgtgtatttccgtgtgcgtgctcctgctttccccaggtctgggccgcctgcctggcccgtgtgccgtagggaatatccacactgggcctgggcggaggctgggcatctcccgctctgggcttgctccctgatgagattctcagaccgtgcttcccctcattcatgagaggaaggttcacagagcaggcgtgggaacctgcctggccgccagggcctcctcccgctcaggctgaggtttgctgcatctctgtccttattcccttccagactggattggctgaaccaggtgtccactctttttggcccatggcataaagaagggtttgggcaacccagtgtgccccaggttgttaccgcccccccgcctccgcccccacccagcctttgatgggcccccttctcatcaatccatcacccctgcacatgccaccaggactgcctggaccagagcccgggactctctgaaacccactgagagctcggccctgggaatgggcctcccaatctcggtctccagggggtgggccccaggtccctagtcttcctcagggtcttctccactgttctgcctcctctcctgatacccagttcctagccggggtgaccccagcctcccgtaacagcctccttgtggtggtgctgggaagaaggggcccgtgtacccggcagggccccccaggcaatgggcatgagcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttaatgttagccttctcagtaacacagccagtgtgccccatgggcatctgagggtaggctccacacaccagatgtccacaccttagtgctcagcacaaggccagacacaatgtctgatgaccgctataccgtgctgagggaaagggataagggactagcagaggccactcaggtttttcttgggaggagcatgaggcagaggagggactagcagcagggaaatcctacctgcctgaccaatagcaggcaacagctccatgaggatgctctcctcagaagaaaggtgtatcctgacccaggtccttaccagatgtgaagcagcaaaagcgggagaagtgtgtgtgcatcctcattcctggaacttagaaaacctgccactaaccacgcagggtgctgaggggctacagcccctgcctgccaactcaccctgtgctcagagaggtccctgagggccagggcttccagctggggtttcgccttctgtgcttccttgcacccaatgagcctcaggaggccatctgctgtcttagagaaactggggcctcaggaaaggaccccaaacctcacaagtatatggtacggcagtacacctcctgatgcctccagaagtctgtggccagggaacagacaagatttggccccgccctgcccagtaacaaggtccctcacacccctcctcccatgcctggcaggaaggtgactcaggcagtgcgtctgggtagcctggggctgcgcttcccccaacgcaacatctaggttcttaggaaacttcatttgttgtgaaaatcggaaatgaaaagacagttggtgacaaactcctttctccatcacctccttattggacagaaacgacccaggaatgcgcctcgcgtgagtcctattctttcttggggtgcacacccgctgctggaagtatgaacagcaggtttgagggggaggggagcgctgacccgggcactgcgcagggagtctcaaggggggctgacgcagagggagggtcaggcactcccgggtcaacggtctcggcctggcacccacctcggtcacgacggtggacaggtagacgtcctggctgaactcccagccatccaggcagctctcctgctccagctgccccaggtccacgtcgcgccccggctccagcccgagcgccgagaagttggcgatggtggcgagccggtagcggctgcagctgtggggcacctcgcggccgtcccgcagccgcagcgggacactgttgttgcgccaggcgctgctcaggttcgcggcgtccggcactcgacagcggtgctccggggtccccgccaggaacacgactgacataccattgaagccattggggatgatgctggcgctgagcaggaagaagatgaggcgctggaagggcccccactcgcccaggaaggcgatcacctcgtcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtgttcatgttcccagggtaccatagcagctctacagatgatgcttctttcttcccctgagaaaaggatgcctaggatggacattaactcagcccaagtatatataactgtggtcctagaaattggttaattcgatctgctattccactggagttgtctaatagtgtggcttgaactctgtttttaggttttggacctccgagctggttaaaggagcatttacaaagtgaatacctcctcctcgtagggacacctctcttcaggggaagagaggtggagctaattctcccgaggtagaggggaaggggaagttctgaatatcccttttacattgctctatctcacactgaagtcctttcagggaagagtacttagggtgatagtgagcaggctgttgggacaattcccaagaggcagggttataaagagggggaacaatgtgggtaggagaagggtctgggacaactgcctctgcttgagggggaaggaggttagggatattggacgggggaaggtggtggaggaagttccatgtgttggtgagctgtctaggaacagggaccttatctttctcagaggagttaatttctgacttgcttttcaggattgattcctgagtccaaatgaaacaacaatattttatcatttgctgctttttcttgtatttagtcctttcactctcttttcaatattttagcataagccctaggggactatcaggaggaatgttattgttgctagctttatcctttttctcccctgcattacttgaggtatttcccatcttgaaaagggattggggtgaggctcaatttcccctactagaaatttcttcccagttacgagaggtttgtataaggctcaacctctcctactggagatttctcacctttcctttccttcccttcccttcccttcccttaccttaccttaccttacctttcccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatgccctaataaaagagtttcagcacagatctctaaagttctggagcaaggccatgcagcagagagatattcgacttttgaaaagcagctgtttggccccaataaaaaccaagagcctagcaatgggacatcaagggtctatgcaaccagagatacccattgtaagccaggtattgtcagagtctaccaagtcgtaagattaggcaggtttaagccaggcatggtggctcacacctgtaatcccggcactttgggaggaagctgagggcagagaattacttgagcccaggaggcaacatggcaaaaccccatctctaaaaaataaagaaaaaaaaattagctgggtgtggtggtgtttgcctgtagtcccagcaacctgggaggctgaagtagaaggattgcttgagcctagggaggttgaggctgcagtgagctgtgattgtgccactgcactccagcctgggtgacagactgagaatctctctcaaaaaaaaaaaaagcagacttatcagcaatccatcatataataatagaacaggaatggtaaattcaggatcaggactaagcaggtcaatagggtgcatgtaagtcaacaaaaggtggctcagactcctatgacacctacctcagctatcggctataccaacccttctgtcttagctcagacctacagccttagtaggtagttctctgtaaccaactgatggaggggaaaatagcccttactcacagatggattagctttagacattgatactagttaaaaaagaaaaaaaaaaaaaagagattgttcctgtaacatagctccatttagggggtagccctaaacaactttgaagggaaattcccccagtgggctaagctgtaagcagtatacttgttcattcattttgtatggaggacaaaacaattccagatagagatttacatacacttgtgagcaatggcaaatagtcgagtggtacctgttcagccctcacttatgtgcaatctggaagtgcaagcagttgaccaatggagacagaactaggaaacaaatacctcctcattctatatggctctttagaagcccccagtgggattaaacctcagtaacccacagcaatggggattgagacaaggctgaggtgaggaaaaagagcaaggcacttgtctctggtgcaaatttaaggaggcaccaagaaattcagtaaccaagattaattatattttaatgcaatattttttaaaatagaaattaatgcaaatacccatgatgaacgcaatatcaaaattttcaataaagacaggctcagtattgctaattttccatttattcttaggctccactagggctccacacaacactgttactgatcttggtcatcgccaataaccatctcaatttcacagtctatgttggctttacctccctctctgttcactctcctccctagtccctcacttctgttttatggtatcattactcagaataaacgaccttatatacgttcttgtctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncatatatccagaattagtattgctggatcatatggtgattctatttttaatttttttagggaccaccacattattttccatagtggctgcaccattttacactcccactaggaatgaacaagggtttcaatttctctacatcctcactaacacttgttattttctgtgtttaaaaacaacaacaacacttttttagaggtggggtcttgccctgtcacccaggctggagtgcagagatatggtcatagctcactgcaacctcaaactcttgggctcaagtgatcctcctgccccagcctcctgagaagctggaactacagtcacatgccctcatgcctggctaattttttatttattttttgtagagatggggtcttactatgttgcccagtgctgtcttgaactcctgccccctagcaatcctcctgcctcggcctcccaaagtggatttctgggtgttttttttttctttttgtagtagctatttttaagggtacaaagtggtacctccttatgattttcatttgcatttccctagtgattagtgatgttgagcctcttttcatcgcttgtacccccaatttatagacaaggaaactgaggctttcatcagtgatgtaacctgcctggagtcagccaggtggttggcagtggagtcaaaactggccctctactgagtctgactccagaactctgtgtgctgccgcccctctgggggagagccatccatccatcctgcttaccctggtacttgcttccttccctcctcctcccaaccaccagagcccagttttttgttgttgttgttgtttgtttgtttgttttgagacacagtctggctctgtcacccaggctggagtgctgtggtgtgatctcagctcactgcaacctccgcctcccaggttgaagtgattctcctgccttagcctcccgagtagctgggactacaggggtgcaccaccactcccagctaatttttgtatttttagtagagacggggtttcaccatgttggccaggctggtctcaaactcctgacctcaagtaatctgcccgcctcagcctctcaaagtactgggattacaggcgtgagccactgtgcccagcccctagttgctttttattttacttccaccactcaaaaaggaagccaggaagggaaaagctgccaaaaaaagcaaatcctggtgcatgtgtgtgaatgtgtgatgatgtacatccttagaggtccctgtgaacagcgtacaacatgagtagctatggacttggaggccagcagctactcacccctcacgccctacagtgaacaaaaccagcgagcaatggaaaagcagacaggtcagcccagctgccagggaaggctgccactcatgggtccagcctccataacaggcactgataacactnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntccaaagggtaagctaagataataattcctgtaactgtggtgttgttaatagcaaatgttttttaatgccttgtgtgtgccaagttctctgcggggtgctggagagacacaaataaataagacagacacagcctctgcccttatggatgatacctggacccatccctgagtactcaatacgtacttatgcagagaagaagaatgcatgaaataagcagtctgattattcccagcagcacagacacctgatgggtgtgcagtaaatacgtgaaggccactagggcaggggtgatgtgtgacctggccaccacacatccccaccctgaagagggcttccagaccctgtgactgccttatgacttggtattccagcatgatagggtctcagcaatacagcaatctccaaggaccaaggccattacaggggaaaaggaaatctgagggcttccttaaagaactttcgggagagctggagaagccatagaatctgcagcttgtctgacctgctgcctagaactcagggtaccttatgagtgggtttacagcatggcccctaagaagggccacccccaaactccaggtacagaacctgacctggcatctcccctgtgggaaggcacagtcagaagtaagcctctgatgttctcttaagtcagggatgtcaacatgagctcatgtgagggaatgactggcctggacccggatcctgcatcattccaatctgtccagatgctgcccaatgaaatggggaagtttatggaccagattctaaaaaattcatccagagtccccaccccacctccacctccaaacttgtgatagaagcctttggagatggattacactgcccagagactcaggggccaggaaggtcatattcaggaggaccacttcacattcccccggacagaagtaaacgggtaatgaaggaatttcaggatggaggcaaggagtgtaggcagtctttgggatgtgaaatcgggggaaacaagcaatgtatgaagaggagtttcaggaattcactttgggatacattgggtggaagcttccacagacccttgaggatcccttccccccagaaaaggtctgcactgtttacattcactaggactcttggagcccagctgacaggcctctgaccacaagccatgctgtacaccaaaccctcaggacagccagtgataagtgatggctgccccttactctctaccccatttagtagggtctaagtcctggggagcttctggcctacagacctcagagagacaatgcagtgaccagctctcctgctggcccttccacctttcttcacttgggatccaagtctgcaaggggctgagcagaaacctcctccaccacaaagtgatggagaacagcccaatggctggtgctctaatggattcagacaccgcacccccccacacacacacaccccaaatacactcccatataaacaccgctaccacacaccacttgtttctctcccagctgaacagatagcagcatcttgcctcctacagaggcacccacattctactctgaagggcccctcccttccttggactgccctaggtttgtgcttctcaagcagttctcctctttgcgggttgtcagagacccagtggacacatttcatcccaccacctgtgaggagcccaagagcagggtccttatcacagcttgactaaaaggacacataaggttaaggatttgggctaaatgagagacctccacagagtctggaaaagtaaaaggtgtctccctgatgtagccagatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaacaatcttctagaagagatcacataacactgttacaaaggatctggagaaagggaccctggcttcatcactgtggctctccagtcatgctttacatttggcagtgactatctccattcaactcaattccctaaccctaaactagctgacatttatcaaatactgccctttaccaggtctaagtaagtttaactccccccacccccaccaaaaaaaaatcaagatactaagggatatactattcacaaaagggaaacctgtctcctcttcatatacctgttcctttcaaggaagggtataaaaatggggatgagggaggataaccactaggaatttgaccctatattataaattggtcagataaatgaaaataattcctctggactcaaagtgatatggctctgaaaacgggagaaacatcggggtcctttgtctcacgccagttaaacgacatggacacacaggagtggttttaaggaacagaaagtttaataggcaagaaagaagaaaggctccctgcggtacagaaaaaggggggtctgaacagagaaaaagccccgtgtgtggcagaacagtactcggttatattgggaggctggaggaggtggtgtctgatttgcacagggcccagggcattggtttgaccaggcaggtcattcatgtagcccgagaaaaacgtggccctcccaccctagccttttaatatgcaaatgtaggtcaccatgttgtcctgcacacatggggtcatctggaggtgtcaccttgaggtggtgactagaagaagagggtgggaatctccatgttgaatggacacagtttctaagcgctggcatttgcatatcaaagcttggcagcctgtagtcccagctactcaggaggctgaggcaggagattcacttgaacctgggaggcagaggctgcagtgagctgagatcacaccactgcactccagcctgggtgacagagcgagattccgtctccaaaaaaaagataaaaagaaaagaaaaagaaatgtttctggagttgtttctattaaaagggaaagccttactgaggcctccttaccctctctatctgcctagtataatttctgaataactcctctattaaaagtaccactgaggtgcttaatatgacatttctgatatttcccaatgctcctccacaaattcaatttggaaaggtaatctgttccaggagggcaaaccaaagaaaaagtcctaggctcctgagtcaaggcttgtttctttcctttgtacaagctgactactttttaatcatagtaaaaatgagaaaaatgcaagatgaagttaacagcattgctttatttcccatgaaaagctgttataaagcattctcaaaataaactgttattcagccacaaatgacaccatcacttttttattcatagggcacagtatcgctgccaaagagctttcctctatatgctctcttgcagggcaaaaaatattatctatgttatacagaaacacagtaaaaaaagtgatttacttaaggtcctaactactaaataaaagctaaactactcacttcctcctagattcagagagagctccaacattttctaaaatttggtatcttgttgttgaggtaggcactttttggcaataatgaatagacatttaattagccaatcaaaaaaacttattaggtacagtaagttcctcttcaaaggtttaacctgttcaacttcctcgttctttgttcctaagaacaatttccctgtaccttctcacccctatttacctgcttagttatctgctcagttacctgccttgtaaacaactcttcccgtcagtcccaacctgtaactcacattccctctcccttccttattagggagaatattcgcgatagcaaatcaagtctgcttagattgtgtagtccgactccagcccatgtggaaatgacagagaggtagggactgcgttagggatataaactcctgctctatcctgctcggtgtgctcttgcattcgtgactaacgcaaacagcagtcttttgcagaagtaagttgtcttgctgagaaaactttttttcctgagtgctggttcttccttgcagcactgatcatttgtttcttttttctttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngttgtaaggactatttgagaaaaacagggcatgtaaagcccccacaggaggctgggcataaggtggtgctcactacagggactggagggagctgttaccaacacccattagggtagggcctggcacaccctggatgcttggccaaggccagccatcattatagcttgtggggaaggagccccggatgatgttcttgggactcctggaggcttcatgggctgagattgcaagcccccagccctgccgggccgatagcctcctccctgtctgtgtgaggctgtccctccctaccaggtcccgcgtaggggaggtcctggaagcaagggaggggctggatcttgagccccactggtgaagacactcccacatatcttcagtccctgtagacctgccccagaggtacctgctaggcaagctgtggcctgtgcctccccagcgctgtaaatctccccagatcccacccaaacccaacctcagccatcctggctccttgggcctgagctgctgccgcgtgactttgggggacaaaggaggctcttcctggcaaaccttctcccagactgcctgcctggggcctgcatccccagtcagctccaaacaaggctgttgctgctgctgctgccgcagccgcagctgtgacgtgtggaggcctttcctcggagggcaggcagccgcgtgggcaacagatgtctcagctccctgccgcctgcagccgtcagccgccgccactgagcctgtcagcggcctcacgcccagggtgcctggccagcccgcttagtgtccccaccagccccctcagcggacacacagcatgacacacacaagcagacacaggcttgcgtacacacacacacacacacacacacacagcaggaatcctataggaaagaggagatgaaaggctctgggatgtgttgaaggcccacctcactcggccccagggacctggcagtgagggcagatgtgggaagcctcctaggacagctgggcctgcctgtcaccctggcccccagaaacgggattccatgattccacgctccacctggtgcccaccccctcccaagaactggacagaagtctcttaaagcccagccggcttggcccagcccccatggcaagaggtggcagtagggtgggggaaggtgcttctctgtgcctctgacacaggcccccaaagacaagatcagcctgtgtgggagcaagggatggccgtcagatggtttcaggttatctcctctgctccttccagactgagagccgccaagggcagggcctgggttctctcctcttctgtcccttaggctggggacccccaagggcagggtctgagtcctctcttttggccctccagacacgaggatgtcgaggctgggccaggatcctgtctcccctagacaggcaccccctcgaacagggcctgagtcacctcctccactcctctatcctcagactagccacgctccagggctgtgccggctccttttccttctctgtgggcaaggcagggccctgggaaacttgaggaacgggcctgaggctgtcctggcccccggctttgtgtcatcttgtggggaggggtctcacaacctcacagttaagtctccctttccccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctgtctcctgttcaggagactcaacatctgattgttttccacctcagcctggagctgtcttcccacactctctagctccttccttaggtggttggtctcatcttgtagctgctctaccttagatggccctgctgggggctctggggccaggggttcagctgagaaagcaagcagagaataagggcctctggattctcaaaaaaaaaaaaaaaatcctccctttggtgcacagctcctcctctcaggcttcccaaacttggcctcactgctaatgactcctcacacccggatggtagacaatcttccaagtcactttcagatagagagcactgtgggtggctgacaatgggcactcctccctctttactgatggggacactgaggctcatggagatgacaagacttgtcctcccctggcacagacctctttccctctgcctcaaagcccttccatccacccacctccctggggcattctaagtcacccccacagccctctaatgccagtccagctgccaggtcatgccagccccatcttacccgtctggtttttgagtttgaacaagctcctcccaagcttctgtaccagatgtatctcatgcttcttctcctccttagatgtgcgaacctgcccaaagcaaagggggaaaagggccctggagggaggggctggtgaacgtccagagacagagtttgagaaaggcccaccccccttctgccagtttgtgatttagaaacgtgcattcattcaacaaacatttactgagcatgtacaggccaggtacagttcttcatagcagagatataaaacagcaaaggacagacaggagcccttggccctgaggtttccattctaggggcctttaaatctctgactttcagagctaaccaagacctttgatactctctacctcctccagaaacacgagcataaagaggagagatggcttgtccagactcaaaaagcaaattagggactgaggcagggcagaaatatggacccctgacaaccagtcaggctagtgcttcccagagaggtgacaaccccagggcatgtgtggcaaggactagagcaggggtgtctggagaagagagagtcagcaaagagggcagtgcagaagacccatgctgcatgttctgtgctctggggtccctccaggtgagacctgggtgcccagctccccatttgcccttggcatcaggggcccctagctcctttcttcagggccccaagaggaaactggagtccaggattgaccagctgtaatcaggggaccccactggactcttaccagtgaattgatgttttcagtgagttgactgattattgcggagcttgaatccagggccactgctagttcttggtactggctctgaggtgcatgcagagagaaggagttggaggaagattgtggcgaggggtagagagaataatcattagggctggtgggggtgtgtgggctgcctcagctggcagaggggcaacaagcccctgctgtgggaggaggttggagggctggcctgcagggtcactgcacctcggcccagggcctcttacctccagatcctgcagggtagtagaggatgcacggccctccccgtagatacctgttgctgactgcaagagatgagagtgcacatggagatgttctgtcccccctcactgtctaagccctctgacttcctttcttcccccatcaactggcaaaagcttcttttctgcctatcttggacccttttccccataactcctttgtgccaacttctctcgtggttcttatctccccaccatcccaccctggggccctttcagtgactcctaaagggacagcctgatggcaagtggctcttctcattggcctggcttccccttgagactggggatgaggaaaatcaaacagcaacgaccatttcctcagtgtcctgggtgtttgcagcaggccatgtactaaggattcacataaaagcaacaataacgaatctcatttaaacttcacaaatggaagtcaaaaaataccacctctattatacagatgtgaaaagagaggcccaaagacctcaagcaacttgccctaaatcatatgctaatcaatccctaatcaattcttagcagacggagaggcaggattcaaatccagaattcttaaccagtacccaacagtccatctacaatcttaacaattaccctctactgccccttgggccccctgtccccaggagcctggcccgccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggggttttcacaatacatcgcatgacacaccatcttccaaatctctaaacatttctctccacagcccagtcctctccatagttgtccaaatccctccctcttttctcttgttgtctccaaaactcaaaaccatgctctgactttctatatcccgccctccccttcttggaccatctgggaagccccctgcttccccagggtgtcccctcctccccttctgggatcagtcatctttcctcaaatggaccagttcggcctctcttagtttctccaactctgcatctcaacctttctcccttcactacacaataatgtccaggaggcaaagagcccacaaacctgggaacctccctttccagaagggaggttctggaatgactacaaatatttggttatgattttcttccctgccacgcctgttttcatgggcagtgctgagccccggtcctggcagagctcagaaccaggctctcatgagctggggcaagtggggcctagggaacctctgggttgaggaccttgcaccccactctgcagctgccctgctgatttggctcatgcaacctctcctcctgggctcaagcgatccttctacatcggtctcccaagtagctgggatttgggctaccacgtttggctaatttttgtatcttttagtacagatggggtttcacctgtagcccaggctggtctcgaatcctgggctctagtgatctaccctcctcagcctcccaaagtgctgggattacaggtgtgagccactgcgcccggccttgtgccagcttttaaatatcaacaaggacaaattagagaacagtggaagagggtgagcagcatgatgaggtgatacagaaataatttcacatgaagaactgggcatgcctggcttttttttttttttaagctattctgggttggatgctgaggctcacacctgtaagcctgtaatcccagcactttgggaggccgaggtgggtggatcacctgaagtcaggagtttgagaccagcctggccaacatggtgaaaccctgtctctactaaaaatacaaaaaattagctggaattggtggcatgtgcctgtaattccagctactcgggcagctgaggcaggagaatcgcttgaacctgggaggcggaggttgcagtgagctgatatcgtgccattgcactccagcctgggcaacaagagtgaaactctgcctcaaaaaaaaaaaaaaaaaagaaagaaagaaaagaaaatatatctatgcaccagagctcaacactaggttaggagcatttctgagatttggagctattcaaccatggaagttcctggcacatacatcaggtattcacaataccctttctcaggtgtttggtcactgctagtgagcctgcctggatcagtgtttcccaaatggcagtcatttgcatctttgcattttttttggggggggggttgtgggggtatataccataccagattttttaaaaattgacattaaaaatacatgtataaaatgtgtaaagtgcactaatctaaagtgcactggatgtattttttattgatgtacatacttttgttatccatcacccaggtcaaaatacagaatcagcaccacagagggttccctcctcctccttcccagccaataatcttctcctcctacctaaccaactgttcttacttcaagcactgtcaactagtattttacattcttgaactgcatataaagtgtctcaagtttcacttaacacttttcttgaaatacacttgttttttgccactttttatttgacctaagaagtaacattaatgaaacaatgatttgacgtgataggcatttccctcctaatgagcactaaaacacttaactatttgaaaaaagaagtttctccgtgtaccagctaatatattctcctcggccgccgttggtacacggaccacattttgtttctcaaagcaatccgatgatttctgaggtcctttgcagcttgaagacggaacgactgtggtgatcgagtagccaaaagttcacggaatgcactgtcacaattgtgattccgccatagcgccgtgcatccatccaacacttgtttaatacctatatttaatacctaataccttagagtgtcctaggctgtggacacacaagactaaaccccacttcctgagttgaagtgggggaaatagaggagtaaatcatttcacgatgtgtggttaaatgctacagctcaggtaaccacgagcacacagagaaagggcagtttctagaaacagggcggagaggagaccgtgagtgggcatttcccagagcagtctctgccagccaccctgctgtgatcactttgccacagagcagccccggcggtcaacctcagcctcccttagcaacctgagcgccccgcccaggtgccttactattggtctcgtggagcgggatgggcagctctgccgtgcaatcccagctcgcagcccttgctccgcgtgtactcacgggaggactcgcagacgttactgccttcttgcgtgccccggccacccccgggcggcttgtagccggtgcgcggggtggctggggctacgtgcagagctgtcgcggagccggaacagcagcggtgaagcccctcggctcggccgagaccgccgtgcccattgctcgcctcggttgccgccgctttagccgcagccgctgctgccgccgccgggggagaggcagcctattgtctttctccgcggcgaaggtgaggagctgtctcggctcggcccgcgggggagccccgggagccgcacggtgagagcgcaacttagttggcggagttgggggaagttttgtgatttgaggaggggtcgggatgcggagcgcggcccgtcccctgcggccgctcggtggggcgggccccagaggagggtcgggggctgcgcggggcttcaggggcgggcggcacggatgggtagccgggcggcgcggggacctcagctttgcggacccctcctccctgcgcatcacccttctcccgcattgtctgcttggggctcggcgcgcctcccactccgcagcccaacttgggggccgtcgccgctttccggatggggggcgcgcccggcggcggatggccccgaacccttgccccgggtccccgggttggcgccgctggggcggactcactcctcccctggggcgggcggccgcggtgtggagtccgcgccgcgaacaagtgctgcgggcgcgagggagcggttccccggggccgacgcggacggtaaacctgtccggcggcgcccgcctgctggggcctctccgctgtttctcgcgggcgcggcccggctgaaactgcgaccgtcggaggcgagcggccctctgggacccgtgcagccggtccaccttgcagctatactttgagactaaacattttttttttttttttttgcaaaggcaaaccggtatgtgaagttgaaaaaagcaaaaaccctcaaattttccttctttcttcttttttttttttttaaatcaagaaagggggtagataggtttgttttgttttggaaatagtttttatagcagagtgataccgtcacatttaatgatcctactgtgaattcaagaattcacgatgaaagttggattgagcggtattttggtgttcattctttgctgatactcattaatgaagttagttggagaatttattgcttcagtacagtaaaaaccagtgtgcctttttttttgttactactcccccctccccgcattgttttatttttcgaagaagcactttattcagtttttctaagccacgggattgcccagatgaggaccaacggtgcagttcttgaaaggtcattattggcaagtttgtgagggagctaagatgagttgagataaaccagtgttactgttcttgtattctgtcgtggactcttggggatttgcaggctgcattaagtacaagtctggtccagttttgggtgcacgtattccactgaatttggttcgtctggcttattatatgaacatgattctgtttcacttccccagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatacttcaaaaggactcaaagccatatactagttcccaataggcctgcacaagttattagaacaagctgctttgcattcttgtgtgatcagaaccagtaactagatggcaatcaggtctgttactgaagatggaaaaactatacttaagtttgtataacaatctttcataacatggcttcacagaaaagaagtataaaaaggattccttggttgaaaaagagtgctcttttcccttcattatttaagattagggcaaatttataaaacaggaaaaaaatagcacaaatcccttggcaaacagagtaaaacatctactctgttttgctttttttcacttcttacactctctttcataggaagtcaatttacagacttccatcaagcccttagagacctttttgtactatccatgacaagctcttgatgttatctctgcacttttgacaaattcttagcagttaacttacaaggcagttaagatttttgttcaagcacaatatagctagaataggctcatacattcaataaaacaaatatttaccaagcatttattgagtggaagataaaaagcacaaagcataattatgaaatattttcccctgccaccataaaaaaattaaacaggcttacagaatacagtgtaagaaaacatgaccaaagcaaaaatagtaaggactaaagaagggaggaaggggaaatatcaacatggactgaatatgacccaaaagagccttgatggatggtcagacatgtaaaggcaaattggttagggttaaggggtggaggtcagggcacgttctatagggaaacggcagctgatacagaagcctgaaaggaaaagcgggcagggcacctggacaggactcttcaggaacgagcacgcacgtgcgtgaaaaacaacttagtgaggtaccgtccacccaaacattagagaaaccgcgtaaaaatgcttcttggtaagcatgaagaaggcagggctcggcctgtagaagaactcaataaacatttgaactgtctaaagagtaaaagttaatgaataggccaaactcactcctttctttgttttaagagctacaactttagagaataacaaatcacaaacccagtagacaggtcctggcatttgaaatccaaccccatttttcccttaatctttcccctctgagcaaatggtatcgacatgaacaagccatgttgatttgatcaagacactcatccatggttaaaagagtctttactttcaagagatacaaacagaaatatttacatgggctaatttactgggcaacaagagagaaactccgtctcaaaaaaaaaaaaggaaataaaagcatacaaagtgaaaacaaagaaattaaactgcccttatttgccagtgacattactgtctatgcacaaaattccaaaaatctacaaaaaagcttctagtactaaaaatgagtttagcaaggttgtagaatccaaggtcagcatataacataaaatcaccttcctatatactagcaatcaccaactggaaattgagaagtatcattcacaacagtaccacaaacatgaaataaatgtgtaagattacaaaatacaagcaagatccaactgctaaaaactacaaaacactgacgaaaaatctaagaaggtctaaataaatagatataccatgttcatggctcattattaaaatgtcagttgcctcctaactgatttccagtttcaatgcaatgtcaatcaaaaaccccagcaggctctcacgcctgtaagccctacactttgggagaccatggtgggaggattgcttcatcccgggagtttgagaccaggctgggcaacatagagagaccctgtctctacaaaaataaaaaaattagccaggcatggcggtgcatgcatgtgatcccagctacttgggaggctgaggtgggataatcgcttggttcaaggctgcagtgagcagtgatcctgccactgcgtttcagcctgggcaactgagtgggacactttttttttttttttttttttttgagacaaggtctcgctctgtcgaccaggctggagtgaagtggtgcaatctcggctcactgcaacctccatctcctgggttcaagtgattctcctgcctcagcctcccaagtagctgggattacaggtgcccgccaccatgcccagctaatttttctgtttttagtagaaacggggtttcaccatgttggccaggctggtcttgaactcctgaactcaagtgatccacccgcctcggcctcccaaagtgctgggattacaggcatgagccaccgcaccaggccatgaaacactttcttccacccacggctttctcttctctccccatttacagcaataagacagcctaacctgggaaagagagagagagggaagctacttccaaatggatgcctgtccccatcagtaataaccaagtctattcaagtgctagatgttaactttaaaagaaggaaacatcaaaagtccaagtttcagccgggtgcagtggctcatgcctgtaatcccagcactttaggaggctgaggtgggtggatcacgaggtcaggagttcaagaccagcctggtcaatatggtgaaaccccgtctctactaaaaataaaaaattagtcaggcatggtggcgtgtgcctgtagtcccagctactcgggagaggcagaagattcgcttcaaccggggaagcagaggttgcagtgagccaagatcgtgctactgcactccagcctgggtgacagagcgagactccgtctcaaaaaaaaaaaaaagtccaagtgtcttcgcctagctttgtcaggaatgtttttaccctcagtctgtaagtgtgaccaaatatattttttaaaggtttaccctcaatctgttaagttcaaaggtttactataatctcttcataagaaaactattggaaagatggaataaaatacacagaaatgtccttaacaggtaaatatttatttttctttcttattattatactttaagttctggggtatatgtgcagaacgtgcaggtttgttgcataggtacacacgtgccatggtggtttgctgcacccatcaactcgtcatctacactaggtatttctcctaatgctatccctcccctagccccccaacccccaacaggccccagtgtgtgatgttcccccctccctgtgtccgtgtgttctcactgttcaactcccactacaggtaaatatttctagaatgtatctactccatcagctagtgtaagtattctaaactgtgctagtatagctgctttaaatcactgctttcttctgcaaatggtggcacctttaaagtgttatcttgaaggggaagtgagtgatttgctcatgtctctactgaactaacactgttaacacccagtccagttctaccttaaacaagtcggagaaatacagacataatccatacttgttatttgtcaagactaaggtaaaataaggaaagttggaactcactcatatcctcttatgactgatgtactgaaaacaatccatctctcaccatttcctaaatagcatagtcacaaagagctctaccctaccaagtactctgcaagtcccactctcaaaggaagactcacaggtgactgagaagataaatttgctattgtttccattatccttcagttcatctgacacctttgaagaaatgcatttggataagactcacaagtctcagggccccttctttatgaaagaaatagctaagcctccatactcagaagcatcagacttttcagaatgcttaagtcatgtaaaaacgtatcaaaattattatcattacagctaccaggaaatagctacctactccatgttagatactgcagttaagtatctcacacagtttcactgattcctaacaacactgcaaagcatgttactaacccttaaggagtaggaagctgaagctctgagaggctatgcaactactcaatggaaatgtggggatctgaactctacctagctccaaagggcgtacttttttctaaaatttctaatttttttccaatttcacaatggaggcagagttttcactacaattttaataatttcaccagctgggtggggtggctcacgcctgtaattccagtactgtgggaggctgaggtgggaagacggcttgggtcccggggagacaactgggcaacagtgaagattctgactctaaaaaaaataagaatttcaccaaaaggggggacagatttctaaatcggaatctcttgttaaaatccttagagcactagttaagccccacttcttttcaaaaaataaccgacagattaaaaaaaaggttagaaatccttttaaagtaaatttcatcagagatctgcaagtgaattgtcattttggacaagtccccagagttggtggccctctcctgtgtacaccagctaccactaggcagtaaaagtaatttacccaattcaaacacataccgggcctgcactatgttaaaaccactggcaaagagggtacaaagttaaataaggtctatcacagccctcaaggagttaaaggactagaggaggagtccatttatagtatagtatgtgtgcagttaccatttagtcaaggcaaacgaactgtgagaaatcctacaacaatagtacctacagtataacatgccatcaccgcccacagaaggaaagcaactggtgccctcgtcacgttatgttgttagtacttgcttacatgatgtccctccctgacaatcccttccaacctctgtcagcctccttccccacaatcacacacacacacaaaaccacactgccaggaagggaagccattgagtgagtattgtgaatcctacaagtggctctgtagtttaaaagggcaatgcctgtgcctgaagaaaatttgtctttagcttcatcaggtgaagaaaattggttttataacacaaggcccaccaaaccagaaaagcccaggaacgcttctccacaggactcacttagcacgagaaatcactcagagcaaactgacgcacacagtatttgtcaaatttttctttttcatttagcagaaggtaaggtaaaggactacaactgaagttaataaatgacactctagccattttgatcatttgtcactataaatgatagacatttaagctagttccatctggggaagtgaaacagaatcatgttcatataataagccagacgaaccaaattcagtggaatacgtgcacccaaaactggaccagacttgtacttaatgcagcctgcaaatccccaagagtccacgacagaatacaagaacagtaacactggtttatctcaactcatcttagctccctcacaaacttgccaataatgacctttcaagaactgcaccgttggtcctcatctgggcaatcccgtggcttagaaaaactgaataaagtgcttcttcgaaaaataaaacaatgcggggaggggggagtagtaacaaaaaaaaaggcacactggtttttactgtactgaagcaataaattctccaacgaacttcattaatgagtatcagcaaagaatgaacaccaaaataccgctcaatccaactttcatcgtgaattcttgaattcacagtaggatcattaaatgtgacggtatcactctgctataaaaactatttctaaaacaaaacaaacctatctaccccctttcttgatttaaaaaaaaaaaaaaaaaaagaaggaaaatttgagggtttttgattttttcaacttcacataccggtttgcctttgcaaaaaaaaaaaaaaaaaatgtttagtctcaaagtatagctgcaaggtggaccggctgcacgggtcccagagggccgctcgcctccgacggtcgcagtttcagccgggccgcgcccgcgagaaacagcggagaggccccagcaggcgggcgccgccggacaggtttaccgtccgcgtcggccccggggaaccgctccctcgcgcccgcagcacttgttcgcggcgcggactccacaccgcggccgcccgccccaggggaggagtgagtccgccccagcggcgccaacccggggacccggggcaagggttcggggccatccgccgccgggcgcgccccccatccggaaagcggcgacggcccccaagttgggctgcggagtgggaggcgcgccgagccccaagcagacaatgcgggagaagggtgatgcgcagggaggaggggtccgcaaagctgaggtccccgcgccgcccggctacccatccgtgccgcccgcccctgaagccccgcgcagcccccgaccctcctctggggcccgccccaccgagcggccgcaggggacgggccgcgctccgcatcccgacccctcctcaaatcacaaaacttcccccaactccgccaactaagttgcgctctcaccgtgcggctcccggggctcccccgcgggccgagccgagacagctcctcaccttcgccgcggagaaagacaataggctgcctctcccccggcggcggcagcagcggctgcggctaaagcggcggcaaccgaggcgagcaatgggcacggcggtctcggccgagccgaggggcttcaccgctgctgttccggctccgcgacagctctgcacgtagccccagccaccccgcgcaccggctacaagccgcccgggggtggccggggcacgcaagaaggcagtaacgtctgcgagtcctcccgtgagtacacgcggagcaagggctgcgagctgggattgcacggcagagctgcccatcccgctccacgagaccaatagtaaggcacctgggcggggcgctcaggttgctaagggaggctgaggttgaccgccggggctgctctgtggcaaaggatcacagaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaatatgttcataaagttaaatgaaataggatataaaattgggcctagtgtttaaaaggtaaatatatttacatgaaggagaaaacaactcacctcccactcttagagcctctgccagtttatcatagcctagtttcttgagagaataagctacatgtcttcaccttttttcactgagctcattatactctggattctgccttcatcgttgcactaaaatttatctcctagttgtcaaatccagtggctcccctcttagtccccaaattgtcccctctgcagtattttgatactgttgattgttcctttgttgaaacattcctccattcttaatgtccaccaataaagagttggttaaataaaaattatagtgtaccgttttataatattctgttgttctgttgtggaccaaaaaatgcagccagtctttccataagagcacgtgcaaacttctaagatatattaagtaaaaaagtaaggcataaaatattgtgtataatctgacccctttagtacacagtgtaaaaacatctgtgtctgtgcttctttatacttacttttttctcccctggtgaatacaggaaactgtgagtagtacaacacaattaaaaaaaaaaaaactgtgtgtctgctgcaccaggacctgtgataattgggtataaaagacaaaaaagacatgtccctgtcctctgggaagggacatgataatcaaatgagacttctgtcggattcttttctcctgttttgatcttatcaccctttcttggtctcctccgatctcttcttccttgtcctacttcttctcttctcattctgtgctttctctgagtaatctttgactcccattacttaagtcatgacctgtgttccagggactcctaaatttgtattcatctccagagtttcaaacccatatatctgtctgtatatcatatatttagggaatctcacttggagtgacatgggtgttcaaaatgatgatatttaaattttcacgtatccatctcctagcactctatctagtcacatatgcctaaacctgggaactgtcttaatattcttttatatacacctgttctgacctcccccccaaactagtaaatttctaagacctgtccttctgaatgtctcttacaattttccctgtgatctcagtttcttcctcccatccctcaaatgctttgtgtgtgtgtgtgtgtgtggtgggggaagagagtaaaattgaaatttgtggaaaacgtactagcctgtctgtctgtctttcgaggtgaagtctccctcttgtccccctggctggagtgcaatggcacaatcttggcttactgcaacttccatctcctgggttcaagcaattctcctgcctcagcctcctgagtagctgggattacaggcacctgccaccatgcccagctaatttttgtgtttttagtagagatggggtttcatcatgttggccaggctggtctcgaactcctgacctcaggtgatccacccgccttggcctcccaaattgctgggattacaggtgtgagccaccatgcctggccactaccctgtcttgttgcttggtatgactccactaccctgctgcctctctccccgtacagcagcataatttaggaatcagagagactgaggaggatatatattatttaggtgcaccggcccagtcagattaacatctaaaggactgagccctgaacaaagagtcaggttaccttttaagcattttgtgtcggtcattatgccgacaaggtgtccgcactaagttcagtatcagtatggtgacctcctgggaacaggtcatcggcttgcctaaggatgggagaactggcccaggtcagaaagggagcaggtcagaattcctgcaccaatcggtagtgggactgtgcctgggcaatatagcaagatcttggttcttaaaattcaaaataaagaacagctcattcccctctggggaggggctggctcaaggttacacagtgagtgtgggggcagaggcgggcccactgtacctcccttgttgggttgtctgaggacccctctggccaccccccacaggagatggaggaggacatctggacagtgagcaggaggcgcttcggcccatgccgaacatcccaggggacctggagagccgggaggccatggtgagcctgactttccctgcccctactttgccaccttcctctgtggtccctccgaaacccccttatgttcttggtttccccgccttctgacttctgtggactttctctgcttctgggagccagtggtcagacaccatttcacctgtgaccaacaggtgcactctgtgaggcccgaaatgaaggggctatgctccatctgcctgccccagttgttatgtgtatacccctacaagaatactcacctcttgtcttcaggtggcatttttcaactccgctggagccaatgcccaggaggaacaaagggtgtgctgccagcccctggctcacccagtggcctcgtcccagaaaaagccagaggtagcggccccagccccagagagtgggggtgagtctgtgtttggggagacccaccgggccctgcagggggccatggagaagctgcaggtgagtaggtcctggcatcggccaacaaggggggcgggggggcaggacaaggcaggtgactcctgacatgtgaccccattattttggctccacagcgactttatggaaggagaaggtggacctgaaggagcgggtagagaaactagagcttcaattcatccacctctcaggacagacagacaccatagggagtgagaggctagggcaccgctggggggagctgccaggccgtctgaggggccccagcatctgagccatgtcctcctgcaggaaagtacatcagccagggggcagtgtcagagacgcagcactgggagaggaggacatcgtcaggctggcccaggaccaggaggagatgaaggtagggtgtgcaacatctcggtgggggagggtgggggtgggtgtgaacgtgcgtgctggcaccggcatggcagctaacaccccttcctccaggtgaacctgcaggagctgcggggcaggtgttgcagcttgtgggagaccacaaggaggggcatggcaaattctgaccattgcccagaaccctgctgatgagcccactctaggagccccaatagcccaggagcttgggtgtgctgacgagcagggtggtgagtagagccctcaggcggggtgggcaggcaggagcaggggaggctcacactgtgctcagattcccaccccccctccctctctctgaagatctttgtgaggtgagcctcactgatagcgtggaggctgcaccaggagaggacagggagggttctccccacgacaaccccactgcacagcagatccagcagctgcttcctgtaatgcaggactccccaggagcacccaggcatgggcagcaacccctgcatgccattctttttgggctcccaagaacagggagataaacaccaccatcatctgagagccgggaaggggaaggcgtaggtgtgggcgtggcaaggttcctggaaaagaggggctggaagggaaaggggaggaagatggagggagaagctagagcttcataggtagtgcctgggggctgtggcggtcctccccaccccacacacactggcctctctcatggcacccaggcagtccacccacagttcagaccaatgctcaactcccccggcttccctcttctgtggtcaccccatcttccaacccactggcccagggccacctcttgcttggggagccccacccaacagccaccaagcctgacagaaggaacactgcttgaaccaaaatggtgaagctgtaagggatggctggctggagtgagcgccagaggcccctctctgggcagtcagaaagcccagggtccactgaagggaccctggggaaggcagggagggcaggtagctagatgccactgcccatagacttataagtctaagaggggaacctcaactggttggcggggggctgcaggttgcataggtgaggctgggcccttcctgctgggaaaagcagaagagggagactccgcggcaggaaaggcaggtgggctcgctaggcggagctcagctgggccagcaagcactgtggtctccttggctgaatagcacaggtgacccctaggagcaacaggccaaggtccgtgagcctgctggctggcagtagtgcttcagtagtgctggccagggacccagccttcagtcacatgctagcagctgtgatggtacctgggagggagggaagggggctgtgtgtccttgcatggcctatgaagtgtgttgtgggatgaccgcgtgtataggactctcaggcttttatcctagatcaccactggattgctgacagatagaggacgtgggaccgtgactatcacccctaatctgcagtggatttggctctcggcactcccaggctgggagctggatacctgccctggcagcatgactcagactgcatgacaggtacggcgtgcccaggatgatgtgcccaggcctctggccgcctgagtccagccccccacacaaccccctccaagctcccagcccctacaccataaaccatgagctctgtgccctctctgatggttccacatctgccaccttcggcatggagcctgttgtaagagcccccaggctcagccatggagaccttgagcagtggcactgagtcctgtggctggcagggagggaagtgagacagccagcagcacaaggacagaaagaggaaagagcaaggctgcagctctagaagggaggggcaggcagcctggctctgaggctccaggtatgccccctgtgtggagctggggcagcggggcgggcagaccattcatgcagcaggcagtgaggcatgtacctaccatggctgatgctcctcaggggccactgatagtgattctgaaagacagcatcaaatcacatggcaggtcccatgcatgggtggggcaggcctgggggtggcggacacacgcacacgccagattgtgcacacacatgctgtgaggccccacggcccgcatgcacactctaacacatgcccacaaacaacacgcatacgtcgccctctccgccacctcccggtgcccaacaccctcaccagccggcacgtgccacatggatctggggcgtgcagccactcggcacactgaagcacatgcgtgggcagagtcacaacacagatgctcacccgcacacagaggcatttgcaccagctccctgcacactcgtgcctggcgtgctcagaggaccacccatcctgctcagggagacagggcttgctcactaatgtccggctgtcatttctccacctaagagccttccatggctccctactgcctacagcgttgaatcccaacaagtcatactctttggactttgaaggttctccaccctgtgccccaccctccccacagagctcttcctcattctgtctctgttccctgctttggccagtggctatcctcaatgtgacccacactacacctctgcccacactgcagctctttacccagttaccctccagttcctcacaacgtatgcctatctcagtcatgccccggactgcattgaagccaggctgccttgaagaagctctcccagactgcccttttccccaaggcagggtcatgatttgccaaaggtttcgtgtgtgtgttagcaagactggagtcagagcaggcatcaaactttacatcccatatgtcacacctcaccatagacctgggtgccaaatagcctgaagagtctgaactcacgttggcagttagcaaagtgctcctacagccgcatctgcggttaacatagcatccctatggccactgtctcccttgatccccacagccatcctaggagaaaggcagaatgtcataatttgctaaaagggatgctgaggctctgggagggaaagggacttgcctaaagccccagggtgaagcagcatctctggactcccagtccagtgatcttgcccaatactttgctgcttgcctatacccctctaacttggtcaacagcacatcacagggcaagccccaatccctgcttcatttttatatatgggcgctggtcccacagccccactctccagccatttggaaacaaaaacagatgctattgttcttccttagagaacgtggccagtggagacggcacactggaaatcagagtgaatgttcttgaaagagggtcacgggtcaacaaggcccagccaaaggatgcagtagaaccattttccttagaaatctttgggagtgaagtaggcttcagccactcccatccctgccctcgcggctaccactaccccattagtttagacagggtcgggcggggaggggtgtggagaagaaatgagcttgcctgtggcccccaggctccctctgtcctagctcaggtctgggtgccattctttacactcgtgtgctcgctcacgcacacatcacacaccttgctggtcacacagtcacagactcgcctctgctcctgtggtccagtggccggacaccccctgggatggctcaaaggagtcaggacttggaagtggggacatcagggtagctgaaggaaatccacacacccagagcatctcggagttcagactctcagacctgaagtaggcgcccccgggactgggctaggagttggacggaatggaggatggaggacagcgagaagaaaggaagagaaatgcaacgtgtgggcagccgccaagagtgaaaatagagggaagtgtcatgcaagtgctggacagaaggcggcaggtgggacgagccccacagccccctcctcaaaaacgaccacctccaggactcagtgatccctggggggcaggctctgccagccctcggccacacgtggctccggcacccatggtcccagtgccttggatggagacggccagttctggcggccagatgtggtgctctggaatccagtcccatttccttcctggccacgcctgtccagcggcctcttcagccgcattcagcccctacttacctggggaccccggctggggcacgagagcaccaggggggtagggcccaaagggatcaggggaagcctctggcctggagggtatggggcacgcttccccaagggcggacccggcaggaggaagcccaggagctgggtcctgccgcccaggagctgggccctgccacccaggccgggctagggacatggcagggcctgggcatcctgacgctggacttgggcgacctgggaggcacagggaggggagagatgggcgaccccgccccagcgcagtgccggccacaccccaaggcggttgccagagcttaagccccgcccccagcagcgagaacatcccagctccacacaccccccccccccccggcagccagtgctccttgtcaagctccccccgtcactccaggtgggagccaccccggtgagggggtgtgccacttgcccccagggcactcctctgggcatcccgggtgggggattttggggccgtggggggcagtctttggtacctgtgttcgtcagggatgctctgacaaccaggtgtcgtccacgggcgggggcatgggcatggtgacagtggtcctgttgatgtcaccgatgatgctgagcgcctccttcagcgcgtggtgcatgtgcagcatctcgtcatgctgctgtgcctgctctgccaactcctccatcagtgtgttctggttcccacatgagtacatattggccagcggctccgagatgatgaactccggggtctgagagtgggcaaacagggaagaaggtgggacctggtgcctgtgccgccctgggtgccttggtggggccttctgggactgtgcgctggacttggagccccttggagtatgggttttcacatgggcttctataccgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaccacaagctttattatcaaggagtcttgtggctcctacttgagtcttaccccataccaggaagagtttaagaacccagggtcttagtccaaatttggggcaggctgggtgcagtggcttatgcctataatcccaccactttgggagaccaaggtggaaagatcacttgagcctaggagttcaagactggcctgagccacacaatgagaccccatctctattttagaaggaaaaaaaaaacaaattaacaaatttggggcagccatctctttccacaccccagtgggaagaggactagggcttggtcagtctgctgctgtcattgctgctcattgccacaaggtgtcactgttgaacacctatgtggtgcagtctggtgctgatggctgttgagctctgcaggtagtgatgccacatccctacagagatgcaccataccaggactccaagatcatggttcttagtgttctgcctctgcagttcccatactctgccatcacctattctagcatctgggagcaccataccagagccatttcttgtgtcaatgtcatggtgacagaactatgtccttcatctctccttgagatattcctccaccacaggtcaggcagcttttttttttttttttttttcccagaacacagagcatctgcctgggctccctgtccctgaacagttagcctggcttccttcagtgacctcgagaaactttgccaaacttagggggactgatcaacggattctcagttacccattattccaggggtgaaatctagattccaagacaatatttctggtgcttctcactcaaggaaagaggaggagaatttaaaaatacaggttgggtttctagaagagcatcttgctatatgtcagttccttgtgggcaaggaccacatctgattcacaccagggtccccagagcccatccaggcctggcccagagtttcctttggtgagtgtttggaggatgaataaagagatggcaggaaggcaagaggagtggcaccagaggcccttgtcctaggttttctgctctggggccccctgtggggaacccactgtgcttttataagggaaatgatggattcaaagtgctgccccccatctcccattccccgtctctcctcaggtcaggcttgtcctgggccaggaggagctgaggctgcagaccccagcagaaattctactgagtggctccgtcccccacaccacagttctgactgtctcagaggactggcccacattgtcagtcaatgggtttctgaatgcctcctctgtagtcctgggagcccccctagaagtcccctatgggctctttgttgggagcactgggagacttggcctgccctacctgaggggaaccagccatcccctgaggggttgcctccatgcagccgctctcaatggccgcagactcctccagcctctgacccccaataagcatgagggctgtgctgaagagttttctgccaatgatgatgtggccctgggcttctctgggtcccactctctggctgccttgcctgcctggggcactcaggatgaaggaaccctggagtttacactcaccacacagagctggcaggcacccttggccttccaggcagcaggctggcatggggacttcatccatgtggacatatttgagggccacctgtggtccatggttgagaagggccagggtactgtattgctcctcaacagtgtgcctgtgactgacgcacagccccacaaggtcagcatccacatcaacattcaccagctagaaatctccatggaccagtaccccacacgaactgaggagtcctcagctacctggagccacgtgacagtctccttcttggggagctggttgcagaggcctctcatcacctccaggaacaccgctcaggcctgacaccaggggctgccaatgcctccctgctgggctggctgcatggaagacctcagtgtcaatggctagaggcaggggctgtgggaagccttgctgacgcacaacatggtggctggctgcagactggaggaggtagacaatgcctatggccattatgaagctttctccaccctggctcccaaggcttggctgtccgtggagctagctgagccatgcgtgcctgagccagggctacctcctgtctttgccaatttcatccagctgctatcagcgcagtggtggtgaccgagggtggcacagcctggcttgagtggtggcatgtgcagcccatgctggcactgatggaggctgaactgcgtaaatcccaggtgctgttcagcgtgacctgaggggcacactacagcgagctcgagctggatgtcctgggtgcccaggcatgaaaaatgttcaccctcctggacgtggtgaactgcaaggcccgcttcatccacgatggccctgaggacacctctgaccagctggtgctggaggtgtcagtgatggcttggttgcccatgccctcatgcctgcggaggggccaaacagacctcctgcccatccaggtcaaccctgtcaatgacccaccccacatcatcttcccacatggcagccttatggtgatcctggaacacacacagaagcctctggggcctgaggttctccaggcctatgacctggactctgcctgtgagggcctcaccttccagctccttggcaccccctctggcctccccgtggagcaccgagaccagcctggggagccggtgactgagttctcctgctgggagttggaggccggcagcctagtctatgtccactgtggtggccctacacaggacttgacattccgggtcagcaatggactgcaggccagccccccggccatgctgaaggtggtggctgtccagctggccatacaaatccaccgcagcacagggctgcatctggcccagggctctgccatgcccatcttgcctaccaacctgttggtggagaccagcgccgtggggcaggatgtgaccgtgctgttccgtgtcaccggaggcctgccgttcagggagctgcagaagcagggggctggtggggtggaggatgctgagtggtgggtcacacaggcgttccaccagcaggatgtggagcagggccacgtgaggtacctgagcactgacccacagcactacaccgaggacaccgtggagaacctggatctgcaggtgcaggtgagctgggaaatcctgagcaatctgtccttcctagtgaccatccagagagccactgtgtggatgctgcagctggagccactgcacactcagaacacccagcaggaggccctcaccacagcccacctggaggccaccctggaggaggcaggcccaagccccccaaccttccactgtgaggtggttcaggctcccaggaaaggcaactttcaactacagggcacgatgctgtcagacggtcagggcttcacccaggatgacgtacaggctgcagaggtgacctatggggccatggcacatgcctcagtggcagtggaggacaccttctgtttccatgtcacagctccaccatatttctccccactctgtaccttctccatccatattggcggtgacccagacatgcctgtcctcgtggtgcccgagggtggtgggtgtgtcctctctgctgaccagctcttcatcaagagtctcaacagtgccaggtacctctatgaggtcatggagcagccccgccatgggaggttgacttggcgtgggacacaggacaagatcactatggtgacatccttcaccaatggagacctgatgcatggccagctggtctagcagcatgatgactccgagatcacagaagatgatatcccatttcctgctgccatcaggaccagagcagtggtgacgtggcctgggaggaggtatggggtgtcttctgagtggccatccagcctgtgaatgaccacgcccctatgcagaccatcagctgcgtcttccacgtggcctggggtaggtggcggctgctgactacagacaacatggccttcagcaatgctgattcgggctttgctgaggcccagctggtgctgacccaccaggacctcctctctggcagtatcatggccacggatgagcccatgcagcccatctgccgcttcatccaggaggggcctcaggaagaggcgagtcctgttcacacactcaggctgaccacggctggatcccgctgcaggtgtccgatgggcagcaccaggccatcacggtgctggaggtgcaggccttggagccttacctctgtgtggccaatggctccggcctcatggttcctcaaggaggccagggtaccatcaacatggccgagctccacctgggcaccaacctcaacatctgcagtagggatgaggcccactaccacgtcacagacagccctcactggggacagttgctccaagccactcagccagccacagccttctctcagcaggacctgctggttggggctgttttctatggccacaatggcagcctcagctcccgcaacaccctggccttctcaatggatgtgggaccagtgcacacagatgccaccctacaagtgaccattgccctagagggcccagtagccccactgaagctggcccagcacaaggagatctacatcttccagggagaggcagctgagatcagaagggaccagctggaggtgaggagctggaggtggtgagcggggtgtggaccaggtagagggccttcctcccagcctccatgccgggaacacatgtgacttgggctgtacctgtggtggtcccagcttgtgtgtgtgcacgtgcctcagatgtgctcccatatatgttgtgttcccaagagtttctggggagcttgctgtacacccatcctcctgggagtggtgtgtgcctctagagctggtgtccactcatgtccatggcatggctgagcatgcagattcctggacgccacccagccctacagaatctctgaagtggagcccgagaatctgcattgcagtcagttccctgggagggcatcacgggtcctgaacttttgggattgctggccgtggagacaggccgctgcctctcagacccctgtgtaccccgctctcttctcagagcccagaccaggaccaggagggtctgtcaagggcttctgctcacccaggaaccccacagagcagccacgggccttccagagatctgacatgccctgtgacctcaggccagtccttgcccgctctcagccttactcttccacactgcttatttcggagacccttctggtctgcatctggagcttggggcccatggtgagccagcagatctggcatcaggaaggcctcatgggaggaggcagtgtttgggccgggctctgaagagtacaggccattaggagcagagaatggggagtggtattccacgcaaaaggaacattccggccgaaggcacaaaacaggaatgtgagtttggaggcagtttagcctcttgtggatggcccatcaggtgagggagcccatgtggcctttggggtgtgagctctgtagggcctgtgctgggggtgcctgtgcctctaggaggggtggggtggggtggggcagggcaccctctgatggtcctgggtggtaatagcaggggttggggaggatgctgccagcaaaccagccacaggcctgaacagatcctgagcagggggcctgtgtgcgtgtgcacacacgcatgtgtacctgtacctgtgtgactgcgtcagcatctgatgaactcatatgtctgtgtcactgagtctggggacatgtgattatgcacctccctgagggagtgcatctcaagctgttgaccgacaccccgtaaccatgtgtggggtgggtattaacatgtgaccagctggggcaacccagtgaaaccccatctctacacaaaacatttaaaaattagccaggcatggtggcacatgactgtggtccccagctacttgggaggctgagcccttgagcctaggacgttgaggctgcagggagctgtgatcacaccacagcactccagcctgggtgacagagtgagaccctgtctcaaaaaaacaaaaaatgtgaccagctgcatgtctggctgctgtgtgtgtgaacccacatgtgtgtgtgtcactaaatgagcagtggtatctggggaaataagtggagcaagatcaaggctgttctggctgcttagggccacagtgggcccctctgagacccctctgcattcccttgtgagtcctcatgacctctgttaaccaggtagcccaggaggcagtgccgccagcagacatcgttttctcagtgaagagcccaccgagtgccggctacctggtgatggtgctgcgtggcatcttggcagatgagccacccagcctggaccccgtgcagagcttctcccaagaggcagtggacacaggcaggatcctctacctgcactcccgccctgaggcatgccttctcgctggatgtggcctcggcctgggtgctccccttgaggacgtcacgtggagctggaggtgctgcctgctgtcatccccactgggggcacaaaacttcagcagtagagggggcacagtcgcagctgcaccctggcccctccactgctccgcgttgccaggtcctgcttccccactctcccgggccttggcctgcaggtgctggagccaccccggcatggggccctgcagaaggaggatgggcctcaagccaggaccctcagcaccttctgctggagagaggtacggctgtgagagaggcccaggggctgcagcccagctctgggggcagagtggagggagccccggggactcccagtccaggggttatacagagaggagacagggagtcacatttcagaaagacctatgctttagatgctgtatctcgggctgggcgctgtggctcatgcctgtaattccaggactttgggaggccgaggtgggcagatcaggaggtcaggagatcaagaccatcctggctaacacggtgaaaccctgtttctactaaaaatacaaaaaattagccgggtgtggtggcccgcacctgtagtcccagctactcaggaggctgaggcaggagaatcgcttgaatctgggaggcagaggttgcagtgagccgagatcacaccactgcactccagcctgggcaacagagcgagagactctgtctcaaaataaaataaaatatcccctttcttcctcacaactcctctgggaaccagaacttatggtccccattttccaccaatggaagctgaggccctaaaagggtcagtctcttcctgcacccaaaggcagaacatgaagggtactgctggggcctgactgccagccctgggcctgcccctaggtggaagagcatctgatccagtacctgcacgatgggagcaagacactgacggttttgtcctgatggctaatgcctctgagatggaccgccagagccatcctgtggccttcactgtcaccatcctgcctgtcaatggccaacccccgacctcatacaaactcaggcctgcaggtgagcatattcctgggaccaccccccatgtctgctttgagaaagaggccaatgtcccctacttcccggcacagatctcccccactctgagcctcagtttcctcctctgcaaaatgaggacactactgtgtgcctcacgcagttgttggaaggagagatgtgagattgtgctgaaatagaacacaggtgggaggttttgttattggacatttgcaagtacggtaggcagacttctgagcagccatgggtggctctgctgttccttctcctgtggcttaggaccagaacacctgaaagaatcacttacaagcccttaagggctggcgtcagggtgggaccgttaagcttcccaccttcaccccagcaagtggaggcctcagcttggcttcccaaactcctgccccttgtccacagcagagcagggcccccatttggcaaaggtggaagttgaggcccagagatgggatggaacttctccatgattgcaaaagtagttctggtggaacagaaagggcatggctttactaagcccacgtggcagggctttgaaccccagcttctggggcgcgtcctccccagtcagcagaagccactgaaggttccgcaagagggctgacttgggctgtctctgacatggggcaccggggggctttggtggtctaggatgtgcctgtagggggtggcctcatggtgcggacgccacagaagagtgggacacagcaccctggaaccacaggctgggatggctgtgtggcagtgcggccaccaggtggtgccatctacccgtgtttgttccgggagcccagtgatggggccctgcctcccacagtatggcccctcttgccaaggctcggcctgagggctccctgcggccaggggaggaagcccaggaatgccagagggctgttttctgggcatgtgagtcccactgcagcactgcccacaagtaattgacccagcaagagtggtaccaggacctcaggaacgggtgcctgttctgcttgctagtgggaggcctgaaaaggggccccctttgcccaacacgaggagggcccgtaactgctctggaagcacctgggcccatcccagcactgcttctgtgctgcaggacagtgccaaccatcaggcttcagctctctgcgcctcccacccctcccttagctggaaggagtgctcgtttctaaaatcactgttcccacctgtgcccagcccctgccaggcacacatggagggtctgaaaggagactgctgccccaccagtgagctagattaaggagcactgttggtcagcgctgggggtttctgggggtgagaacttggtgacggtaagagctagggccttcctgggttgggtacacaagctggtcttgagggacacacaggactaggacagatgaagagcagggatgctgggcctggagggtggccttccctggggtgacagggaaggtgaatgcagggaggccatttgtgcaggggagccacagcagcgccagccttgatgccacctgagggcctgagcctcagtggggttggagccctggtggcagcccagggccggggaggaaggggtgggtaagtgtggcagggcagaaccttcacaggcctgtgtccccagatgtgggagggggccaccgtgcccatccctacagaggctctgaggagcatggatggttactctgggcccaaggacctggtgtacaccattaagcagcccagcaatgggtgggtagtgcagtgggcggtgccgggcactgaggtgcgcagcttcaagcagacccagctggatggtgggctcgtgctgttctcacacagaggtgggtgctgagggccgagccccaggtttctgctgcccacgggggcaccctgaggtggggagccagttcaggccagctggacccaacacccttgtccccaggggccctggacggaggcatccactttggcctctctgacggtgaacatacttcctccagacacttagcttctgagtgacggcccagaagcaagtgcttcactcgctggagggcagccggacactgactgcccaggtgggtgtgctgattgtgggcgttcctgggtgcggggggctggggcagagctgagggtggcatgccagggtcacactgcctctctgcagccacaggcctcggcctggatcacaaaggctgatggccccttttgcctctggcagagtccgtccagccactcagcagccagagcctcagagccagcaggcaccgacccccagctcctgctctaccatgtggtgcggggcctccagctaggccggctcttccacgcccagcatgacagcacaggggaggacctggtgaacttcactcaggcagaggtaagggccccactctgcagccaccactcagatgcgcccagcctcaggtggccactgtgccatggacatcatgtggacatgggcaccagctccagcatcaccggcagcagacactcccaggcctgccatggtccaggacctggtgtcctgccctctaggagtcatcaggctggcagggcaagttcatgttcccagaaggagggagaagaatgcaggaagtcggggatacagggccccagagcagggctggggtcttggggtgtggcttcccgaaggaagctagagctggacccaagggtctggagagggagaaccatgtaggggcactagtggcaccccagcagctggtgaggggcagtgcttggtgggggatggagtcggaggtgaagcagctgctggggcctgtgggcagaggtgtgagcctcgggctcagatcaggtgccagccagaggaagagtggatcctaggagcagatgagctgatgaaaggcagctgagtcggccaaaagggggaagccactgttcatctgtcctggtggcttcagagaagaactagagctctcagccatgggtagtggcagactctctgtggtaactgtgccacgggggccagcccactcatggtttaaatgaacacctctccccaaaggcagaatgggagttgttccatagcagggcagggcagggcagggcagactcttgtgggccgccctgggcaggcagcacacctgatgctcccatcaggaggctgcgtgagcatctggacccagcacatgatcacagtgagttctcggcagggagcggtcttgtggggcgcagagctgactctgtcactcaggagccacggcacacagcactgccccaagtacctccagaggggatccctgtcagcccttgaaaatggcagagcccaccccagcccccttttcaagctcccttgcttcggcaaggacctcctgagcctggcgctctccctcctgagaggtgcagatggtactcagcaagtgcaaagccgaggtttcttgggcctctcacatcagcacctcccagacctcggttctgtatttccctggagctccactcctgctatggtgcccttcccacaatgagatattcatcaggctggtgtctacagctgctgcgtaccctcagttgctgggagcctttgtcaagaatgcccaggaatgaggagggcacaggacccagaccatcagcaaccctcttgcactctatagtcccatgttactcagagcttccccatgctccagcaagatgaaggactagattgaatgggcaccaggctggcagtgccacccaggaaagctgggaagaggctacatgggctacctggcccactcagggaggagggcaggactgggtattgtcttgacagcaaccctgtcccacaacactgaactgggcagggaaggggtcaggtgtcctcatttttcagataagaaaactgaagctcccagagggcaggtaaatgtattcagagcacatggcgagtaagaggcaaatcttctgccagcaagtccaggatttttttcaccagaggacattgcttggtccccagagctcaggaccctgtgttttgtctcactcccacccacagagctcctgtatccaggcatcaactccaactcccactcctggaggccgaggcaggaggatcacttgagcccaggagttcgagaccagcctgggccacatagtgagaccttgtctccacacaaaaattttaaaaatagctgggcttggtggtggcatgtgcctgtagtcctagctactcgagaggctgacgttggaggatcactttgagcccaggaggtggaggctgcagtgagcagtcatcactgtactccagcctggtgacagagcgagaccctatcaccgccccccgccccaccaaaaaaaaactgagtagacaggtgtcctcttggcatgataagtcttaagtcccctcccagatctgtgacatttgacaggtgtcttttcctctggacctcggtgtccccatctgagtgagaaaaggcagtggggaggtggatcttccagtcgaagcggtatagaagcccatgtgaaaagccatactccaaggggctccaagtccagcgcacagtcccagaagggcccagcaaggcagccagggcggcacaggcaccaggtcccaaccttcttccctgtttgcccactctcagaccccggagttcatcatctcggagccgctggccaatatgtactcatgtgggaaccagaacacactgatggaggagttggcagagcaggcacagcagcatgacgagatgctgcacatgcaccacgcgctgaaggaggcgctcagcatcatcggtgacatcaacaggaccactgtcaccatgcccatgcccccgcccgtggacgacacctggttgtcagagcatccctgacgaacacaggtaccaaagactgccccccacggccccaaaatcccccacccgggatgcccagaggagtgccctgggggcaagtggcacaccccctcaccggggtggctcccacctggagtgacggggggagcttgacaaggagcactggctgccggggggggggggggtgtgtggagctgggatgttctcgctgctgggggcggggcttaagctctggcaaccgccttggggtgtggccggcactgcgctggggcggggtcgcccatctctcccctccctgtgcctcccaggtcgcccaagtccagcgtcaggatgcccaggccctgccatgtccctagcccggcctgggtggcagggcccaactcctgggcggcaggacccagctcctgggcttcctcctgccgggtccccccttggggaaacgtgccccataccctccaggccaaaagcttcccctgatccctttgggccctacccccctggtgctctcgggccccagccggggtcccccaggtaaataagggctgaatgccgctgaaaaagcccctggacacgcgtggccaggaaggaaatgggactggattccaaaaaatcacatctggccgccagaactggccgtctccatccaaggcactgggaccatggggtgcccgaaccacctgtggcccaaggctgggcaaaacctgccccccagggatcactgaatcctggaagtggtccttttttaagaaggggctgtggggctcatcccacctggcaccttctgttcagcacatggatgacacttccctctaatttcactcctggcggctgaccacacattgcatttctcttcctttcttctcgctgtcctccatccttcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttaccaccgggggaaatggatgaaggctatacaggccctctctctattatttttgacaagagtgtgagaatccacaattatttcaaaataaaaagacctccctaagtgcggacagaatccagccttgggccaaaggtgcgcaaactctcctcaaaatggggctccctgacagcacggccccctcctccaccagggcttcttccctagggctgggaagcacctccctgagatgcaggctcccaccctcctgcagctgcagtacctgatgagcaggatggcagtgtcatgctgcagggggtgggcgtctcccttcatgttgatgcttttctgccacttgcagaagctcttcagggtgttgtctgcatggtgcatgatctttaggtcctcctgggggcagagagagtgactgctcatgcctcccctgagttccaagaaggtcaggcccaattctcccccatacaaaggcaggagacagaggcccagcagggcagtgggaggcccgcaggcaccagtccagcttccggcctgaccatccctcctgtaggaacctcctgcaggagacctgggacctgagagagggtcagtcaggaaccagggagtggcaggggacacagtccagtccaaggaggccttcactgtgcccttccatacagagcagcacaggtcatggggcaggagggctctggcagccgaagccattgccaggcagcgtgggaccacatgaccgctcacctcctcatcttccagaaggaccaggagcacaatggtcatgtggatggggttcccaatgctggggtcgtgaaacaggccagccacctgcccaagagatgagggggtcaggctgtcaccaggatgaaggatacaagcagccaatgcccaccccaagccacccacccacccagggcaatgcacacctgtgctcacacacagggacgctcacacgggtgcacacaggctgcacagcggataggcaatgcacatgcaccaatgcatgagtgtccccacacctcacacgcactgccccaatgtggcagcagcagaacctacagaggacaagaggcctccgacgccccttcccagaccacaaatctttcctagaccacagacaggtaagcttggtatcagtccccagcaaagtggctccagaggaccagaagcccctgagggtctgctctgcctgcctgaggactgacccaagctatattctgagtcagggctaggggcagcttagtgccaccacaaaggccttccctcagcatatataacctcactgtctcccaggagctatgggggtaatacaggcattgggagatgttggagggaggcagggtcttaattggctgatcaactcaaccaagtaacattggttaatggcccaaggtcaatgtggggtgtttcaactggataaatgatatccagggaagcccagccctgttctgctgcaggtctggagagcatgccagaggtgtgcagtgtttgtgaaggtaagatctggaggttacagataaccacaggctcctggtgagctgaaagtgtgacaagagcccctcgaaaagggcttgtggcctcagagagtaagaacagaattgggggtgaaaatggggtgaaactggctgagcacggtggctcatacctgtaatctcggcactttgggaggctgaggtgggcaaatcacgaggtcaggagctcgagaccagcctggttaacatggagaaatcccatctctactaaaaatacaaaaaaattagctgagtgtggtggcatgcgcctgtagtcccagctgctcaggaggctgaggcaggaaaatcgcttgaaccagaaggcggaggttgcagtgagctgagatcacgccactgcactccgacctgggggacagagtgagactccatctcaaaaaaaaaaaaaaaaaaaaagaaaatagggtgaaaagggacctgtcttgctatccttgggacaaacccacccaagctctaggactcagatctgagtctagcacagggagaacacggataaattggggtctgtaggtggcgttggtaaagaaagatgaggctgtcctgaaggtggctgtgggtcagatactgcagcagccaaaaaaatagccacagccaaccttgatcgagcctaacatgtacagtccctgtgctgggggcttagcatgcattatctcatttaatcttacttctgaggtaggcacaattatcctcattttacaaatgaagtaactgaagctcaaagagagggtgaagctgggctcagaacccaggtttcactgcttcaaagcccctgcttatttcctaaatttggggaatgctgcctgcctattctgttggggattctcaatgaatatttactttgagggctctgagaagtcctgtagtaacgaagtctgttttacctttttttttttttttttttttcgagacagtgtctcactttgtcatccatatggagtgcagttgcatgatctcagctcactgcagccgctgcagcctcgacctcctgggctcaagcaatcctcccacctcagcccctcaagtagctgggactacaggtgtgcaccaccatgcctggcccgttttactttttttaaccctgtgtggccaaacttattcaacagcagcatctttttttttcacagtgcactactggcattctttggaacacactccctgaaatattccttgggaaatgctacaatgagacagagtccccacatgcagaatcatgctcttccacatccatcaccttatcccaggtagagcgatggctctcaacaagtcagtcttaaataaacatctgatcctgagggaacatctgttccccatccttctggcccatcctggcccagggcacacgtctccagggcttctcctcagcgagttctctggggcactgggaaccacacagggatcagaggcgaggggcctgaattcccctcctggctctgccccaaacctgtgctgtgtggctctgcctgaccactttctttctttgatcttgagattccctgactaaaaataggaataagttgatctgcctcatggggggacctcaaagggtaaatgaaatggtggatataaacgcagtaaagtactgtgtccatgggaggggaactcctgggcttgacaaagctggctactgggcccctatctccccgtgtcacttcctcccaccctgggggcttagtgcatctcaacactgacccctgaccccaccctctaaaccccagcctggggaggctggccaagacccagcccagcttgccctactgagcctgctcccctgacccaggctgctccagatcagaagaggaagcacatctatgaagctggggaaaatgaggccaagaagcatgcctctgtggatatgtgctccagcaaatggagtaccagagctgtgggcagcctgagattggcatgccagccaagcattccccaaatcccagcaacccttagcaggcagctcttcacctggactggccggcactactgctgctctgcagaggaggcactgggtaccacactccaggtcccaataatagaggttagttattctagggtgggagcagggtggcatggggagggaggttcctggctaatggccctgttggagctgggcatggctcacctggtctggacactggagggagaatggctggcagagccaggtgccataggcttggtggggagggagcaagagggaggttgagccccaaggtgggagaagtaggtgagatggagagagggaggtcagtctaggggactgactgggacaggcctgaaaggcagaggacacagtcttgtggcacaattaagggcacacgctatagtgatgtatccgtctgtctgtctgtatcctctggtctaagggacaccgagcatgggcatgttacgaggggcttctagaaaggccccttcatgtccccaggcctagcacctgcctgagaactgggagtagaagagcataccttgcaccccacaggtacttggagcactggaatcaccccgctgtgccagcctctccggggccggatgcttgtacaccacatggggctgggcatggctgggccaggctggggcaccgtccaggggctgaatgaagtagtccttgttggagagcaggaacacacctttctagggaagaagcaccagggtcacacagggagggctggccctcagctgctcttcctgcacgtcccagaggcccatcctgctcagctgagcccccactgcccacatcatctgtgactgcccacagacaccctgcactttccgcctgctgggcctttgctcactctgtagcctccatctggaaagcccttctctgccatttcacacacagccaaaccttcaaagcggagctcagaagcctccgcccctggggatgctgccccacacacccaccctattaggagaggaaaacgggtctgcacccaaatctgacaaaatggtgtcttccaaagtcccagacagctgtcctgagcagggcagcttgtgcccaggcctccaggctattctgcgtcttctctgcaggccagccatttccagcactgtgctccctcccagctggccagggcttctgaccttccctctatctccctaaggcaatgaatcactccaaaagcatccacacccacacccgagtggcggagatgcccacggccaccaggacaccctgttctctgggcccagggctgcccagagaagggaagctggcaggagtgtcttggacatgtccgccaacattcagagtccagggaggggaggggccccaggaagcatctatgatgcccactacctcctgaggaagctcagggctccaacaggaaagaaggttttacatccctcggacttcccctcataggcaccaattctgccccttgagtcacacaggaccagggggcctggagggagggctggagagtgcatcagctcttgggtctggagacctgggtatgaatgcgaagtccccccctcccgcccaccactcactgaatgactaggtgagcctgggcaagttcccctctgagcctgtttcctcatctgtgaaatgggaatgatgccccatgtgcacagctgtggcacaggctcaacaagatcaattgtacattaagggacaggcacaggctccataaatgggaatactgtgcagggcagatgggccttcaaaggtccagacgttgtgcagcttgcgttgtgggctgccctgtcattaggccctgtgcggccacagcccatggtttttgcctgagcaatctaagctgagggcctcctgggaacagtggacgctgagagtgtgcacacatcccctactcctcccaaacccccaccctccagagctgggagagtggggctggtcacctgaacacgaacagaaaggggccctactctgcctggagtggaagctgctctaatcagcacccaatcagggagcaattagggctgcagtagccagcaccacccttcagccagtcgaaaccaggaagctgaggcctgcttttcccggagctctgatccgagcagaggggctgaaaggggttcctcaccacaccctgcagaatggctacagggtgaggggtggctttcctggagaaaagcagcctaaagggacctgtgaaggaacagtcataactgatgccccaaggaagagaagtcaactgctttttcagttacttagtccagtcaaacagaggttctcaaaatgggatctctggacctgcatcttcaatattacctgagacgttttcagaaatccaagtgtttgggcgccattccagacctaccctgcaaaaattctgtttaaacagggcctgcaggtgatttgagctcatattaaacttttcttttcttttctctttctttctttcttttttttttttttttttagtgcctggggtctcgctgtgtctccagctaagcgccatgatcacaccctacgtcctacatcctttaactcctgggctcaagtgatcctttcgcctcagcctcccaaatagctgggactacaggtgcaccaccacccggctttcacattaaactttgagaactgttgtcctagagatgaacgaggcctgcgttgtcactcccactttacaggcgtgaataccgaggctggcagagaaaaagtgcactgggcaaagccaccagacaagtgcgtggcaaggctagagccaatctccacatcccaccacccgagactgccccaagtatacatgtcccagctcactcaccaggccgtcgcaggcgctgatggccgccaggccaccctcgagctcggagtcctgcacctcgccaagcaggtggcaggcgggggtgtgggcccggatgtgcgcgcgacccagggcgccgcgccgcggcatctcgctcacaaagccgggcgccagcaggtgctgattggcggtcaggttgaagcgcagctcgcgcctgcggtattgcagcgggtagaaggcgggcgcgtctcggcgcacagatacatcccgcttgcgcagtgcgcggggccgcagctcacaggacaggaaggaccccccagcgtccacgcgaacctggtgcacgatatccggtgccgcccggccctcggttacacttcctgcagggagggaaccacaaaggccttaggcccagggcagaccggggtccttgctggtggccagggaccagaggggagcggccaagagggggctgctggagtcagagtatctggattcaaatcctcgctgggctatctactaactctgctatttcatctttccgtgcctcagtttctccatctggattgttgcagtaactccttttgttgttgttgtttgtattttgggtttttggttggttgttttgagatagtctcgctctgtcgcccaggctagagtgcgtggcgcgatctcggcccactggaacctccgcctcctgggtttgagcgattctcccacctcaggagtagctgggactagaagcacgcaccaccacgcccagctaatttttgtatttttagtggacacaggatttcaccatgttagccaggctggtctcagattcctgagctcaggggatatgctggcctcagcctcccaaagtgctggaattacaggcgtgagccactgctgcccggcctggattgctgcggtaacttcttaacaggtctctctgtttccactattgcctaccccaggtgcccctcccctcatgttttcaatatagcagccagagtcattcaaaaccagcctgatcatggtccttctctgctcaaaatcctgcaatggtgcccatctcactcgagcaaaagacaaagttctggcctgtatgagacgctaggcaaggtgacctgtccaatctcatttccagctacaccttcttagttccctccactccgcccactggcctccttgcagttcctccacaggccagacatgctgctgcttcaggattttgcattgctgttccctacacctgcaacactcttccctctgttttccacgtggctaaaccactcacttttgagttcttgctcaaatgtctccttctcaatgaggcctcctataatgactttattttaaaattgcaactccctggctctccgtatccctcttccttgctttatttttccccatagcacttctgacataccatatcacttagcattttcattattttttctatttatttgttttctccctcccctcccaatgtagtctaggaaggcaaaaatctttatattctttgcccccagcttttttggaaacagggtcttggtctgtcgcccagacaggagtgcaggtgtgcaatcataggtctctgcagcctccaactcctgagctcaagccatcctcccatctcagcctcccaagtagggagggactgggactacaggtgggtgccaccacacttggctaatatgtttttatttttagtttttttaaaatagagatggggtctcactatgttgcccaggctggtctcaaacaaactcctgggctcaagtgatccttctacctcggcctcccaaagtgctgggattacaggtgtgagccactgcagctggtcctggataatttttttgtgtgtgtgtggagatgggagtcttgctatgttgcccaggctggtcttgaactcctggcctcaagcaatcctcccacctcagcctcctaaagtgctgggattacatgtgtgagccacgacacttggccctttatattctttgttgaagatttaagtgtcagaggaagtgtccagaacttagtccttttttggtatttgttgaatgactctgtagaatgtggataaccacagcacttacactcttgatgctgctgtgaggattaaaccaggtgagctactccacatttagcagtgcctgaaccactggttgaatatgatggcaattatgattgttatgattattattagcctgatggatttaaaaatgtgctctcaggtgcgtgagcattctgcaagtgtctccaggcctcctggaatggggagacagagaaagaccaccccagtggggctgcctggcccctaactgccacttcaacagagtggctctggtttctttcttttacatggaagaattcatttaaagaaaggttccagggatggaaaaaattggcagacctctgctcaggcccttgcagtttaaaaacccctctctgttgctctgtcctctaggatttcccaataaggcctggattcttatccttttttgccacaaactccttctcagaacaatattttgaaatgcagaaaataaaatacataggagtggttgggcccggtggctcacgcctgtaatcttagcactttgggaggccgaggcaggcaaatcacttgaggtcaggagtttgagaccagcttggccaacatggtgaaaccctgtctctactaaaaacacaaaaattagccaggcgtggtggcacatgcctgtaatcccagctactcaggagaccgaggcaggagaatcgcttgaacctgggaggtggaggttgtagtgagccgagatcgcatcactgcactccagcctgggtgacagagggagaccctgccataaaaaataaataaaataaataaaataaatgcacaggagtaccaaggaaattgattatattgaaatacagttatcaaaataatttaagaccaggcaaggttgttcatacttgtaatcccagaactttgggagaacaaggggggaggatcacttgagcctaggagttcaagaccaactgggcaacataatgggaccttgtcgctacacagacacacacacacacacacacacacacatacaaaattagccaggcatgatggtgcacacctgtagtcccaactacttggaatgttgagatgggaggctctcttgagcccaggaggtcgaggctgcagtgagccatgatgatgccactgcactccagcctaggtgatagagtgagacattatctcaaaaacaaaacataacaaaacaaaaaataatttaaaaagtagggtgtggaattatactttaaacaagattttctggcaaattaaacaactatggttttttttttttttttttttgagacagagtctctctctgtcacccaggctggagtacagtagctcaatcttggctcaccgcaacccctgcctcccaggttcaagcaattcttgtcccttagcctcgcaagtagctgggattacaggcacgtaccaccacacccagcaagtttttgtatttttagtagagatggggttttgccatgttggaaaggctggtcttgaactcctggcctcaagtgatccactcacctcagcctccaaaagtgctgggattataggcgtgagccactatgcccagcaactacggaaattttgaagtagtgatgaacgtaaaccttatttcaagatacatgcaacaactgtaatgagatagaaaaatatttggtttgttctattggtaacaaaatcacaggtgctgttgggatttgctaataatattcataattgagggaaatactaaatttcattgagaggttacaaaaagtaaatatgtaatattttcccattcaagctcatggatcccctcagttcacggtcccttaggctgtggaccccaggttaggacacctgcagtagggtgtccagactgcttcctaggtgagagagcaaagggaggctcagagaggtggagagattggcctagagccacacagtgacagtgagagtggcagtgctgagactgggactcaagtcccccaaatggtttcagtctcttcagtaacattgctttatattctcaacagtccatcccttactgggcctcagtttccccatcgttaatgtgaaagagttgaattagatcacgtttctcaaatctctttggccaccaggtctagtctcaaaagaaatctcatgtgccgggggtgggggagccctggcatccatgcttttcccactcttttccctctctgcagttcccaggctctaaagagcacagttagggaacttggcaatctggagtttctcgattgggtttatacccagctcccaggatcctggctgttcacgacaatagactccacgggctcacatgaatgcctgagtgccctgctgacatcccaccaggattccttctgctgctgcccagcccaaagctccatcccagcaggctgcggaaaccaaacccgccctccagtctgtcccctgccaaactgcatgtagagtgccctgcacacgtcagtgctgtgcccctgctgagagcatctcccactgctcacaactgccccagcagtgccggcctcaaagagctttctctgagagtcaggaggttggatgggctggggcaacgtgctatgtggctctgagcaagtcttcctcatcactgagcctcaacgggccactagtgcaaggattttccagatctcacagatgagtttcttaaaaacaaattcccaggccccatcccagactcactataccagcatttccaggaaactaggactagggactaggaagctgtttttaccaagaacctccgggagctgtgatcctcaggaaagttaggaaatcccccactgggagtgaacctggctggtcatcagcagtacgtggagagctctgaaaaactgcagatgcccaggacccagcccagagattctagttccacagatccagggctctgggggccctagaatgtgtattttctgtgtttttctagaccttcccagggattctgatctagccagttcagaggctggcattcagaaaccaccggactggatgatttaaggtgacttcttgctctgacatcctaataaggacatatgggactacaactcctcaaccacagcgtgcagatttgcttgtgttgatcagttattgattttttggtttgttttggctgacacaaatattgaaaaatgttttagtcaattgccaatgtttaggaatcacatgatcttgtacaaaaatctcaattttcagcttttcttgaaaagtcttatcatccatccatgtcaggcttaaattgctccctggcagaagtggctggggtggagcagtgagttccctttaggaagggcctatgctccccggtcctcagtccccaccactccctattcattcccagcactgtggctgcaagtaggctccctttcccatcatgcttgtgtttcctttcactcagtaaagaactgagtctctaacaaaagtgggaaaacaagagatgggccaagaagccccatgtttcaggaaaaatctgtctccctacccacctcgtttgctcatttatgttacctgcctagtccatggcatttggtatgtgacccttggctactaactgtgagggggcactaggtgctccaaagtccaggacagtggataagacaccatccttgccttcaaatggagaaatggccggacgcagtggctcacacctgtaatcgcagcactttggaagaccgaggagggcagattgcttgagctcaggagttccagaccagcctgggcaacacggtgaaatcccatctctacaaaaaatacaaaaattagccaggcgtggtggtgtatgcctgtagtttcagctactctggaggctgaagtgggaggatcacttgagcctaggaggtggaggttgcagtgagcagagactgtgccactgtactccagcctggatgacagagcgagactctgacccccacaaaaaaacagaaaacaaagcagaaaaatgggtgtggtagacccaagacccccactctggcacagtgctgacaaggtccaagcaaggggaagggatggcaccttatgaatgcgttggaatgaagaaaagtttcatcaaggaggatgcatttgagatgtcccttaacatatgttaattcaacagtgaagacaaggagggcctcttggtggtaggggcactgtgtggtaaaccctcagagaagtggggaaaagccaaaagtaagaatgggcaacaagaagtttaatcttggcccaggcatgtgttttgtaaaatgggagacaatggatggacaaaataatgcactgtcaagagcgtgggcttgaaagtaacaagacccagggaatccaccactgagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttagtgaaccactgttttataagtgaccaatgcacgatgttgtaatatcatgcaagggtggaagatccaaagttcaagaaaaaccaagatttgatggagtatcaaaaaagaagcctaggcaacatggcaaaaccctgtctctacaaaaaatacaaaaagttagccaagtgtggtggtacacacctgtagtcccagctactctggaggctgaggtgggaggatcaccttagtccctggagactgaggctgcagtgagctgtgatcacaccactaccttccagcctgggcaacagggcaagacctcatctcaaaaaaatatatatatccacaatgatctaaaatggttatctgtatgagattggcctttgttcacattttttcaagaaaatatcacacaataaattgaatgcagaagcaaactgacatatcaatttgctaatgacatatcaaacatcatgcaaatgacatatcaaacatcaaaataatttgcaaaagatgtaagactgtactactttgggtttagaaattttcttttcataaaagcatttataacaatatgtggtgagcttttaaacaatattttaaatatttctgatttaatttctagtgataaataccaatagatataccctacataaaccaaagctccttgggacctcaatgtatttttaagagtgtaaaggaatcctgaccccaaaacttggagaactgctgccttcccctccactttcttccttctctagaatttcttccttggaagaaacatccctttgccattctatattaacttacatagttccactgaggcaagttttgctacctccctcccatctttccacctctctctcaacacaaaacctgaccaaagcattctaccagcccaccccatttccagtgattagctgtcaggtgggctaagccaaacaaatctgggttttccctgagactagacctctctttctgggagagatggaatcacagggacaaggttggccaccttggggtagtgagaattcatcctgcctaaacagggagaattcaaacaagtttctagaaagccaaactactttctagaaagtcaaagataattatattttttgccatgactgtaagaatgcccatttcattgcacactttctaacatttttaccaatctgataaataaaagctggtactgagatgaaaaaaaggctgggcacagcggctcacacctgtattcccaacactttgggaggctgaagtgggcaaatcacctgaggtcaggagttcaagaccagcctggccaacatggtgaaactccgtttctactaaaaatacaaaaattagccaggcatggtggcatgcgcctgtaatctcagctactcgggaggctgaggcaggagaattgcttgaacccaggaggtggaggttgcagtgagatcacgccattgcactccagcctgggtgacaagaacaagacttcatctcaaaaaaaaaaagaaaaaaaaaagaaaaaaaaagttcccatacaatataatttcttccatctctggaaacaaattcagcaatgagaactgaaagtcaccacgtggaaggtttcaaggatttacgtctacctactgatgtctaaagcattagttaagttacaaaaaaatacgcacacacgcgcacgcacacacacacatacccgtatgtattcagtaccagaaaacatgactgactacatggtaaagtcatccaacagaaagcacacaataactgaaggcaatgtagaggagtaagttataacatggatctacaatactgttgagtgaaaaagcagattacaaacaaatatctgatttttaagggagaggaaacatatacaagcacaggagaaaagaggtgagcagatgactggaaagatacaaatttctgacagtggcaccttctgagtggtagaattacataggtaatattttctagttttgcctaaaagttttctaaatttcttaaaataagaaggttttgttttccatattacaaaatatccatcaccccaggaaatttaacctttggcacaaactctacaacatgttcaaagtttgttcagttgaatatttaagagacaatctattttgaaagacatttaaaatgaccaatatttaaacctatgcattaatatttttcaatcacgttttaaattttgtaattttgataagttttagatccatcttgaaaagataaattttctgtttgtctttaaaatattacctacaatatgcctgtttttatacagttaatggtgctcaaaaatcgcaatataaattcaggcagtgttccttctatagaatgtgtaagtgcttctaatactgctctttttcaccagttatgaaaacacggaacaattatctaagcatctaattattcaggtcctttgtttctcctccattctgttagttttatactaatttcaaggcctgtgaggatgaagttgtctgtgacagctaccacaaaggttactataagcagacaaatttccagcaagtttatcaccactaccatcccaccataaaactgtctcaatcaagggcaacacaattcaaggttagtcaagacaacctctttacctgtcactgcttaagaaaaggattttttggtcttatttagaaataactttatctatttttctccataattccactgagaccaatgtgtgcctctatctcaagcaccagcaagcaaaactgcctgccagtatgttcagtttttgtatctttccaaatgtagggcacagctatcttttgatatcataattttttgaaaactgatgcacaaacttcttcttgaaagttcagccaggtgcggtagctcacacctgtaatcccagcactttgggaggctgaggcaggcagatcacgaggtcaggaattcaagaccagcctggccaacatggtgaaacctgtctctactaaagctacaaaaattagccaggtgcggtggcaggtgcctgtaatcccagctactcaggaggctgaggcaggagaattgcttgaacctgggcagcagaggttccagtgagccaagattgcaccactgtactccagcttgggtgatagagtgagactccatctcaaaataaaaaataaaaaaaagaatttcagatatacagcagttgtaattcttctgaaggctgcttatgggacacattactttcataatttgctgttcaataaatgtggggtggagaataaagtaaattgacagaattaccatataaaataaaattctaagtcctctgacaacaaaaacttacacacacacacacacacacacacacacacacacacacacacacacagctttccctgctaatcattttacaacaaccaagtagctaacccagagcccacaaaagcagagtcaaaattctaacacttggtaaaataaaaatgcacatatatccctgtcacctaaaaaaaaatgcttacgtattcaaagacagcaattgtagctactgagaacatcattgtaagcaaactgaggcagagaaaacaaacgtgctgatgaggatttgaaacacctaagctgcagaaacccactggatggtttcctaggttccgagttggcattatctttcagaacgatcttctagaagagatcacataacactgttacaaaggatctggagaaagggaccctggcttcatcactctggctctccagtcatgctttacattttcacttcttacactctctttcataggaagtcaatttacaggcttccaccaagcccttaagtgacgtttttgtactatccatgacaagttcttgatgttatgtctgcacttctgacaaattcttagcagttaacttactaggcagttaaggtttttgttcaagcacaatatagctagaatagggtcatacattcaataaaacaaatatttaccaagcatttattgagtggaagataaaaagcacaaagcataattataaaacattctcccctgccaccataaaaatttttttaaagccttacagaatatagcataacataaccaaagcaaaaataggactaaagaggggaggaaggggaaatatcagcatgaattaaatatgacccagaagagccttgatggtcagacacgtaaagacaaattgggtagggttagggggtggctgtcaggggcacattctacaggggaaaaacagctgatacagaagcctgaaaggaaaaccgggcagagcacctggacaggactcttacctgctgcatccagggtacaatgcgcctttccagaacacagcagcgacccggggtagagggatcgctcaaacagcaccagaggctgcattccaacttttcctccatcaacgagtccgttttcattgttagtttctccttaaacacgattggctgaacatgcgggaacaaggaaaacctgactgaagaacgaggcatttaagcttaagggccttggatctgggcgcggtggctcaggcctgtaatcccagaactctgggaggcagagatgggtcatttgaggtcaggagttcgagaccagcctggccaacatgatgaaaccccatctctactaaacaacacaaaacttagccaggcgtggtggcgggcgcccgtaatcccagctactcgggaggctgaggcaggagaatcgcttgaacccacagactgtcaagagatggaggctgcagtatgccgagatcgctccactgcactccagcctgggcgacagagtgagactccatctcaagaagcgcctgccaccatgcccggctaatttttgtatttttagtagagacagggttttaccatgttggccaggctggtctagaactcctgacctcaggagatccagctgcctcagtctcccatagtgctgggattacaggaatgagcactgcgcccggccaaaaaaccgaaaatcttaaaggcctttccccttccctcactgggctcaaacaacagcgggagccgccctgccacgccccgtcgcggtccaggggagcaggctagctgactgagggcgatcatgggccccaacaggtctgcgggcgacgcgggctcccacctcagggcgcagcgactggggcgagaggtgccggcagcccccaagccagccccgcggcaaggagccagagagacgcgccctccccctcctcccacgcaagcctcacacagcggggcgggccagacgcgggagaaaggggcgcgctcgccccgcctggggaaccggggcctctcccgggcaggctcccctttgtcccgggactctgggcgcctcctctccgccctcgccctggcccgtgaggccgccactgggcgcctcaccgtgatgttgcagtggagcgtgagctgtggcgggggctcctggttcttgtggaagatagaggccaacaacctcagcttggccttgaaccctcacacggacattttactctcacctctggcgggaggggcgcggaaggtgagcccgtcgggagccgctgtcacggccgcaaccacccgcgggacctctcggcggcgctctcccagctccgcctctccctgctgcctcaactctattcggagtagggctggaaaatggcaaggggcaccgaggcctctgcggggagctgtgtggcggcctgggcggctgctccccttgtaacagactccaccgacaggaggcgctgctcctgtcaagccgcagcttaaaagggcaacagcaccacagtccccgctaccgcctgggaaagggctgcccctaccccgctcccgtccctctcgcccctcacacccgtcgcccctcacccctcaacccgcgcgccccctgcgcacccgtttcggcggctgcaggagtccagagcatgcgcgcgcttccggctgccccctcctcgccttgacccagcactgctggacccatctggtccgttcttcacactcgcggactggaggctccgggcagcacaaccaccaactcgtgtgtgtgttggggtgggggtggggggcagaaaaccaccaactcgtgtgtgtgtgtgtgtgtgtgtgtgtgtgtgtgtgtgtgtgtgtgtctcccaagggaacagcactgctgagttcaggctatcagctcatggactgtcagcaaaatacagtcacaagaaggctatgtgctgttttgtctcttgcagtgacgtcatgttgctcatgttttatgtttttcagagttcattagtttctgtttgctctcagttaatatccagctcaatagattgtgtaagtagaatacccccaaactgaaagtcacctacataaaatatagtgaaaaatatgtcacccacttaaactatagttgaaaatatgtactcattagttttgtgtagccaacactggataatgggtaaggggaaaggatcccagggctagactgcctgggttcaagttccgatttcctgctggctgtgaaatacttgacagcgttcagcctctgtttcttttcttttttttttttttttttagcttaatcccaaatatgatagtaagtctcagtttcttgatctgaaaaacagaaattattcaatgacagtctatgtgaaaactttaaagttttcaaagccactatctagcttaggaaagtcctcagctttaggggttaaagtttttaaaaccactgcctggttcaggaaagccctcagctgtagccattattagctatgattattattgtggtggctacacatacattaatgaggcaggaaaatgctcaaggataacaagcaagtatccagattatctcatcagaccaagacagatgcatatgcatgcatgatcatgttttagctcagagccatttgtctaaaaggctcttgaactcagaggcccaggagtatcaactttgctttgcagtggagccatcgcttttgttaatcaatgaaattgacataatgctcttcttttttttttcctttttagcaccaaccatgtgcctagagctaagtgtgttaagaagagcatgcttcaagtggctggagtgagcaattcaacttgtggaggaatgagaagtgacagtgttgagacaagcaacataaaaccccagggtaaggtagaaatcactgaaagtcaggcaaaggaactggcgtccagtaatgagtcaggctttgccagcctctggccctacagatggctctttgcagaggaaaaaattaagccaggcccgagggcacagatcctaagggaatgctggcagctctaggctgtctatgagagtccagagatgctgcttcaccctggggctttaggcaagtccctttccctcccagagcctcagcatcccttctagcaaatgacgttctgcctttctcctaggatggctgtggggatcaagggagacagtggccatagggatactatgttaactgcagatgcggctgtaggagcactttgctaacttccagcgtgagttcagactcttcaggctatttggcacccagatctatggtgaggtgtgacatatgggatgtaaagtttgatgcctgctccgactccagtcttgctaacacacacgaaacctttggtaaatcatgaccctgccttggggaaaagggcagtctgggagagcttcttcaaggcagcctggcttcaatgcagtctggggcatgactgaggtaggcatacatggtgaggaactggagggtaactgggtaaagagctgcagtgtgggcagaggtgtagtgtgggtcacatcgcggatagccactggccaaagcagggaacagagacagaatgaggaagagctctgtggggagggtggggcacagggtggagaaccttcaaagtccaaagagtatgacttgttgggattcaacgctgtaggcagtagggagccatggaaggctctgaggtggagaaatgacagccggacattagtgagcaagccctgtctccgtgagcagcatgggtggtcctctgagcacgccaggcacgagtgtgcagggagctggtgcaaatgcctctgtgtgcgggtgagcatctgtgttgtgactctgcccacgcatgtgcttcagtgtgccgagtggctgcacgccccagatccatgtggcacgtgccggccggtgagggtgctgggcattgggaggtggcggggagggcgacgtatgcgtgttgtttgtgggcatgtgtgttagcgtgtgcatgtgggccgtggggcctcacagcatgtgtgtgcacactccggcatgtgcgtgtgtgtgtcccccacccccaggcctgccccacccatgcatgtgacctgccatgtgatttgaagctgtctttcagaatcactatcagtggcccctgaggagcgtcagccatggtaggtacatgcctcactgcctgctgcatgaatggtctgcctgccccgctgccccagctccacacagggggcatacctggagcctcagagccaggctccctgcccctcccttctggagctgcagacttgctctttcctctttctgtccttgtgctgctggctgtctcactttgctccctgtgagccacgggactcactgccactgctcaaggtctccatggctgagcctgggggctcttacaacaggctccatgcccaaggtggcagatgtggaaccatcagagagggcacagagctcatggtttatggtgtaggggctgggagcttggagggggttgtgtggggggctggactcaggcggccagaggcctgggcacatcatcctgggcacgccgtacctgtcatgcagtctgagtcatgctgccagggcaggtatccagctcccagcctgggagtgccaagagccaaatccactgcagattaggggtgatagtcacggtcccacgtcctctatctgtcagcaatccagtggtgatctaggataaaagcctgagagtcctatacacgcggtcatcccacaacacacttcataggccatggaaggacacacagcccccttccctccctcccaggtaccatgatagctgctagcgtgcgactgaaggcagggtccctggcccctgctgaagcactactgctggccagcaggctcacgcaccttggcctgttgcttctaggggtcgcctgtgctattcagccaatagtgctgctggcccagctgagctccacctagagagctcacttccctttcctgccgcggagtctccctcttctgcttttcccagcaggaagggcccagcctcacctatgtaacctgcagccccccgccaaccagttgaggctgccctgttagacttagaagtctatggccaatggcatctggctacctgccctccctgccttccccagggtccctcagaggaccctgggctttctgatggcccagaggggcctctggcattcactccagccagccatcccttatagctccaccattttggttcaatcagtgttccttctctatcaggtctggtggctgttggatggggctctccaagcaagaggtggccctgggccgtgagttggaagacagggtgaccagagaagagagaagcccgagggggctgagcattcatctgaactatgggtggactgcctgggtgccatgaaagaggccagcgtgtgtggggtggggagggccgccgcagtccccaggcactacctatgaagctccggcttctccctccatcttcctcccctttcccttccagcccctcttttccaggaaccttgccatgcccacacctacgccctcccctccccggccctccacagctgctgcagcgcacccatactctgcacttgcctcaccagctctggcttttctctaacccgttttctctctgctttctctccaactgccagctgattgggtcaggcaagtccatcccatccggggagccccaggccccacttcgacctctaaacagattcctcctcttctcagagacctccctttccaagcctgcctgggtgggtgtcctgtgacttgacagtggctcccccagccccaaagccagcccccttcttctgtgacttagtctgttgtagtggtgagctgacacgtccaggtttgaccgttgctgaaacttgtgccccctctgtggtatgcccctgccctgttctataaatagctataaattctctctcacacacacacacacacacacacacatatatacatatatatacgtggccaactgcctcgcctctagcactgggaatcagtccccgtgctgtgcttgtggagtcttgtagcccagcaagaggaagctgtctcctgacatcgcccctccaaagtgcaccacctccagtgagcttccgggacatgcgcggcctgtggacagccagcccccgccatccctcccgcccttctggccaagcatggcggtgctgtgcaggcagctgtgtggcctgacagtctctaccagtcctgctgtcccttggctgagaaacccatttctggatgacagagaatgtgtcctctgctggctgtgttctctatggagctcaggggagggaaaaggccaagccatttttagggtgctgttgggagcagtgaaaaggtcacacccttttcaagggacacttttcctggaaagtccctggagcttagctggctcttaccctgtgaagccggctctggccactaggggacagggccctgaactcagcctggagggaacctgcggggcagccggcactctggagggacagacaggccacccggtgcagacaggagagggaggcagggggacagaacggaagacacctggggtggatggaagtcagtgcccttgggcactggtatctgtcttccctgccacagctagatcaggcttctcaaccagttggctgtcagggccagagtgtactccgtaggcgccatggcagtccccatgaaatccaccaggtgtcaccaggcagcatacaggtaacaggcctggaaggtccccaacagcccagctggacatgctgagacactctggggctcctcattcagtgggacaaactgcaggacccagtgagggaaatgggaacataccaggccgagcagtatggctaaatccatttattccaaaatcaaaagcaaaaaaaaaaaaaaaaacaggagtcccatcaccagggagccatgaccccatccccgcctccttcctcgctcctatgctagcaataaataagtttcccagtcgcgaataattataagaacctcttcctcatatgccagctgcaacctccgctaggtacgatacagaatgttacacagctacagtatgtacacgggggaaggggggccacccccagcagcctgtgccctggcctggtctacagttaactccactgtcccgcctcagctgcctctctgagtaagaagatgggagcccccctgagggaaaagttgctttggtgagagtaagaaggccgtcagacctcctccaaacaaaccaactccaccaacctctggctcttaaataacaaacatcatcatccagaaatgtaaggactcagccttggtcaaggtggtaaagggtctgtttgtctccctccattagacaggggtcttgtcttgctaccctaatggtaaagggctgactggggaggggttgtagggacatggtgggggtgaagactccagacccacttctccaggcttatgctgacaggggcctgcttttatttatttttatttttatcccatgatgtttttttaaatcccgtaacttctttttcagaactttttaaaaaaacttttcataaaactttttttttttacttttttcccacatctttttttgccacaacttttccacagtattttttatcccgtaactttttcatcccacaactttaattcctgtaattttttagtttgtgttcttttaataaacacacttacatggttacaattttgtaagaataaaaaccgattatctcatgccaagcatgcccagcatttgcacagtctcaatacctttaatactatagttttcaagacacacaaaatttttaggcaaaacagcaccttgaaacaatctaataatttattacattacagtagcatcacagaagcagtcaataatgccactttagacaaaaatcagtatttccatcatgcattctgtgtataagaattcataaatcggtaaaagtcgttctaagaaaacttggcaaatacagctttggactggaattggcatttctttctctacttttccttcccctagattctttgttttaagctacagtattcgtattttaaaatgttttaaattattttaagacattaatttaacagttacatttttgaatagttatttgaaagtgactgtaagataaagttttagagaatctattttggatagggttgatttacattttcacattttctaaaaatcagctttggttttagaactgattgtttttcatttcaggaaaacctatcaggtttaatctattactttaaaaataattatcatatattgcagtctttaaataggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatttatcagaaagaggacaacccaagcctcatttcagagcaaagtctggtatacgcttggaaacctatgtgtctgtcacccccaagtacattaatgcattttctcaagagaatcaagggaaaatgatgcttcagaaagatgtcccgcatttatcctgtggcactcaaagtaccccaggttgagacgatatgaggaagattcaagctgtcaagttcagtttcccaagatctattccacagaagatgagcaaatctcacttcagaggccactgactgaagggcagtctggtcccagaaccgtggagaactcagaaaaaaatgttaaagtctctctggaaagtagaagcctgggaaaaaaccaaaccaaacccattctcccattgccacccagagatactgtgaacattttgagctcacaggggaagtgtaggcttttcccactgtcaatgtctatgttaagggagtaaggcagcctgaaacctcttgctcctaggtcccatagtctccactccccttccagctggaaatttgtgctgcaaccagaggaaccagaaatggggtgagaaaacttaggggactgggttgtaagatcaaaggctggtcttgcagcagtaatgacagttcctaggggcactgtgacatcattgcattccactcctcccaggggaggggaccacatcagcgcgatgcccgagtcgctgctccacgatgggggagggaaacacacggtttcgacccaggtcctcagagacgccagcccaagaagcctagggaggtcgagcttggggcagcaggaggggagggcagagtctgcagtagggagccccgggagtcaccagcccaaagccacccagggatgactggtgagggcagggcctggggctgggggacccaggtcctgggagacgcaagcccaaagagcccagggaggttgggcttggggtggcaggaggtgagagctgattatggagcagggagccccaggagtcacctgcccaaagtcaccctggggtgattggcaagggcagggactgggctgcttgctgaaggggtggggctgactgactaggctttggttgggggagcccagaggggctggggttggggggccccatctggtatgcctcaggagtggtatggactctggcacaggtcttgtcatcggaggggatctgtggctgggttgggggccatgacctggtgtgttttacctttttcttggctgcggccaatttcccctgttgtgttttttctgacatcgcggggtggggagggaggcggggttggggccacatcagcgaaataccagtgagcactgctcaatgcctccagtcacctaccaggcagctgtgcaactgagccacaggtggcgtaaccagggcaccaatggaacgcagaataggggcgtggccttaatgctccaagcccattggtcagtgagaaagatgaaagggaaaggaggcgtggccaggcagcagcatgtccagagggacctgtggcatcataaggaaagctgcccatgcaaccgctgtccccgcccactcagagaaaggggaggggccgcccactctgggagaggggaagggctgggttttgctttaaaacttttaaaactgtaaaaaataaactttaaaaaatatatgtgtatatactttatatatatgtgtgtctgtgtgtgtgtatctatgtgttcctccagagctgtcttcattatgcagcttctgtgcaaagtctgtgattttggcctatatttttcatcttcaaatggagtacaagaattaccagtattaccttaactgagatatagatcctataaaaatggaaaatccatagcatgcttgatgattaatgaagccgactatagtatccgacattccaataagacaaaataatcacaacaatttctcttttttggaaaaatgtttgtcttattctcctacattattgttaagatttcttttaaaaacaagaaacatgtctaatatctttaaaaacacaaagcttttgggccgggtgcggtggctcacgcctgtaatgccatcactttgggaggccgaggtgggtggattgcctgaggtcaggagttcgagaccagcctggccaacatgatgaaaccctgtctctactaaaaatacaaaaactagccaggcgtggttgcgggtgcctgtaatcccagctatttgggaggctgaggcaggagaatcacttgaacccaggagatggaggttgcagtgagccaagctcacgccactgcactccagcctgggcgacagagcaagactccatctcaaaagaaataaaataaaatacaaaataagtaagaacacaaagctttcaatttaataaccacttaaagctctttactggtttaagagaattacaaggcccatttttctagaatcacctggcctctctaagccttgcaaatgaagctgaatttctcacttgatacttggctctcacttgcagtcatgaaaaccaagaatttgttatgtcactgtgtattgcttgttacctgaaatccacactaggctgggatcaagggttgaatctttcatgattttctccataacctgtgtgcttcttatcccacaccaaactaagctttttttctagagctctgcaacttacagttagtatatgagagcagttctcaaaaatgtagtctctggactagcagctccagcagcacctgggaacttcttataaatacacatcctccggccccaccctggacctgatgaatcagaaactctggagtagggctcagcaatctgtgctgcagtaatccctccaggtgttcaagaacctctggcatacagcaggtagaaaaatgtgtttccttctgtaggtccaaaaccagggatactatatgttttctctatatgaaacaatgacgtgcaattaaaagacataaatctccttcctgctcccaccttccagccaatgtgttttatttttatgagttaaataagaaaacaatcagagattttgtctaaatcgcatatttacaggtatcagttctcatccagcctgatcttatccaatatcatttatattctcttacatgtgaagttttagagaaggatcttcacaatgtaagactcaggcacactagcagttctgtaataaaacaccaagtagatcagaatgtccaaacttactggagaagaaaagtggaatcattggctatattttcaaattgcaataaacaggatattaaagttttgaatttttttcaccttcatccttccacgttaatagaattaagccaaaatacttgtcttccaaagcctctagccaggcaaaattttactatattacttcttgcttttcaatggctataaagcagactcctggtaggcacatttggtatacctgcaaagatgaagaactaaacagttccatctgttcaatactgaaacaaaagtcctgcaaacctcggatggtgagtgtaatacttcagcactagcaccaaagcctcaaatatgaaaagataccaagaacaccactagcaaacaaaactaaactctcggctgggagctctagttcatgccgtaatcccagcactttggcaagcaaaggtgggaggattacttgaagtcaggaattcaagaccagccttggcagcatagtgaattcacacctctacagaaagtttttaaaattagctgggtgtggcagcacacttcctggggcagatgtgccattgctggaaacttctctatggagagtaccaagtacttctacctgtagcattttccctggctggaatcctgcaattatcacagtagcccgagatccaagaaggcagagcaggagcatcctgtcccctccccagcaggtgcaagggaggctggggggtgaggcacaagcccgtgggagggtgaggagcaggagggatgcatggtgagcctctgttgactgcttgctgcctcagctggaaggtcaggaccaaatgtctattacaggttaaattacagaagtatttcagattttggatttttttcagattttggaattcgaaaatctgaaatccaaaatgctccaatgagcatttcctttgaatctggccttcgaacatcatgtcggcactcaaacagttttggattttgaagcatttcagattttggattttcggatgagggatgctgtattatcttctgaatgaggccactcattcaggaaagcccagagcttggggacgtggagctgcagaccaaagaggtgatttctgtagtggctttcagtgcggaagggcctacaaagtggtttaaagcaagccacaaaataggaaacccaatatttagctaatggaactctgataaaacctgctcaagatgtctgtctctactaattcagatggagccaagccaaagcatcattattattttaaaaaggcaccaatccctctgcaaaagcactgaattatatcatgatacaatcatcaattgtaccatgaatcaccatcagcggtggtcttttagggatatgaagaaggggttttcacaatacatcgcatgacacaccatcttccaaatctctaaacatttctctccacagcccagtcctctccatagttgtccaaatccctccctcttttctcttgttgtctccaaaactcaaaaccatgctctgactttctatatcccgccctccccttcttggaccatctgggaagccccctgcttccccagggtgtcccctcctccccttctgggatcagtcatctttcctcaaatggaccagttcggcctctcttagtttctccaactctgcatctcaacctttctcccttcactacacaataatgtccaggaggcaaagagcccacaaacctgggaacctccctttccagaagggaggttctggaatgactacaaatatttggttatgattttcttccctgccacgcctgttttcatgggcagtgctgagccccggtcctggcagagctcagaaccaggctctcatgagctggggcaagtggggcctagggaacctctgggttgaggaccttgcaccccactctgcagctgccctgctgatttggctcatgcaacctctcctcctgggctcaagcgatccttctacatcggtctcccaagtagctgggatttgggctaccacgtttggctaatttttgtatcttttagtacagatgggggtttcacctgtagcccaggctggtctcgaatcctgggctctagtgatctaccctcctcagcctcccaaagtgctgggattacaggtgtgagccactgcgcccggccttgtgccagcttttaaatatcaacaaggacaaattagagaacagtggaagagggtgagcagcatgatgaggtgatacagaaataatttcacatgaagaactgggcatgcctggcttttttttttttttaagctattctgggttggatgctgaggctcacacctgtacgcctgtaatcccagcactttgggaggccgaggtgggtggatcacctgaagtcaggagtttgagaccagcctggccaacatggtgaaaccctgtctctactaaaaatacaaaaaattagctggaattggtggcatgtgcctgtaattccagctactcgggcagctgaggcaggagaatcgcttgaacctgggaggcggaggttgcagtgagctgatatcgtgccattgcactccagcctgggcaacaagagtgaaactctgcctcaaaaaaaaaaaaaaaaagaaagaaagaaaagaaaatatatctatgcaccagagctcaacactaggttaggagcatttctgagatttggagctattcaaccatggaagttcctggcacatacatcaggtattcacaataccctttctcaggtgtttggtcactgctagtgagcctgcctggatcagtgtttcccaaatggcagtcatttgcatctttgcattttttttggggggggggttgtgggggtatataccataccagattttttaaaaattcacattaaaaatacatgtataaaatgtgtaaagtgcactaatctaaagtgcactggatgtattttttattgatgtacatacttttgttatccatcacccaggtcaaaatacagaatcagcaccacagagggttccctcctcctccttcccagccaataatcttctcctcctacctaaccaactgttcttacttcaatcactgtcaactagtattttacattcttgaactgcatataaagtgtctcaagtttcacttaacacttttcttgaaatacacttgttttttgccactttttatttgacctaagaagtaacattaatgaaacaatgatttgacgtgataggcatttccctcctaatgagcactaaaacacttaactatttgaaaaaagaagtttctccgtgtaccagctaatatattctcctcggccgccgttggtacacggaccacattttgtttctcaaagcaatccgatgatttctgaggtcctttgcagcttgaacacggaacgactgtggtgatcgagtagccaaaagttcacggaatgcactgtcacaattgtgattccgccatagcgccgtgcatccatccaacacttgtttaatacctatatttaatacctaataccttagactgtcctaggctgtggacacagaagactaaaccccacttcctgagttgaagtgggggaaatagaggagtaaatcatttcacgatgtgtggttaaatgctacagctcaggtaaccacgagcacacagagaaagggcagtttctagaaacagggcggagaggagaccgtgagtgggcatttcccagagcagtctctgccagccaccctgctgtgatcactttgccacagagcagccccggcggtcaacctcagcctcccttagcaacctgagcgccccgcccaggtgccttactattggtctcgtggagcgggatgggcagctctgccgtgcaatcccagctcgcagcccttgccccgcgtgtactcacgggaggactcgcagacgttactgccctcttgcgtgccccggccacccccgggcggcttgtagccggtgcgcggggtggctggggctacgtgcagagctgtcgcggagccggaacagcagcggtgaagcccctcggctcggccgagaccgccgtgcccattgctcgcctcggttgccgccgctttagccgcagccgctgctgccgccgccgggggagaggcagcctattgtctttctccgcggcgaaggtgaggagctgtctcggctcggcccgcgggggagccccgggagccgcacggtgagagcgcaacttagttggcggagttgggggaagttttgtgatttgaggaggggtcggggtgcggagcgcggcccgtcccctgcggccgctcggtggggcgggccccagaggagggtcgggggctgcgcggggcttcaggggcgggcggcacggatgggtagccgggcggcgcggggacctcagctttgcggacccctcctccctgcgcatcacccttctcccgcattgtctgcttggggctcggcgcgcctcccactccgcagcccaacttgggggccgtcgccgctttccggatggggggcgcgcccggcggcggatggccccgaacccttgccccgggtccccgggttggcgccgctggggcggactcactcctcccctggggcgggcggccgcggtgtggagtccgcgccgcgaacaagtgctgcgggcgcgagggagcggttccccggggccgacgcggacggtaaacctgtccggcggcgcccgcctgctggggcctctccgctgtttctcgcgggcgcggcccggctgaaactgcgaccgtcggaggcgagcggccctctgggacccgtgcagccggtccaccttgcagctatactttgagactaaacattttttttttttttttttgcaaaggcaaaccggtatgtgaagttgaaaaaagcaaaaaccctcaaattttccttctttcttcttcttttttttttttaaatcaagaaagggggtagataggtttgttttgttttggaaatagtttttatagcagagtgataccgtcacatttaatgatcctactgtgaattcaggaattcacgatgaaagttggattgagcggtattttggtgttcattctttgctgatactcattaatgaagttagttggagaatttattgcttcagtacagtaaaaaccagtgtgcctttttttttgttactactcccccctccccgcattgttttatttttcgaagaagcactttattcagtttttctaagccacgggattgcccagatgaggaccaacggtgcagttcttgaaaggtcattattggcaagtttgtgagggagctaagatgagttgagataaaccagtgttactgttcttgtattctgtcgtggactcttggggatttgcaggctgcattaagtacaagtctggtccagttttgggtgcacgtattccactgaatttggttcgtctggcttattatatgaacatgattctgtttcacttccccagatggaactagcttaaatgtctatcatttatagtgacaaatgatcaaaatggctagagtgtcatttattaacttcagttgtagtcctttaccttaccttctgctaaatgaaaaagaaaaatttgacaaatactgtgtgcgtcagtttgctctgagtgatttctcgtgctaagtgagtcctgtggagaagcgttcctgggcttttctggtttggtgggccttgtgttataaaaccaattttcttcacctgatgaagctaaagacaaattttcttcaggcacaggcattgcccttttaaactacagagccacttgtaggattcacaatactcactcaatggcttcccttcctggcagtgtggttttgtgtgtgtgtgtgattgtggggaaggaggctgacagaggttggaagggattgtcagggagggacatcatgtaagcaagtactaacaacataacgtgacgagggcaccagttgctttccttctgtgggcggtgatggcatgttatactgtaggtactattgttgtaggatttctcacagttcgtttgccttgactaaatggtaactgcacacatactatactataaatggactcctcctctagtcctttaactccttgagggctgtgatagaccttatttaactttgtaccctctttgccagtggttttaacatagtgcaggcccggtatgtgtttgaattgggtaaattacttttactgcctagtggtagctggtgtacacaggagagggccaccaactctggggacttgtccaaaatgacaattcacttgcagatctctgatgaaatttactttaaaaggacttctaaccttttttttaatctgtcggttattttttgaaaagaagtggggcttaactagtgctctaaggattttaacaagagattccgatttagaaatctgttcccccttttggtgaaattattattttttttagagtcagaatcttcactgttgcccagttgtctccccgggacccaagccgtcctcccacctcagcctcccacagtactggaattacaggcgtgagccaccccacccagctggtgaaattattaaaattgtagtgaaaactctgcctccattgtgaaattggaaaaaaattagaaattttagaaaaaagtacgccctttggagctaggtagagttcagatccccacatttccattgagtagttgcatagcctctcagagcttcagcttcctactccttaagggttagtaacatgctttgcagtgttgttaggaatcagtgaaactgtgtgagatacttaactgcagtatctaacatggagtaggtagctatttcctggtagctgtaatgataataattttgatacgtttttacatgacttaagcattctgaaaagtctgatgcttctgagtatggaggcttagctatttctttcataaagaaggggccctgagacttgtgagtcttatccaaatgcgtttcttcaaaggtgtcagatgaactgaaggataatggaaacaatagcaaatttatcttctcagtcacctgtgagtcttcctttgagagtgggacttgcagagtacttggtagggtagagctctttgtgactatgctatttaggaaatggtgagagatggattgttttcagtacatcagtcataagaggatatgagtgagttccaactttccttattttaccttagtcttgacaaataacaagtatggattatgtctgtatttctcagacttgtttaaggtagaactggactgggtgttaacagtgttagttcagcagagacatgagcaaatcactcacttccccttcaagataacactttaaaggtgccaccatttgcagaagaaagcagtgatttaaagcagctatactagcacagtttagaatacttacactagctgatggagtagatacattctagaaatatttacctgtagtgggagttgaacagtgagaacacatggacacagggagtggggaacatcacacactggggcctgttgggggttggggggctaggggagggatagcattaggagaaatacctagtgtagatgacgagttgatgggtgcagcaaaccaccatggcacgtgtgtacctatgcaacaaacctgcacgttctgcacatataccccagaacttaaagtataataataagaaagaaaaataaatatttacctgttaaggacatttctgtgtattttattccatctttccaatagttttcttatgaagagattatagttaacctttgaacttaacagattgagagggtaaacctttaaaaaatatatttggtcacacttacagactgagggtaaaaacattcctgacaaagctaggcgaagacacttggacttttttttttttttgagacggagtctcgctctgtcacccaggctggagtgcagtagcacgatcttggctcactgcaacctctgcttccccggttgaagcgaatcttctgcctctcccgagtagctgggactacaggcacacgccaccatgcctgactaatttttgtatttttagtagagacggggtttcaccatattgaccaggctggtcttgaactcctgacctcgtgatccacccacctcagcctcctaaagtgctgggattacaggcatgagccactgcacccggctgaaacttggacttttgatgtttccttcttttaaagttaacatctagcacttgaatagacttggttattactgatggggacaggcatccatttggaagtagcttccctctctctctctttcccaggttaggctgtcttattgctgtaaatggggagagaagagaaagccgtgggtggaagaaagtgtttcatggcctggtgcggtggctcatgcctgtaatcccagcactttgggaggccgaggcgggtggatcacttgagttcaggagttcaagaccagcctggccaacatggtgaaaccccgtttctactaaaaacagaaaaattagctgggcatggtggcgggcacctgtaatcccagctacttgggaggctgaggcaggagaatcacttgaacccaggagatggaggttgcagtgagccgagattgcaccacttcactccagcctggtcgacagagcgagaccttgtctcaaaaaaaaaaaaaaaaaaaaaaaaaagtgtcccactcagttgcccaggctgaaacgcagtggcaggatcactgctcactgcagccttgaaccaagcgattatcccacctcagcctcccaagtagctgggatcacatgcatgcaccgccatgcctggctaatttttttatttttgtagagacagggtctctctgtgttgcccagcctggtctcaaactccctggatgaagcaatcctcccaccatggtctcccaaagtgtagggcttacaggcgtgagagccaccatgcccagcctgctggggtttttgattgacattgcattgaagctggaaatcagttaggaggcaactgacattttaataatgagccatgaacatggtatatctatgtatttagaccttagatttttcgtcagtgttttgtagtttttagcaattggatcttgcttgcattttgtaatcttacacatttatttcatgtttgtggtactgttgtgaatgatacttctcaatttccagttggtgattgctagtatataggaagatgattttatgttatatgctgaccttggattctacaaccttgctaaactcatttttagtactagaagcttttttgtagatttttggaattttgtgcatagacagcaatgtcactggcaaataagggcagtttaatttctttgttttcactttgtatacttttatttccttttttttttttttgagacggagtttctctcttgttgcccaggctggagtgcaatggcgtgatctaggctcgctgcaacctctgcctcctgggttcaagcgattctcgtgcttcaccctccccagtagttggcattacaggcgcccgccaccacgcctggctaatttttgtatttttagtagaaatagggtttcaccatgttggccaggatggtctcaaactcctgacctcaggtgatctccctgcctcggcctcccaaaatgctgggattataggtgtgagccaccgcttccggcctaagaggacacagtttctttggcttattaagaggtatttggttagtgttagaccgggggttggtacattatagcttgctgactggatgtaccatgctgcctctttttataaatgaagttttattggaacacagccacacccattcatttacatattgtttaacagagaccatatgacctacagaccctaaaatatttaccactttgcgcttcgcaggcattttgctggctactgctgtggacaccaattttaatttaggtagataaacttttttgtagcttctgaggttttgcattaatttgctcaggcatataggttggtggaagtgctttctgttccttctcccaaaccaatcacacagccatataacttcatgcctgagtttctgtgtggtcctctatagtgagtgagtttttacatacttctttgcagcagcatgaatttcaaaaatctcaacgcttttgctcttgctaatctttgtaaactttgtacacccagtgctggtacattctgatgatagtgcccacactgcactctatgaagaaaagactgatgattgtttatattaaaatgcaggaagagaattgtagcggcaacttttgcttctctaatcagcagcatcataagagacttactatgtgtgggcaatgggggaaaacgttaatttatacattgagatagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatggagaacactttaaaaataataacaaacattattataaactaatatatgtgagagtacttagttgaaacaaaaaggagttttagtagacagtattatactacatttgaaaatcaaggagcagtttatgcaacgtaaaatgtttacaaactgcagcgcaatctactgtttgtgactgtcaaagtgtcatgaggaaagtgtctatacaatcacagagttatatttcctcacaaagttctttacgaagagtgaaatatgtttttatacctctcagtttcagttagaggcatattttgtgtaatatttatggcttaaaatggactaaaggtcctgttcttgccttgtctgaacttgccgcttttgcattctttgagttcagtttaaagacacttactttaactccattttaaaccctcgggctagaaatcgtaccactgttaattagccacgttatttggtctaacagtttttgtttatcattctgaaactgagcttatctaatacattgataaattatttcaaaggtatttttatagttcaaatcgcttcacttttaccctgacacgtataaatgactaggaatgaccttcagatagcgtttagcaactgtaaccaatctgacaataatgtgttcatcaggtacctgtggattaaatcacatactggcatatttaagctgaatgtcagtctgaaaaataaatgtactatattaattcaaatacgactctttgtgtaggtattttgtcatatgtttaagaaaaagctaaagagaatggaaatcctatgacaataactcaagtctttcttcaaagtgcatgcagtcttttgcagtacctcattcagccaagtatttgttctctacctcattcagtataaggcagcctttaatttgcttagaaggcaacattagaaggttagagttcagcaggaacatagaattttaaaatgtgacttcaactgaataaatttgaatttctgtagggagtaaagaatcaaaacacctatttaaagactgcaaaatatgataattatttttaaagtaattgattaaacctggtaggttttcccaaaatgaaaaacaatcagttctaaaaccaaagctgatttttagaaaatgtgaaaatgtaaatcaaccctatccataatagattctctaaaactttatcttacagtcactttcaaataactattcaaaaatgtaactgctatattaacgtcttaaaataatttaaaacattttaaaatatgaatactgtagtttaaaacaaagaatctaggggaaggaaaagtagacaaagaaatgccaattccagtccaaagctgtatttgccaagttttcttagaatgacttttaccgatttatgaattcttatacacagaatgcataatggaaatactgatttttgtctaaagtggcattattgactgctgctgtgatgctactgtaatgtaatacattattaaattgtttcaaggtgctgttttgcctaaaaattttgtgtgtcttgaaaactatagtattgggtattgagactctgcaaattctcggcatgcttggcatgaggtaatcggtttttattcttacaaaattgtaactatgtaagtgtgtttattaaaagaacacaaactaaaaaagttaacaggaattaaagttgtgggatgaaaaagttacaggataaaaaaatactgtggaaaagtggcaaaaaaaagttgtggaaaaaaagtaaaaaaaaagttttatgaaaagttattttaaaaagttatgaaaaattagttacaggatttaaaaaaagtcatgggataaaaataaaaataaataaaagcaggcccctgtcagcataagcctggagaagtgggtctggagtcttcacccccaccatgtccctacaacccctccccagtcagccctttaccattagggtagcaagacaagacccctgtctaatggagggagacaaacagaccctttaccaccttgaccaaggctgagtccttacatttctggatgatgatgtttgttatttaagagccagaggttggtggagttggtttgtttggaggaggtctgacggccttcttactctcaccaaagcaacttttccctcaggggggctcccatcttcttactcagagaggcagctgaggcgggacagtggagttaactgtagaccaggccagggcacaggctgctgggggtggccccccttcccccgtgtacatactgtagctgtgtaacattctgtattgtacctagcggaggttgcagctggcatatgaggaagaggttcttataattattcgcggctgggaaacttattcattgttagcataggagcgatgatgggggtggggatggcgtcatggctccctggtgatgggaccccttttttgttttgttttgtttttttgtttttgttttggttcgcttttgattttggaataaatggatttagccatactgctcggcctggcatgttcgtgtttccctcactgggtcctgcagtttttcccactcaatgaggagccccagagtgtctcagcatgtccagctgggctgtggggaatcttccaggcctgttacctgtatgctgcctggtgatacctggtggatttcacgaggactgccatggcgcctctggagtatagtccggccctgagagccaacaggttgagaagcctgatctagctgtggtcaggaagacagataccagtgcccaagggcactgacttccatccaccccacgtgtcttccattccgtccccctgcctccctctcctgtctgcaccgggtggcctgtctgtccctccagagtgccggctgccccacaggctccttccaggctgagttcagggccctgtgccctactggccagagccggcttcacagaataagagccagctaagctccagggactttccaggaaaagtgtcccttgaaaagggtgtgaccttttcactgctgccaacagcaccctaaaaatggcttggcctcttccctcccctgagctccatagagaacacagccagcagaggacacattctctgtcattcagaaatgggtttctcagccgagggacagcaggactggtagagactgtcaggccacacagctgcctgcacagcaccgccatgcttggccagaagggcgggagggatggcgggggctggctgtccataggccgcgcatgtcccggaagctcactggaggtggtgcactttggaggggcgatgtcaggagacagcttcctcttgctgggctacaagactccacaagcacagcacggggactgattcccagtgctagaggcgaggcagtcgaccacatgtatatgtgtatatatatatatgtgtgtgtgtgtgtgagtttgtgtatgtgtatatatatgataatttatagctatttatagaacagggcaggggcataccacagagggggcacaagttttcagcaacggtcacacctggatgtgtcagctcaccactacaacagactaagtcacagaagaagggggctggctttggggctgggggagccactgtcaagtcacaggacacccacccaggcaggcttggaaagggaggtctctgagaagaggaggaatctgtttagaggtcgaagtggggcctggggctccccggatgggatggacttgcctgacccaatcagctggcagttggagagaaagcagagagaaaacgggttagagaaaagccagagctggtgaggcaagtgcagagtatgggtgcgctgcagcagctgtggagggccggggaggggagggcgtaggtgtgggcatggcaaggttcctggaaaagaggggctggaagggaaaggggagggagatggagggagaagccagagcttcataggtagtgcctggggactgcggcggccctccccaccccacacacgctggcctctttcatggcacccaggcagtccacccatagttcagacgaatgctcagccccctcgggcttctctcttctctggtcaccctgtcttccaactcacggcccagggccacctcttgcttggggagccccacccaacagccaccaggcctgatagaaagggaacactgcttgaaccaaaaatggtgaagctataagggatggatgactggagtgagtgccagaggcccctctgggtggtccaaaatcccagggtcctctgaagggaccctggggaaggcagggagggcaggtagctggatgccactggccatagacttataagtctaagaggggagcctcaactggttggcgggcgtggggctgcaggttgcataggtgaggctgggcccttcctgctgggaaaagcagaagagggagagtccatggcaggagaggcaggtgggctcgctaggcggagctcagctgggccagcaggcactgtggtccccttggctgaatagcacaggcgacccctaggagcaacaggccaaggtgtgtgagcctgctggtcggcgatagtgattcagcgggggccagggaccctgccttcggtcacacactagcagctatggtggtacctgggagggagggaagggggctgtgtgtccccgcctggcctgtggagtgtggagtgtgttgtgggatgaccgtgtgtatgggactctcacctagataccactggattgccgacagatagatgaggtggggccctgactatcagccctgctttgcagtggatttggctctcagcactcccaggctgggagctggatacctgccctggcagcatgactgagactgcacgacaggtatggcatgcccaggatgatgttcctagggactggttcagtgtgtgggtcaggagcaagtcgacaggccctgctccttaccccttggaagggactgccaccaggggcagttctgactaaggcctgggaacccatgactcagagcgtgggtccccaggtcttgctgggccagcctggctgctgcagacagacaggaagcacgtctgacgctcctccaccctcggtcagcacagcggggctgggactcacgctagccttcccaggaacttgctttcctgcgtgaactctggcaggctgccctctctgtgcaaagccatagctggggcctgcttggggccctctccctctttcacctgctcagagtggcctggaacttggaggtgggcagtcggcgcctaggatgggcctgtgtcactagggcatgtgtccttgggccagttacttcctcttagggccttgggctcctcctctgagaatggggcgtgttggtgtgaaatgaggtgagcatgttgatttgaggagcagcaggacagacacctgcaggcagcccccctggccacattcccctccctcccttccaagtcctgggacagacgctcttcaccaaggggttcagcctctgatgctctttcttggtctcagtccctaaggagtaattttttttcttttcttttcttttctttgagacacagtctcctccctctgtcgcctaggctggagtgcaaaggcgtgatctcagttcactgcaacctctgcctcccaggttcaagcgattcttcttcctcagcctcccaagtagctgggattacaggtgcccaccactgcacccggctaatttttgtatttttagtagagatggggtttcaccacattggccaggctggtttcaaactcctgaccttaggtgatccgcccacctcagcctcccaaagtgctgggattacaggtgtgagccaccgcgcccagccaggagtgattttcagtggtgtcctctccatccccagcatacacccagccctgagtggctgcggctgccacatgcaggctccagggctacatttgcctttcgtccagggttgtcatacgctggagagtagaatgtgagaggtgacccctgtaggctgcagggtggcctctctgaaccttagtgtcccccacctgtagaaggggcgtaacaccttccagggggagggctgaggaggaaattgtcaacggctgagtctaaggctcacagccagaggccagggtcggatccagggctgggcctgggcctgggaggacagtgtccgccccttctccagcctcccgcccctggtcaggccaggaccctcttcaaagcaccttcatgcccatctgttccctgctgtgggcactactgtctggctccatgggactagattttatgggaggggaaggggctgtgggtaggcaggtgccaggtgctggaccatagatcagcatggtaggaacctgttgcttgggctggtggtgggaaaggggccaacccaaggcagtggcaattagcccagccctatctctgggcacagagatgaagggacacgtggggacacagtagggcaaaattggccagcctgctcttcccctctctgcccgctttttgcagaagagtcaacagatagaacagacagagccagggaggtgcccatgggggccccagtccccaccactccagggggcagtccctgcaagtgacaaggtgggctcaatccctgtggaacaggtctctgaggaccacagagtggggccccagggaaggctgggagcctgagctgaaggcaggcagcaagtaagggccaagctgtgcccctgcccagaagaccttcctgcccccagaaccccaccctctgcagacaggcctccctgggcagcagccccctggcttccgaggccttccgtgcctcaccagatgccatgctctcagggactcgtttgctacgctgccccctgcagatctgccccagaggagcaggtgaaaagccgcgcctgccgaggtgctgcagcggtggagttttgggcagaggggtcgggggaagagtttctcacttttaagattccccaaatccaagatgaagtcacactgtgctttagaatggtagatgctcatttatgtaaaatcataataaatgttacacaaactgttagaataaaaaaatacctttttcgagggggaggagctccccagcctgccgctgggtagtgagagggggttagcaccattagggcgtagggggcgggagctccgccacagcccgtggtgggcactgaggtctgtcggtcggtctgtgcatcctggcaccgtcagtggcgggtgacccgctgatggcctcgggagggggagccgtggctgggcggagagcacgagcggcagcactgggtgcggacggtgggcagctggcagcggcccagtaggcgcagtgtctcacagaacccgaaggacaggcggtcccgctcacagcctggagtggggggtcagagaggcatcagaaccagtggtttggggtatccagaacctggctccccaccccaaccacctcaaggaggctccagcagctccccaccaagcagagagccccagtttctggagcggctcccaaactggacttgcaggtctccaactgttggtgtctctgtcccacctactcacggccgaccccaggactcgagaacgggcgctgctgggctgaggtttctggaggaaaggtcctgagaccgcaccctgaccccctcacatgcctgttaaagagcctgcccagggcgacgccctgccatcccatctccatccttgctcacccctggtgttccccgacagatcctggcacagaactgcggtcccggggcctcctgccaacctgcagcggcctctgcccccgactcccgccaccgccccctgccccagtgcatctgtcctgccagacctccgtgaccacctccagccacaggggctgtacacagcctcgggttctgagtcacaggtcgcatctcccaggccagcctcccacttcccaggtgggccaggaagcctagagagagtgggccctacaggctgtcagcggaaaccagggactaagcccaggcccagtggggagggaggccggctgcaggctgtggttgtcagggctgaggcttggctgggccctcctgccccgtggttatcagagctattttgggaagtggcttgtctccagcctcctggccttgctcctgatgccactgccactgctgacagcccccacctgccgcctgggccctgcttactccagcagacctccctggggaggaagagcaggaggacagcagccagccctgtgccagggacatccctcaggcccggcagagggcacgaggcagcaggcaggctcctccaccccagctccaggcagagctccaaagtgcacatctgcaggcctgcatcctggtcgcccggggtgacctcagacaagctgcttcacctcttgggccttggttccctcctctgtcaaccccacctccacagcaaatggatgtggccatgctgtgtcactgcagcgaccgcacactctggagtttcctggctttcccccgtcccgccaactgtcccacagaccagcaaaacatcctgggaattccaggtctcaaagtccaagacaccttcccagctgcccctccactgttcactggtggcagaaaactcctcacttaggacagcttctagttcagccacctaaccagcccccatagcccactccctgcagcccattcatacccgcccctgggagaccttacaagcccagagcctcctgggccatctgtccttggttctaggcccccaggggcctcagttcctgttctctgctccatctggtcctcatcccctgggatcataaccaccccactccctgtggccagctctagccatgaaggcgagagatgtgatgccagcacccagctcaggcagcacacaggagtgctctgagatgctggctgggtgcgtgctgagggcaggcaggacagggtgggggcactgccacttggccttgaggtaatggggtttgtggcaggaaggccacccctgccagaggcagggtagcaaggcatggcagcgaggcatggcaggggccactctgagcccaaatgagggctgcccaggagccagcgcaggtagagaaggcgcattggataaggggagaaggcagactggggagactgcagggggccccgaatgccagtttgagggccgtggctgaggactctgtcctagggtcagggggcagacagccaatagcacaggggccgcagctcttcaggccacagctcctggattccttagactggcagggtcagccccaggccctctccctgaccttgcaatgggggatgacagtggctttgcgggaggggaaaaagccgccttccctgagcaccacctggatccccacgcagtgctgtgcccttcatgcccagacctcacttatgcaaggatggggcttggcagcccctttattcagcacatgaaggccctgagagggaaatggagcccaaggccacacagctggtgaggggagcccaggtgacactccagggccaccccatttcctgccctcagcactgctgagagcagctggggctgcaggaagtgtgtgagtgtgtgtgtgtgtgtgttggaggtggggggttgggatatccagaaccacctctagctcaggcccttccaccaggacccagctggccaggaaaccccccaccactgggattagcaggaccctggaagggaggcccttcctgtggttccattgctcactctaggcagtcctctggccagggaatggacaggctagggctggggaggggacagggactcacccaggcccagttttcacacagcttcagggacatccctggtctcactatgggaagactgagacccagaggggaaagagcttacccaggttcacacagcaaatcaggggccaaggccactccctctactcaccggaggtcagaaagctgcctgcgggatgttgtgtagctgggacttctcttgactgactcccagcacagccaagcctccagcatgggatcctgtggcatcaggattttcagtggctcctgagcccagactacagatggagccagccggtgccgtgggtgcaatggtttgaagacccaatttccccatcacccttcccgccccacctcacttcagcagagagcttggggtcgggggactcacggggaggctcgacgggctcacaatcctcggtgccacacagccgggagctcacaaggccaggcctcgtggccacactggtcactgtcttcctcgggtagccccgtctgggtgttgacacacttgaccagtgtgtgaccactggatgccaccaccacaggggcctgagcactggggggagcaggggaggaatgagtgtctccagggccagccctagcagtgggggcagggacacctcctctgggaagccgtccctgcgccctgtgcctgactggcctgcccttgctcccagccgccctctcagtgcctcctggaggacctgttcccattcctagagcccacttggtgctggaaccccactctcacttgtgggatcggctgctgcagagggaaggggcatgagaaccatgggacagcccttggggcggcagggcagtgagcccctcacacgggacatgactgagaggcctgggcaggggccccgggatggagccctgatgcagcagtgagcagagacgtgggcgagacaccgctgtgcccgagggacagggcagaggacctgccgcagcccatgggcaggaggggtggagacaatttcacagccggggcccagcccgccaggctttgttgttaacaggtgcaggtctgaaagccctaaacatgtgctgagtctgtgccagtgtcgtgctgtgcccggccctgtgctttgttgcgttcctccatttaatcctcctgaccctcctctcccaaagcgtcccaattttacagatgagaaaactgacccagcaaagcaaagcaacctgcccagagtcactcagcagccagtcggacagactcaaacgctggcccagctgactcccggacccagctcagggcccaaatctgagatttctgaacccctcagttccaaacaggcccagcagaaggtgtcctgcccatacgaggcccctcttctgcccccttctgccgctggcctttgctgggctccctgatctccccaagctcatcattcctgcctcagacttcacacctgctgtcccctcgatccctgtccttggcatcactgactcctccctcgggtctcaaccccagacccctcctcggaaggccttccctgacatcacagcacacatgccctttccttgtctgtttctccctgtcaggtgtgagcaccagcatggcagggctttgtccagtgactgctgcatgtgcaggggccacagacagcctggctcacagcacacactccacagctccttcacccaacccaggactgaccaggcgctaccaagcacttgctccctgctcccccccgcagcctggctcacctggccccagggccccaccacccactgtgtgcaggggtgggtgttgcagggccgggtggtgttgggtctcagtgcctcctcgcagaggtctggctctgggcaggtcaccagacgctgctgctcaccaccgccacaggcctcggagcactgggtgggcagggaaggagtcagggcacagccagggtctgagggtgtcccctccccccaactcaacgcccaggcctcacctccctccaggaagacatgtaccagctgaggcagggctgggccccgcagggccagtgcacaggcagcttggcaggtccaggctgacaatggaagggccacagtggccagagggcccatgtgtccacatgctgcatgtcccacactgaggaacctctgccacagctgtgggagcactggggaccgagagacttgtgtggacacatccccacgtgcaggcccacaggcgtgaccccgtgaggcgtgtggcaggaaaggcatcagacccacgccccagccgggggcaaatccctgaagagccccagcgagaggccaaggctggcaggccccaggcaaaaggtggcatggccaggggctgccatgggctgggacagacagagaaagggaggaacaagtccagatggggtcaaagatacagaggaaaggagacaggccaagccagacaaagatgagatgactcccaagagattcggaatccggtgcgatcaggcacatagacatgcagcctggagccctccccttccctgccgctctcggaacacaggccgtggggaaccagggctccaccccatgccctggggatgcctgtcctggctccatcctcatgcaccttactccagttgcctgagtgccaggtggcacagggccacaggtggcagcggcgggcaggctggggccggccagcggggtcgcagtcctcatcccggctggagctacagcacaccggcctccagagggcacccaggccacaggtggtggagcactgcggggcacagacccgtgaaagccaggcagagcccatcctcgccaggcctccacagccaggaaactacccacctaggctagcaagacctcagcaagacaggggccctcttctgggcctcagtttccttatttgcaaaataggctcctccacccacctcccaggaagaccatgagaatgaaaagtcaaatccccccagcaaccagccgtccctgctcacatgggacaaagggcctgtgtgccagtgtcattggtgcagaggttcgggggaggagaccctgtgggcacccctgaccagctatcctgaccagcctcgtcgcttcccagaggcaccagggaaggaaggctgggtcctggtaccagcagccaaatcgctgcctatccccgcgcaaaacaagccctgtgggcctcagcctgccccttcccaccccaaaattaggaatctgaacagaagcttgcttctcctgcagtgaccatctggggacccagggagggggcactagccagcttctttcatgcagctcagacgtctgcaggtcactgccaaaggagggtggagccactgagggcagagccaggtagcagtgggctgagtccagcctggaggagccagacagagcctcagggaagctgctgcctgctgggcaggactgggcctggtggccacacagggaccctccccactgcacagctgtctgagccagctccatcctggggcatgctgtgctgccagagtgtgcctgcccctgccttccctgaggccccctgtgctgcccaggaatgggccccaggtcccctcattcccctaatcctgggaacccccgccccaaggaaggcgagacagacggcgcctgcgtcccactctgctcattttcagatgaggaaatagtcaccaaggtcctgcgcaaactccctgcccgcccagcccacaccacttgcctcgctccagtttcccacttgtcagccggcgttcctgacaaccaacgggtccgtggggggccccgcttcagccaggctgggaggcagtggctgggtctcaggggctctgtggctgttggcggggctgtcccaagctggcatggacagcagcctagagctcaggggcacctcagggctgagggactcaggctgacccttgggtcctgggttcagggcaggctcaggcgtgtgcccgaggccagtcagggttgtggggaggaaggtcccccacactgccacagtctgcaggtcccatgagcctggtcctggggttgggaaggtggaagtccccggctgcaggggactgtccttgcccttcatctctggcaaaggggctatgggaggaggagggagagaagccaccctaacagtgggccacagttcactgtccacaggccccaggccaccctccagagctgactcccaggctactgtccctcctgtccacagctccgccacgtcaggactaggagaggagtgggtgctgctgaccgggtacaaagtgggcagcgtggggctgggtctcgggggcaggtggggtgctccgcagcccttgggtccctcatcatttgaaaacctcgttggtcctgtcctgccatggagagggcagctggctctggctgtccttgccaactgggaaatcattttggctctcaggggcggcaggcgtctgcaggccatcagtggaaaccctgggccagggcaggctggggagcccaagatctggggcccctatgggggtgtcttcctcaggcaggaaattgatcaaagggttcccaggggtctgctctgagggtgggggtggggagcggccggcctggctaggccaagggctcggggaccaaggtcccgttgccccttcctccttggctgcaggaggctctgtggcaggcacagggctacccgtggagggcgcagcaggacggctgtgtggtgggggcgtccgatcccctgtccccgccaggtctagatcaggctcctcagaaggcccgtaaggacagatcctcgtggaagctgatgaaattgtagtcgtagtagaagtcgtccacaaacacgggccccggcaggtccagctttggagcctcctcctcaatggcgttgcccatggtgcctggcttgggtgatgaggcgggtgaagggcgtggggccaggtggcgcgggatgaagtcagcctcgttgaagagctcgtggctggaggagccgctgcctgagccttcagggcccagtgtgtccaggggccaccaacagggtggcagagagcaggtgacttcgctggctggctgctgggcctcgtcacaggggacaccggtgtcactgatgcagaggacatttcggtgctgagtcccttcctcatatgtcactgagcactgcaggggaagccagggtgaggggcttagcctgggaggcaggctgccaggggacgctggggcaaggctgggtaacctgtccactgcctgatgtcagagtggcagagaccccagccagccctctctggcccttcccagctcaaggccatgactgtggccatgcttgccaggggcttcctgatccctgaggctttagagtcaggggctggaccctggaatgcccaggttccctcccacccacaaggtctccaggaaggctgtctgcctccctgtagctgaagaccaagggtggggctggaggcgggcaccttcccatcccacactcacctgagaccagttccccacagcctacgtggccggacagggcacatggtggttgcaaggggtttcagtagggggccggggaaggtgttcacaggcgggtggcttcagggcgctctgctcatccagccccacgctgcggatgcagagcacagcctggcaggagaggcccccaggcccgcaggagctggagcacagctgccactcacctgcccaccacctgctgagggcacacaggtgtcatcagtatggcatcagacaggtggcattgacaggctcaccagcagggagggccaggctgggtttccaggccctcggggtttgggcagtgccagaagccagtggatgattctccagagctccaagctcaggtaagtgtcctgccctcaaagtctggtgacaaggcacagcccctccactcctgccaccttcccctcagggaaactgagcatgacctgaggcctatttccacatccagggacccaaagaggaggaccataggtgtccaggctggcccaggctggggtgagaggtgaccgggggttggggcttcagccttgggaagagaatgaaagcccggctccctctgctcctccctggggcctctggggacccagatgtaggggcctgtggcagacccaggatgcctgggggtggggagttggtaggggatgggggcgggctcacctggcagggcagggctgctggctgcacttcctctggcagtcatcgggccggcccagggggtcacagtgctcctcgtccacgggccctgcctgccgctccgagcagtacacactctgcctctgcacacctaggggccatggcgttcagcctgggactggcacccaggtgcccaccgcccaagacccaaagacaccctctctgccagaaccctcccagaacagcgccttactgcccatgtcaggatgccttactgcccatgtcaggatgaaggcagacctccaccgtcgcctccttgctgtcctcctggttctcacccaccccctctcctatgtagcttcccctctgactgcccctggaggggtggcagagtgtggaggtttagtgggttgggtgcccagaccctctgcatcctagctgagatgcctgggcagctcatttggcctctctgaacctcagcgtcctcctctgtgaagtgggagcaacaatcctgcctcctccatgtcctggagggaggactgcatgtgttcttgcatgtgcaggctcagcccgtgcccggcacatcctaagagctcgatccatgccagctgctgctagcatgcaaacccagccgtggctcctgccaccttcccctcagggaaactgaatgtgacctgaggcctatttccacatccagggacccaaagaggaggaccataagtgtccagggtggcccaggctggagtgaggggtgaccggggtctggggcttcagccttgggaagagaatgaaagaccagctccctctgctccttcctgggattggcttgggtgatgaggcgggtgaagggcatggggccaggtggcgcaggatgaagtcagcctcactgaagagctcatggctagaggagccgctgcctgagccttcagggcccagtgtgtccagggaccactgacacacggtcccaccatccacacccttcccaatggatcagagaatgtctggacaagaaatggggcatcaatggacagcccctgctctccatccccacaccagccttggcactgctccagtcctttacattctctgccactgtccaacctggggactttgcacagccacgttcctcaccttggacactcacttccatactgcctgttgaggcccagctgcaggaccccgtctgctggtggctctgccttctctgctccaccccctgccccgtggtcccgagagtaagttgtccctcccctgagctgccagtcccacatccatccccctctttcctcaccaacagagtctgattttgttcaaggcagcagtgggacctgctgaaaacacaccccactgccgctcccttgcaactaggggggtctgggacacagtcctggctcaggagaaaaaggcacaagtccctcgctgggagtcagccctttcctctctccttcttgcctagaacactgcaagagccctggaagggaggacaccatctgtggcaagcaggagtggaggggaggctgctatggcaaggatggtgtggctgagggccagtcagctccaggtcccgccagcttggactgtgcacctgggacttcctgcctgagacaaagaacccctgtctcttccagccaccacagggcacttgcctctgcagacgctcctaagtggtccacctgcgaagcagccaatttgctgaaaggcaattccccaaatgtctagtgctgcaaatgtatttgttggttttcacgtttgtccaattaaagacacctgtattaggccaggcacagtggctcacgcctgtaatcccagcactatgggaggccaaggcgggcgaatcacctgaggtcagcagttcaagaccagcctggccaacatggtgaaaccccatctctaccactaataaaaaattagccaggcatggtggtgcgtgcctgtaaatcccagctactcgggaggctgaggaaggagaattgctggaacctgggaggcggaggctgcagtgagccaagatcgcgccactgcactccagcctgggcgacagagtgagactccatctcaaataaaataaaataaaacaaaataaaataaaataaagacagctgtattagataaaatgggtttcctagctttggaaggtaactgcccagttctccattttcactttgtcatcataatagcatttgaaggaatgctcaaacgtctgtatatcagattcccgattctgagaccctgaggatactgagtgtcaacgatgggaagactgagggggaaaggggaggactaagagacaaagggggagactgaggtgtggggagatcgaggaacagcagggcagaccgagcagggggaggaagaccaaggggcgtcgggggggactggggggctggggggagaccaaggaatggcgggggagaccgagccgggggaggaagactgaggggcgtggcgggggtactggagggccggagggaaactgagggatattggggggagaccgaggggtatgggggcagaccgaggggtatggggggagaccgaggggtatggggggagactgagaggcatggggggagactgaggagtatgggaggagacggaggggcagaggggagactgaggagcagtggggaggagacaaagagacagagaggggagactgaggagcatggggggagactgagggaaatatggggaggaagagtcggagttaatgaaattgccctacttttcataaatagttcagggaaataagtcagtgtggtgaggggcctgggctggtctccgggacgcagcagaaatgcaggcacaaaacctgccggagctgagcaaggacaaaatcaagggggagctgtgtccactggagggagaacgccaagagctgcagcacactgagcacacgccgcgagccagcacccacctgcctcatccatttaccctcccagtgggcctgggacatggggcggttgctagcctcatctcacagatggggaactgaggctcagagaagcaaacttctaaacccatggtggcccagcagtgagctgggagctgaagccggtgtccctgtccagagatgaagcccctgctggcggggctgtgcctgccccacttctcacctctgccacaggtgactgtacacttggtccagggcccacagtgccaggagaactcgggcggcgggacctcgccgtggccacctgcctccctgtggatggtgtactcgtagtgcaccccagggttgctctcctggaacagcagctgggtgggcaggcgggggcccgtgagcacgaggtgtcttctccatccacccagtcttaaaggagctgaccccagccacctctgtgaactgcagctacacagttgggccatcttaaagatggggaaaccgaggtagaggcctcagcaggagggtctggctcagagccaggctctgtgactaacccagggctcactcctccaggacgagacctaccatgggaggtgctgggcctggggactccgcctctgctccccacgcctgggcctcgggaggcaggcacctggatccagacaggctccttggtgggacccggggacgtgaggttctcccagttgcccctgcgtgcgtatgtgacggtggtccctgccacctggtagtccccgttctactggatggtccagccaccattgaggaagtacttctccgggtcctcgctctgcagtgccaggaagttggcagcctcagccacctcctggatgcggacctcacgtgtgctggctgggatcagccccacgtccacataccctgtcaggcaagggttgtgcctggggtgagaagcttgcttatccccacctgctcccctcacatctctccccacttgcctccgcctgctgatgccaaagatttcgccattagctttaaagtctgagctccccaaattgctcggatctgtcatgggtcaccaaaaccttgcggaggtgccacaaatcctgaccccgtggccatgccccgtcactcctctcttggggacctaaactggtctcatcataaggctggatccatcccctactctaagggccggctggcattctctttctaaaaaaaaccaaagtgcccaggcctttctcctgggacaccctcctcatccccacgcagcctgcttttattcattcacttccatcacacccatcacgtgccgggcactactctcagcacttcacatgtgtaagctcatgggtaatggccctatagcatggtactattgttaaccccattttacagatgagcaaagtgaggcagacagggagagtaacgtgcatgagcgtcctgctgcaatataagcagcctccagggccagtgctttatccaccacactgcactgcatctctgggatgaaatctaagcttctcagcctggcactcaaggccccatagctggccctgccttcccttcttgcctccagggctctggcgcaagctctttcctccatttggaatgcccattccatctcttctgagttttatgattcagctcaacttccgcctcctgcaggaaaccttccctgacttccccaggccaggaccttcttcttcagtgctcccacagccctctgggcctccctccactgcactgatcacaccagaaggttctgtcccccttcaggactgagcgcttcacctgcatgtcctcatcacctagcacacagtcagtacttcagcaacatgtgcaaaacagaccagaggtgagggcatggagctgggggtctcagaagattcaggaggagacgaccattctttgaaaggcccaggggccacacacaagtcggggtggccctgcctggggtctctgggacaggaagactccccatggggacaggtctctgcgtgtgggccaggggtcccctgactcctgcaagaatccaccccagcaagccctccctgcttagccatctctaggctgggtgggggccacgaggccaaggacaggggcccgggggagatggggaaggggccaccaggtgaagagcacacccctccccacagtggtcccaccccatacccaggccctcggcctcctcgaaggtcccactcacggtgtggcaggtggagccgttgccgtggcacacgccacagcggtcctccatagtgccagagtcaatctcaaagtcacagccccacgttctgcaacacacgaggaggggaggcccctggtgctggcggccagccctctgtggccccagccccgggggccagccagggtcaggagaagaaagctgggagtgggggtcgggaggcctctctctggccctgccccaccccagctgtgcctctgacccaggtgaacttctctacctccctgagcctcagtttcctcagatgtgagacagggagacccacccctcccttaaaggcatgtcatgagcatcacaagagacaagagaagggaagagttctgcaaagcctgcgggcaggcaggggatctgacacgccacgggctcctgagcagcgcgtgcagggaatttcaacgtcaaaggcactgggggttggcacctccctcctggtcctcctcggagcccaggccttgataccccagtggtttagagggcaagaagcaaggacaagtaggtggctggagacatgggtaaagaggagaggccatcgttgttattaaaaataagaatataaattgttaccaaacactgaggcctactcttcggggctcagagcccttcatgtcacctgtgccacctcatttaacccctctatcagggagcaaaccactgcctggggtcagccagccagcaagaggtcaagccactgcctggggtcagccagccagcaagaggtcaagccactgcctgggctccggtttcctggctggggcggtgctggtgcaggcatccaaggagacgcagtggggcgaggcctgactggggggggtccccagtgccaggaggcgtggtaggggctttgccttagaggtcatagagggtaggggctgggaagcccaatggtagagcatggggagggtggcccgaggaggaccaggagagaacctggggcccgccagtggggctgggggcaggcagtgctgggagagcctcttcctaaccaggcacaccttacagatgccattgatgcagaggtcccggctggctcggacctggtagcagggggtgccatcaaccacggcgtcccgcagcttcttggcaaagtactcattcgcgggccggcagtgcagctcacaggggttcactgggggcccaagtagaagagtcatcagcaacagctggagcgggagtatggaggccaccaggaagacccctccgtgacacacatccatggcaggctggaggctcccaagcagcacaaacatgctggaggctccggctgggctggtagctatctgcaaggctgcagattggggagctaggggcgagcagcagccccaggggacagtgggagtggcccaggcttggggtggagactgggtctcctgcttgcatcacagggtaaccttggacccacaccccgctcgccgccctctgagtctcaatgtttccatgggaggcagcactcaccgtcattgaccatgggcacccatgtgtgcagctggccctcgtagagcatagcgtcaaagtggctgcactggacgtggcggaaggaggggcggccagcggggcaggcctgcaggttgcagaggcggaagcgcttccgcttacccacacagtatctgcctttgtatctgggcctgtggggagaaccggggtggaccccagtgagggcccagtgagtgctactgcatggccacagcccagagcaagcagcttcctcctgcacccacaccccaagatccctgctgcccagctttgtgcacgctgcttccctcccttgggttgcccaccctgtggcccagacacaccctccctgtctgtagggacctgtggggaggtggcagcaggaagcctgagctctgcccccaacctgctgtgtgatcgtggacaagtcttcggccaccctctgggcctcagtttcctcatgtataaagtggggttggggctgcccctgcagagggctgttgagaagctgggacaagctgcaggcatgactggcactggctggagggactaatccgagtctccagcccatgacaccagcatcctaacgagcccttgagtcctcagccttcctcctggtggcagtacccccagcctgggtctaaaggaagcgcccagggccccagccagctgaaaggtatgatggagcacagctcctgaaatcctccacatttaggccagggtcgctggcctccactcagctcagacctggaggccaggaggcagggaggggcacaggccagtcttgggtaagcgcagggccctgggtggggccgactgtgaaccccatgcctgccccgggtggcctcctgaagtgaagatcagccgggtagtgcctcggtctacagtaccactggcctctgcttctcaccagatcttcacaccccctgcgcccccccatttagatggggaaacagagatccagagaggtgaagtcactcacctcaggccaccccttcagtgctgtcccatcctcccagctgctccatctcatctcaggcccttgttgtgcctctgaggccaccaagcccctcctgctgagtgcccactacagatgagctgcagggctgaggggctggcctgcataaactgcatttgcccctgactacaactttactggatgggcactgctattatacaggtggggaaacggaggcccagagaaggggtgaagaggggattcgaaccctgagccatctaaggtccagggcccatgctcttccccactgccctctcctgcctccttccagccagcagctgctttgccacgtggcctctgctgagtctctccagtctctgggcctcagtgtccccctttctgcaaaggggtcagcagtggggaccctgtcagccctcagaacactccttgaaagtgactcaaggtggcctggacactcagactgaccattatgaggacacttctaagagccaggggctggcacagagccaagctcctgcaatcggctgactgcctgggtccctctgtcccattgcccagggcaccctgggccccacactcacataggctgcatgcactgctgcttggctctctgtatgcccacgccacagctccgtgagcagatggaccaggcgctccagccagaccagccaccatccatggcctcgggctggaagcccacaggtatgcactccccattgagacaccactaccgagacagacggaggtagagccaccccacccccaagcctatcagtcatcctcaccctagtgagaacaaggtgtgtgagaatgctgcaaaaggcacagaggggaaggatggaaggtgagagaggccccctcgcaatcatcacaatcatctgtgacccaggccacatggaggcgctgagcagggagtaaaacagcccacgtgctgactcagctgaagacaccctggagaatcatggaatcaagccctggccccaatgcctccactttgcagacgggggcttgggctgcagagggcatggggctctctgtgagccggggctgactccagggcccggtcacagcaggaggtctggcctctcacacatccactgccgggactgggaacatcgcctaccttattctccccacaccggatgccgtccacggctgcatccagcttggagtgacaggtggtccccacagagcaccagagtgtgtggcagacattctgcgaggaggagggcatgggccatagcctcaccccctccccagtgccgccacccaccctgcccccctccctgtccccaagggtccctgggcacccctccacatggcaggggcccacagacccccagaggtcccttcttgtgtgtctgctcccaccttcctccccagaccacgtggtggtgtggggcgcccggggctgcactgctcagagtggtcctcagctgtccacacctctcccggcccagcgcctcctctggaaacactcctgttagaagatcacttcaggcgatcttcgccaggataaatagaccctccccacaggggttccttttccctcttatgagccagctccagagaggcgaagggacttgcccgaggggtcacagtcggtccatggttgacccagaattcagagctgggtctgtggccgcccatccctggcctctcccacaggccacttgacgtctcacagtgtcactcaggggcgtagcccagcccaggcgaggttgctcccaagctggcatccacaggctggtgaaagctgtcccctaagccctcctgtcgggtccccacacccccacacccacaccggccccactcacatccatgtcctcgcagaaggcagagtaggccccatactggaggtggcactggtggctcacatcatagaggaccccaggcagcactgatgggaagtcaatgatgtccttggcaggcgggtcatccaggcacaggctccacccatggctagagatgggacgggaggatggaggggggcgcagcctgtgagacccatcggagaagcctcggtggggccaggagaggaggagaggtgggagggggcacagagccctacaactgtaggaaactccagcctccccgctcggctcagccgatcctccacctgcagccagtagcacaggccctcccagccaatctcatctcacctcctgggcactccagctggctaaacaaccccaaccccaatcccaggcctctgcacacgctgccagggcccttccctcagaaggcctcctggaccgccaaaccctcatgtggccctgctctccgaccctgcagcctccgtgtctgagcccagaccctggagccaggcccgacaaggatccggagaatatcacatcacagttgacacaacagagcctccgacggccccacccaggcagagacctcgggtcatctgtggaagggcaaggtctggaaagcagcccctcccctgggagagagcctagggcatccgtgcctgtcccctgtttcccccactccccaacagggctggcctccagcctctgtcataccctatctactcctgccttcctccagctggcattccctggcagcggtggcggggaaactggcagacacgagcaggtgccatctgtgtccaccacacgctcctgctgctgcggtgtggcgaagacaaggctgcccagaccaccacgaggcagcgagcgtggagtccggggccctggggagggcggcccaggcccagctggcacctgcttctgcccctgcctcactctgtacagccctcaggcatgctactgcttctgggaccagtgaccagcctgctgtacctgctggaccttaggcggccactacaacggcttagcagcaggagtgccctggcatgctgaccagcccacccacagctcattgctgtcctggaggaaggtttggggccctctgtggggcagcagtggctggggagaattgagccatgcagacatgcggggctggggatgacccaggcagccacgacttgggcagaagcatggaaggaggcaggacccatgggacctggggcctctagccaggcaggggagatggggaggcaaaatccctccagttctccagtctgggtggactcagggtaggtggtgccaggccagatggctgggatgagcatacagtcctgattgggacaggcagggggtcgcacagggaagaagggcaaaggtgatggatcctggagtccagcagggagagaaagagacactccgagatgtggagaggctgggagaacacgaaagggtcaggaaacagggccaagagtgctgaagacaggtgtggagagaggctaggagggtggatcagaccatggaatcccgaagcccagatttcagaggagggggcctggcagctgggagacccagggtggggtgggtggtctgtgtggtctcctaagtcccctggccagtgacaggcccctgactctgcccagagctgcggagaagaaagccaaggtgaccagacttctactgagaaccctggaatcctcctggaatcactcagactgcccatcatggctggaaacagatcctctaacatgggcgttggcagatgagcagctgctggatgcagtcctagtgcccaagatgaccacgtgccagactggtccagggtgctgggggcataccctctcatttgctcctcacaacatcctgggcagactctaccatcatcttccctcatgcactcagggcccatacgtcacttgtcccgggtcgcgcaagagggacgtgatggccaggacctggagccaggcccaggctgcctgcaccaggctgtgtctactcactgggctacccccagtgcagggctcctcccattcaactgcgagcctggcctcaaatacttcaccccacatacaagttcaaaaccatggcagcgaggcctggcagggagaaaggagtgtcccaagttctcctgcggcttggggctccctgagcctccctgggcctgcacccggggcagagtgtcagccgggggtggtggggtcagctggccctgggctccctccttcccgccatcattccgtggctcgaggaggtagactgggggctcacccatcccagccagggggtcctctgacccaggggctgaggggtccaatgcgcctcatcccggcaccaacagtccctgggctgcagccgagcccttttgtttcctggctgccccagtgctgactcgctgcacatgtggctcctgcaggcctgctgctgggcagctgaagccgcaacaacctctcagcccaccctggatgttgggagaagttgggagcataaggtgaccctcacagaatccactgccagaatcaggcccaggtgctgtcttgggagtcagaaactcaaggtggccgtcagccagcccttccttcctctggcaggctgactgccaggttctctgcactgccgacacacccggatcccccaaaccatcagcccttcccctccacgcccctcctgaagctaactatagcagggctgggcagtcccacaagaggtcaaagcagacagtaggtgactccagtcagaagcttcactctcacctcaagactgcaaagagctgcccaccactgacaggagagacatgtgggcccgctcccctggccacccctgggatctggtcatggagtcactgcatggggtgtccatggggtgaagtgaaggaccccacatgttacctagcctgcctctctccctgtagaaatgctggctttgaggaaaccagggaccagggcctcccctcctccccacccaggtccaagttgacactggcgaaatgctgtgacctctccccaaggtcccataaagcacctgtcagcccagaaaggttcttagagttcttcaggtcaaccctcttggacaggccagtctaggttcttaaccaccaaacaaaactcttctctgcttccaatcccaccccccaccccagtaatccctcttccactggaggccagtatccttgctcttacatccctaatggacctggtcacatccctgcttaagccccacagtgagtggacttctagaaaaacatggcacattgagcagacagatttatcgctgcttccttccaagactccactataatgacagtagaggaaataaacaaggcataaatccataaggggtgatgatgagtaatgaaggatgtcaacaagattctggaagctgggaagcagatggccaggcagtagctgacttgctagagtgatgaaagctgagagtcagattcctgcaggggggaaccacccagaagcagaagcccgaaaaggctcaggaactgagtttgcagggactcctcagggccttacggccaggagggctgaagacagtagggctgaaagtctgtaagaaccgatcagaccctagatcccctccccaaccctgagtagccaagtgacggccacctgccacccagcagagggccagggatcactccctggggagggtgaaccaggaggctctggcccaggaacggtggacacacatgaaggcccaaggcagaaggacctacagagaaaaggggacaagcaaaagtctacacattgaagggtaagaaacacgccaagcccctttcccacttggatgctggaatgctgcagccagacatacactctcccaggaaaagtcgagaggattcctctcaggaaactgaatcactcagaaaaatgacctcagatagtgacattagaggatctccccaaaatagccccatctgaaccagtccttcagcagtgacttggaaaagtcctgcccaagtccacaaactgcccaattagtgtctctgcatctccttgctatatatgaaatacagccaatgcattttaagaaaacttttctttgagacagagtctctctcttttgcccaggctggagtacagtggcagaatcttggttcactgcagcctttccctcccgggttcaagcgattctcctgcctcagcctcctgagtagctgcaattacaggcatgagccaccatgcccagctaattttttgtattttttttagtagagacaggatttcaccatgttggtcaggctggtctcgaactcctgacctcaagagatctgcctgcctcggcctcccaaagtgctgggattacaggcgtgagccaccatgcctggccaagaaaactgttaacatgaaacaaatatatttttttaaataacccaaaggaaataaaaacatttcagggaacagaagaaaaaagtcaaatccgtgtaagtaataacctcacagagataagagaacacactgtacccacaaaacaggaataggatcaaaaggtgcacaggttgagtatctccaatcccaaaatccaaatgctccaaaatccaaaacttttgggcactaacatgatgctcagaggaaattctctttggagcacttcagattttggactttcagactggggattctgaactggtaagtataatggaaatactccaaaataataaaaaaaaaaaatccaaaatctaaaacacttctggtcccaagtatttcagatatgagacacgcaatgtgtatttagtgagtgagaaagttcaagaaattaaaagtacaatgaaaaaaatcaaaaatttaatagagggattgtaaagtagagtcagatacctcctagaaaatagagatggctaggcacggtggctaacgcttgtaatcccagaactatgggagactgagagaggattccaggagttcaagtccagcctaagcagcatggcaaaaccccatctctacagaaaaattaaaaaattagctgagtgtggtggcatacacctgtagtcccagctacttgggatgctgaggcaggaggatcatttgtgcctgggagctcgaggctgcagtgagccatgattgtggcactgcactccagcctgggcaacaaagcgagactcaaaaggaaggaaggaaggaaggaaggagggaaggaaggacggaaggaaggaaggaagggagggagggagggagggagggaggagggaaggagggagggagggagggagagaggaagggagtgaaagagagagaagggagagagggaggatagaaaagaaaagagaaagagatgaagaagtgtaaaatgtttaaaaataagaaagtgagagaatagctgaatattaagggttccagaaagagaaaatgtaagaaagttatcaaatcaataatacaccaacagttcaatcactgaagggcacaagtttctagattaaaacagtccaatgagtgctccctcaaattaaaatagaccaaggcatatatttaaaatttaaaatcaccaaaaagagagagagaaagagaaagagtcctaaaagcttccagattttttaaaaggtcacattcaaatccaaatggtatgggacctcttcagagcaatgttggaaactagaagacaacagaaaaatgccttcaacattctgaggaagagtcacttccaacccagaagttgatatcaaatcaaaatatcaatcagatgtgagggaagaataaagacactttgagacaggcaaaccatttacctccatgcgctctttctcagaaagctacttgaggatgtgctccaccaaaacaaattaaaaaaaaaaaaggtacctgcccataaaaaaaagtagcatgggatccgagaaacaggaccctccatgaatattttggggcaggcatagaaagcatccagtctaaactggaggacagagggaagttgggaggagggtccaggaaagaagggaacggctggattatctggtagagattacctttgggaaaactggattaagagacatcttataaaactgttaaaggatctggaaggcctggagaagcaatgaaaaccaagcaaataaaagcttgttcttacaaagaaatgccgtctagatggggcacagtggctcacgcctgtaatcctagcactttgggaggctaaggtggcgaatcacttgaggtcaggagtttgagaccaacctggccaacacagaaatcccgcctctactaaaaatacaaacatatgctgggcgtggtggcaggtgcctgtaatcccagctacttgggaggctgaggcatgagaatagcttgaacctgggaggtggaggctgcagtatgagccgagattgcaccactgtactccagccagggcaacagaatgagacactctcaaaataaaaaataaattaaaaaaaagaaatgccatcttattacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaattcgcaccacactggcccttcggcagctctagaaggccgtacctatctcctgactgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntctattgctctgtaacaaactgagcagcttaaaataacaaacattatctcagtttctgtgggtcagtattctgtccagtttaccttgggttcactggcttggcctctcaccaggcagtgaaggtgttggtggtggctgtgatcatcccaaggcaggatagggagagaatctgtctccaagctcaggttggcaggattcatctcagaggctgctggactgggcctccgtttctagatggctattggtcagaggctttttacaataccttgtcacgtgggcctctccatagggcacctcatcacatggcaactggcttccatcagagggagcaatggaaagagcaggagaagggtgaccaaggcaggcatcgtagtctccttgtagcctcacctcagaagcgatgttacttttgctgtattctctttgttagaagtgagtcactaggtccaggggtggaattttacaagggtgtgaatggcaggaggtgagggtgatcagggccatttagaggctgcctaccagtgttgaagaaaattgttgacttctatgagctgtagcagcagacagtgctatgcaaggagaatggctgtctcagaagtccagctcctcacatgggtttaaacgtgttgccttttccccctgatacattttgtttaaatccatggtcatcttgccatttagtggtgtggtttaattgcatatttgggttagtctgtatgtaaacatttaacataggtgtctctgggttaaacaggaatcctattcatcttcttcaccgatatggtctgtggactctgatgagccaaatctgacatcagttctggaacgtctagaagatactaaggagaacagttcggtaaggaaagaaaccaagctattttctcttttcctcatgaacattatatttagaaattaaatgttaagtgataatattatataaaaacatgattaataactataatcttagaggaattaaagtctgggtattttaagtcctccaaatcttatttactacctggtttctctttattatttcccacatgtataatcttagtttagattagcaattcgggatctctttttccctgaattctaaccattaagccaagcaagcattttgggtggagaccactagccaaggtgggaagtagaaagaagaccaaggtggaagtgaagggagagatggggagaatgacaccagaactagtggaggggattgccttttttctttcagggtctgtaagtctgcagtaaaagtcaaaggtattcaaaataggaagttttgttttggccttagaatataaggagcataactttccattttgcaaaactttagaaatctttttttcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggcctgtgaggatgaagctgtctgtgacagctaccacaaaggttactataggtggacaaatttcaaacaagtttatcaccactaccatccccaccataaaactgtctcaatcaagggcaacacaattcaatattagccaagacaacctctttacctgtcactgcttaagaaaaggatttttggtcttatttagaaataactttccgtacctatttttctccataaatccactgagaccaatgtgtggctctatcgcaagcaccagcaagcaaaactgcctgctagaaggttcagtttttgtatctttccaaatgtagaacacagctatcttcaaggatttcataattttttgaaaattgatgcacaaacttcttgaaagttcagagacacagcagctgtaattattctgaaggctggttacgggacacattaccttcatactttgctgtttaagaaatgtggggtggagaatcaagtaaactgatagaatttccatataaaattctaagtgctctgagaacaaaagaaacttaaaatacacacacacacacacacacacacacacacacacacggttttccctactaatcattttacaactaaacaaccaagttgctaaaccagagcccacaaaagcagagtcaaagttctaacacttggtaaaagaaaaatgcacacatacgcctgtgagctaaaaaaaaaatgcttaagtattcaaagacagcaattacagctactgagaacatcactgtaagcaaactgaggcagagaaaacaaacgtgctgatgaggatttgaaccacctaagctgcagaaacccactggatggtttcctaggttccgagttggcattatctttcagaacaatcttctagaagagatcacataacactgttacaaaggatctggagaaagggaccctggcttcatcactgtggctctccagtcatgctttacatttggcagtgactatctccattcaactcaattccctaaccctaaactagctgacatttatcaaatactgccctttaccaggtctaagtaagtttaactccccccacccccaccaaaaaaaaatcaagatactaagggatatactattcacaaaagggaaacctgtctcctcttcatatacctgttcctttcaaggaagggtataaaaatggggatgagggaggataaccactaggaatttgaccctatattataaattggtcagataaatgaaaataattcctctggactcaaagtgatatggctctgaaaacgggagaaacatcggggtcctttgtctcacgccagttaaacgacatggacacacaggagtggttttaaggaacagaaagtttaataggcaagaaagaagaaaggctccctgcggtacagaaaaaggggggtctgaacagagaaaaagccccgtgtgtggcagaacagtactcggttatattgggaggctggaggaggtggtgtctgatttgcacagggcccagggcattggtttgaccaggcaggtcattcatgtagcccgagaaaaacgtggccctcccaccctagccttttaatatgcaaatgtaggtcaccatgttgtcctgcacacatggggtcatctggaggtgtcaccttgaggtggtgactagaagaagagggtgggaatctccatgttgaatggacacagtttctaagcgctggcatttgcatatcaaagcttggcagcctgtagtcccagctactcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctttttaatcatagtaaaaatgagaaaaatgcaagatgaagttaacagcattgctttatttcccatgaaaagctgttataaagcattctcaaaataaactgttattcagccacaaatgacaccatcacttttttattcatagggcacagtatcgctgccaaagagctttcctctatatgctctcttgcagggcaaaaaatattatctatgttatacagaaacacagtaaaaaaagtgatttacttaaggtcccaactactaaataaaagctaaactactcacttcctcctagattcagagagagctccaacattttctaaaatttggtatcttgttgttggggtaggcactttttggcaataatgaatagacatttaattagccaatcaaaaaaacttattaggtacagtaagttcctcttcaaaggtttaacctgttcaacttccttgttctttgttcctaagaacaatttccctgtaccttctcacccctatttacctgcttagttatctgctcagttacctgccttgtaaacaactcttcccgtcagtcccaacctgtaactcacattccctctcccttccttattagggagaatattcgcgatagcaaatcaagtctgcttagattgtgtagtccgactccagcccatgtggaaatgacagagaggtagggactgcgttagggatataaactcctgctctatcctgctcggtgtgctcttgcattcgtgactaatgcaaacagcagtcttttgcagaagtaagttgtcttgctgagaaaactttttttcctgagtgctggttcttccttgcagcactgatcatttgtttcttttttctttcttttttttttttttttttttttttttgagacagagtttcgctctgttgcccagggtggagcacagtggcttgatctcagctcactgcaagctccacctcccaggttcacgccattctcctgcctcagcctcctgagtagctgggactacaggcacccaccattgcgcccagctaatttttttgtgtttttttttttttttaggagagacggcatttcaccatgttagccaggatggtctcgatctcctgacttcatgatccgcccacctcggcctcccaaagtgctgggattacaggggcgagccactgtgcccagcctgatcatttgtttctaacaatctgggggctcgtctggaattcccattctcctctgagaaaagggtctccagtcaccaatagtgaggagaagcatcccactgcctcactgaggtggcctcatggtgagggatcaggacccacccagtgtgatgaataaacccggactctcagcagtctggaaaggaacagaccaacaacttaagagaaaaggatcctcacataccatggtgaccaggtaactatgtgcacagaccaacgtaagaaacatcacaagagcgacaaagtattttcttggtggttgggatatcttggagattgaaagtgtgtgttgagactcacaattgagtgcaaagcaagtgttcagtccagatctgcagttctgtggtcaccttatacagcttaaggtagcccttctgtaaaggagtctgggtcaggggtttctactgaaacagccattgctaagaggaaaccaacgttcccatgagggaagcagccagagaaggatgaagcgaaaggagaaaagtgcaagaaacctccagcaggggggtngagttttggaaaggaaagggaaaggaaagggaaagggaaagggaaaggaaaggaaagggaaaggaaaggtaaaggaaaggaaagggaaaggaaaggaaagggaaagggaagggaaagggaagggaaagagaagggaaagggaagggaaggtaaggtaagggaagggaagggaagggaaggaaaagaaaggtgagaaatctccagtaggagaggttgagccttatacaaacctctcgtaactgggaagaaatttctagtaggggaaattgagcctcaccccaatcccttttcaagatgggaaatacctcaagtaatgcaggggagaaaaaggataaagctagcaacaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctggatttctccctccaacaggtggttttctgaggatctgcttattagtcttcttacatactaggcaactatctgtaacttgtcttgccaaaatataaattcctatacatctgtagaccccgaggactgcatcacacttagcttgaggtccctaatgagtcccttgatgcagatgggagagaatttccctcatgaggggtttggataacatttctctttggtctggtgacacccatttcccttctgaattttctttggctcctatttttattaatttttccttttcagcgggagaaaagatggggactgcagtcgagggaggaaggcaaggggctaagtgaaaaacaggcattttcagaggaaacggcagtgtgtttggctatttgatctgctaggttattccttccgctttgaaaagaaagacttttctaatgtcctggaacatggacaatagctattctggcagctgcaggttatctaatacttgggtgattaattctttgtggcccaggtcttggcctttgctattaataagatctcgttcagtccaaatttttccaaaggtgtgagctaccccaaaggcatacttggaatcagtataaatagtccgttcttggttttgcaagtgctttaaggcttgatttaatgcaaacaattcattcacatgtttgggcagaccaattatttggcaggcttcctgactctacttcttcaagtgcctccccatctactactgagtacctattacgcctttttccttcaattacttgggaagagccatctataaagaagccctgccccgttttgtaaggggtctctcttaaatcaggcctaacttttgtatgatcattaaatctaaacactcatgctcaggtctctttagatttggatctccagtcaggaaacctctgggttaagtgaattatcagtggttagtgttaaatcatctctttctaacaggatagcttcatactttaaaattctcaagtcagtaagccatcttcctgccttttaatttaagatggctctaacctgatggggcatgtttacaactaactttcccccaaaggttagttttctgctttctttagttaacaaggcggtagctgcaatggattgaaacattcaggccatccacaggttactggatctaaaacttttgataggagatccatgggttgctggtgacctccgtgttcttgggtaaggacccctaaagctacccccttatttatgttaacagaaaggtgaaatggcttttctagggaaggcaaagctaaaacagaggcagttataagcagatgttttagctcctcaacctggtggagttcttcagaagtccagaggagagggtcaggcttttcttgggtgatttttaggtagagaggctttatgacaagggcatatgagtcaatccataagcggcaatatccagctatccctaggaattttctgagttcttgtttagtcttaagcaaaggtatggatacaatcctttcaaccctctcaggccctatccttcgtttgccgttacttattaagtgtcctaggtatttaacttcaggctctatgaatcgaagctttctctttgaaacccatagcccctctccttacaaatggttaaggatatggacggagaaagcagataccttttctatagcctaaccggatattaataagtcatctacgtactggagcagacatatacattttggggtataaacttgttctaacacttgttctagaatttgaccaaagagattaggggaatctgtgaagccctggggtagaactgtctatcgatactgttgctgtcatccagaatggggatcttcccattcgaaagcaaaaatgtctcagctgtcctcatccaaggagcatgctcaaaaggcatcttttaaacctattactgtaaaccattgatgttcatatggaattttactgagaatggtttaaggattagggacaacaggatgggtagtctagactgtctggttgatggcccagaggtcttatgctagtcgacatgacctatctggtttcttcacaggcagtattggggtgttataaggggacatacagggttcaaggagcccatccttgatgaggctttcaattacaggtttcaggcctattctgccttctaaaggaataggatattgctttcttcttactatttctccaggggtttttaactttatatgtatagggggaatttggagttttccccaatttccttcccttgcccaaacatcaggatgaatgtatgtttcttctgcagtggtgagcaggtttaatgaagtgtagaatccttctgagccaatacgtaaacctatacctaattttaacattaagtttcttcctaatagattagttcctgcctctgaaattaacaaaaattcaacattagctgagcagtttttacatctaatttctgtttcttttaaaatttttagtttgattccctctccttttacccctgagactacaagctcctctgaggaccaggttatattgtgggggaaggtaacaaacagaggagcaggctgctcctgagtctactaaaaaggtcataagctcggatttgggttccacttctaaatttatcaagggctcttggtgggattcaaggtaaaagagacagagcccctaacccccctattcctcctcaaaggtcgtaagtgggacgacttctctttctgattttaatttgggacaatacctcttgaagtggcctactttctcacaattgaagcattgattctgtctcttctctctatttttgggtttctcggctttgtctccttatgttctttatatggcttaggaagtgggggcctaggatctttataggttttggctctcgggaggctttgtttgggagtgtgtgggtctctgggtaacagagagtaatactggtgtgttttatcctttggggccccctgttggaaggtggataacataattttcattttttctttttgcttctcctcatccctccttacacacactttctgagcttctctaagaagctcgttcgtgggatggtccttccaatttcctatcttttgtaatttccttgtgatatctggctgttagtaacaaaatgaagctttaacattcactgcctaagaggatcttctaaatctaggccagcatattttctcatttgttctttcaacctgtctaaaagttcgataggcccttcatctttcctttgttgtatgtcgaatgctcgagtaagattttgggttcggagtactgactcccgaatcccttttattatcatttccctaagttcttgcgtatcctcttcagtgggctgcgttattattgtcccagcaggggtcttggttggggaatttttgatccgctgcatgaatgttttggccaggagggtgttcatgttcccagggtaccatagcagctctacagatgatgcttctttcttcccctgagaaaaggatgcctaggatggacattaactcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntctcggctcatactgcagcctccacctcccaggttcaagctattctcatgcctcagcctcccaagtagctgggattacaggcacctgccaccacgcccagcatatgtttgtatttttagtagaggcgggatttctgtgttggccaggttggtctcaaactcctgacctcaagtgattcgccaccttagcctcccaaagtgctaggattacaggcgtgagccactgtgccccatctagacggcatttctttgtaagaacaagcttttatttgcttggttttcattgcttctccaggccttccagatcctttaacagttttataagatgtctcttaatccagttttcccaaaggtaatctctaccagataatccagccattcccttctttcctggaccctcctcccaacttccctctgtcctccagtttagactggatgctttctatgcctgccccaaaatattcatggagggtcctgtttctcggatcccatgctacttttttttatggggaggtaccttttttttttttaatttgttttggtggagcacatcctcaagtagctttctgagaaagagcgcatggaggtaaatggtttgcctgtctcaaagtgtctttattcttccctcacatctgattgatattttgatttgatatcaacttctgggttggaagtgactcttcctcagaatgttgaaggcatttttctgttgtcttctagtttccaacattgctctgaagaggtcccataccatttggatttgaatgtgaccttttaaaaaatctggaagcttttaggactctttctctttctctctctctttttggtgattttaaattttaaatatatgccttggtctattttaatttgagggagcactcattggactgttttaatctagaaacttgtgcccttcagtgattgaactgttggtgtattattgatttgataactttcttacattttctctttctggaacccttaatattcagctattctctcactttcttatttttaaacattttacacttcttcatctctttctcttttcttttctatcctccctctctcccttctctctctttcactcccttcctctctccctccctccctccctccttacatactcacaccctccctccctccctcccttccttccttccttcgacttctccagctcctttacttgctgctccaactgcagtgtgctcttgttctcgttgttctggacagaaagaagcaatcagtggccacccactaaaactggagaccccagaacttattgtctgcctcccatggcaccgggaagggtggaggcaggttagaaaaatatcccctctctcccacagccatcagagcagggctctggctcacagatgcctttagaagtaccatttcatgtgaaggctacaatgccccattttacaggtggggaaacaaaggccttgagggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncacagcctctcctcctgttcatgtagcctctcctcctgttcatgtagcctctcctcctgtacacgtagcctctcctcctgttcacgtagcctctcctcctgttcacgtagcctctcctcctgttcacacagcctctcctcctgttcacgtagcctctcctcctgttcacacagcctctcctcctgttcatgtcgcctctcctcctgttcatgtagcctctcctcctgttcacgtagcctctcctcctgtctcctgttcaggagactcaacatctgattgttttccacctcagcctggagctgtcttcccacactctctagctccttccttaggtggttggtctcatcttgtagctgctccacctttgatggccctgctgggggctctggggccaggggttcagctgagaaagcaagcagagaataagggcctctggattctcaaaaaaaaaaaaaaaaaatcctccctttggtgcacagctcctcctctcaggcttcccaaacttggcctcactgctaatgactcctcacacccggatggtagacaatcttccaagtcactttcagatagagagcactgtgggtggctgacaatgggcactcctccctctttactgatggggacactgaggctcatggagatgacaagacttgtcctcccctggcacagacctctttccctctgcctcaaagcccttccatccacccacctccctggggcattctaagtcacccccacagccctctaatgccagtccagctgccaggtcatgccagccccatcttacccgtctggtttttgagtttgaacaagctcctcccaagcttctgtaccagatgtatctcatgcttcttctcctccttagatgtgcgaacctgcccaaagcaaagggggaaaagggccctggagggaggggctggtgaacgtccagagacagagtttgagaaaggcccaccccccttctgccagtttgtgatttagaaacgtgcattcattcaacaaacatttactgagcatgtacaggccaggtacagttcttcatagcagagatataaaacagcaaaggacagacaggagcccttggccctgaggtttccattctaggggcctttaaatctctgactttcagagctaaccaagacctttgatactctctacctcctccagaaacacgagcataaagaggagagatggcttgtccagactcaaaaagcaaattagggactgaggcagggcagaaatatggacccctgacaaccagtcaggctagtgcttcccagagaggtgacaaccccagggcatgtgtggcaaggactagagcaggggtgtctggagaagagagagtcagcaaagagggcagtgcagaagacccatgctgcatgttctgtgctctggggtccctccaggtgagacctgggtgcccagctccccatttgcccttggcatcaggggcccctagctcctttcttcagggccccaagaggaaactggagtccaggattgaccagctgtaatcaggggaccccactggactcttaccagtgaattgatgttttcagtgagttgactgattattgcggagcttgaatccagggccactgctagttcttggtactggctctgaggtgcatgcagagagaaggagttggaggaagattgtggcgaggggtagagagaataatcattagggctggtgggggtgtgtgggctgcctcagctggcagaggggcaacaagcccctgctgtgggaggaggttggagggctggcctgcagggtcactgcacctcggcccagggcctcttacctccagatcctgcagggtagtagaggatgcacggccctccccgtagatacctgttgctgactgcaagagatgagagtgcacatggagatgttctgtcccccctcactgtctaagccctctgacttcctttcttcccccatcaactggcaaaagcttcttttctgcctatcttggacccttttccccataactcctttgtgccaacttctctcgtggttcttatctccccaccatcccaccctggggccctttcagtgactcctaaagggacagcctgatggcaagtggctcttctcattggcctggcttccccttgagactggggatgaggaaaatcaaacagcaacgaccatttcctcagtgtcctgggtgtttgcagcaggccatgtactaaggattcacataaaagcaacaataacgaatctcatttaaacttcacaaatggaagtcaaaaaataccacctctattatacagatgtgaaaagagaggcccaaagacctcaagcaacttgccctaaatcatatgctaatcaatccctaatcaattcttagcagacggagaggcaggattcaaatccagaattcttaaccagtacccaacagtccatctacaatcttaacaattaccctctactgccccttgggccccctgtccccaggagcctggcccgccgagactcacatccccaggtgagtggtaaccaccagaagtggctgtgtcagggctactgccattgactttctttttcctgttagctcctgctggaatgccagggctcttcctctgccaatatgcttttaactgtgggaaagaagagcagtaacactcatgagaatgatcagcccctacagccacatcctcctttacagttttgacaaaatacccttatataccatctgatgtaatgccaccaacaactgtacaaggtgttgtcacaatcagtgactgagagggattcatatcatggatagaaaaaaaaaaaaaagaaagatcaaaaaaggcaatactggaacttaaactcagtcctctgactccacgctctggggttttgccatgaatcagcagcttccagggaccaaaaccaggggcagaggtagaaaagcacacattaagcaggcaggaactgtaggccgtgtggtttagagtcatacatcctcacaggtctgctagcgtgaagaagcgtaccagtacctctcacactttcatatcaatgtgtcctcatggcagaaggcagcttttctattaaatctgggaatttatcagaaagaggacaacccaagcctcatttcagagcgaagtctggtatacgcttggaaacctatgtgtctgtcatccccaagtacattaatgcattttctcaagagaatcaagggaaaatgatgcttcagaaagatgtcccgcatttatcctgtggcactcaaagtaccccaggttgagacgatatgacgactatcaagctgtcaagttcagtttccccagatctattccacagaagatgagcaaatctcacttcagagnccactgactgaanggcagtctggtcccagaaccgtggagactcagaaaaaatgttaaagtctctctggaagtagaaagcctggaaaaaccaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttttcggatatctcgcctgtgggaattccagtcaggatgtgcgggggccactcaggtgcccagtgtgcgccctggcgatgtccagcgagaagcagaggcgcctgccggccttcccctaggcctaggccgagggggactccccagctaggatcttgcagatcacgctctgtgacggccaagacagcatacgcccactctgtgtacaggcctgggagctgtcagagggcatttcgctctttcccagcttcgggatactggactgcgaagcgggaaaatcccgtgacctcccacgttcacttcgacgttagggggaatgcttccgtacccgccgggctacagtacgccgcttttcacaccgctggggtgagagtgcgtgtctttacacatttcctggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncatcattgcattccactcctcccaggggaggggaccacatcagcgcgatgcccgagtcgctgctccacgatgggggagggaaacacacggtttcgacccaggtcctcagagacgccagcccaagaagcctagggaggtcgagcttggggcagcaggaggggagggcagagtctgcagtagggagccccgggagtcaccagcccaaagccacccagggatgactggtgagggcagggcctggggctgggggacccaggtcctgggagacgcaagcccaaagagcccagggaggttgggcttggggtggcaggaggtgagagctgattatggagcagggagccccaggagtcacctgcccaaagtcaccctggggtgattggcaagggcagggactgggctgcttgctgaaggggtggggctgactgactaggctttggttgggggagcccagaggggctggggttggggggccccatctggtatgcctcaggagtggtatggactctggcacaggtcttgtcatcggaggggatctgtggctgggttgggggccatgacctggtgtgttttacctttttcttggctgcggccaatttcccctgctgtgttttttctgacatcgcggggtggggagggaggcggggttggggccacatcagcgaaataccagtgagcactgctcaatgcctccagtcacctaccaggcagctgtgcaactgagccacaggtggcgtaaccagggcaccaatggaacgcagaataggggcgtggccttaatgctccaagcccattggtcagtgagaaagatgaaagggaaaggaggcgtggccaggcagcagcatgtccagagggacctgtggcatcataaggaaagctgcccatgcaaccgctgtccccgcccactcagagaaaggggaggggccgcccactctgggagaggggaagggctgggttttgctttaaaacttttaaaactgtaaaaaataaactttaaaaaatatatgtgtatatactttatatatatgtgtgtctgtgtgtgtgtatctatgtgttcctccagagctgtcttcattatgcagcttctgtgcaaagtctgtgattttggcctatatttttcatcttcaaatggagtacaagaattaccagtattaccttaactgagatatagatcctataaaaatggaaaatccatagcatgcttgatgattaatgaagccgactatagtatccgacattccaataagacaaaataatcacaacaatttctcttttttggaaaaatgtttgtcttattctcctacattattgttaagatttcttttaaaaacaagaaacatgtctaatatctttaaaaacacaaagcttttgggccgggtgcggtggctcacgcctgtaatgccatcactttgggaggccgaggtgggtggattgcctgaggtcaggagttcgagaccagcctggccaacatgatgaaaccctgtctctactaaaaatacaaaaactagccaggcgtggttgcgggtgcctgtaatcccagctatttgggaggctgaggcaggagaatcacttgaacccaggagatggaggttgcagtgagccaagctcacgccactgcactccagcctgggcgacagagcaagactccatctcaaaagaaataaaataaaatacaaaataagtaagaacacaaagctttcaatttaataaccacttaaagctctttactggtttaagagaattacaaggcccatttttctagaatcacctggcctctctaagccttgcaaatgaagctgaatttctcacttgatacttggctctcacttgcagtcatgaaaaccaagaatttgttatgtcactgtgtattgcttgttacctgaaatccacactaggctgggatcaagggttgaatctttcatgattttctccataacctgtgtgcttcttatcccacaccaaactaagctttttttctagagctctgcaatttacagttagtatatgagagcagttctcaaaaatgtagtctctggactagcagctccagcagcacctgggaacttcttataaatacacatcctccggccccaccctggacctggtgaatcagaaactctggagtagggctcagcaatctgtgctgcagtaatccctccaggtgttcaagaacctctggcatacagcaggtagaaaaatgtgtttccttctgtaggtccaaaaccagggatactatatgttttctctatatgaaacaatgacgtgcaattaaaagacataaatctccttcctgctcccaccttccagccaatgtgttttatttttatgagttaaataagaaaacaatcagagatttcgtctaaatcgcatatttacaggtatcagttctcatccagcctgatcttatccaatatcatttatattctcttacatgtgaagttttagagaaggatcttcacaatgtaagactcaggcacactagcagttctgtaataaaacaccaagtagatcagaatgtccaaacttactggagaagaaaagtggaatcattggctatattttcaaattgcaataaacaggatattaaagttttgaatttttttcaccttcatccttccacgttaatagaattaagccaaaatacttgtcttccaaagcctctagccaggcaaaattttactatattacttcttgcttttcaatggctataaagcagactcctggtaggcacatttggtatacctgcaaagatgaagaactaaacagttccatctgttcaatactgaaacaaaagtcctgcaaacctcggatggtgagtgtaatacttcagcactagcaccaaagcctcaaatatgaaaagataccaagaacaccactagcaaacaaaactaaactctcggctgggagctctagttcatgccgtaatcccagcactttggcaagcaaaggtgggaggattacttgaagtcaggaattcaagaccagccttggcagcatagtgaattcacacctctacagaaagtttttaaaattagctgggtgtggcagcacacttcctggggcagatgtgccattgctggaaacttctctatggagagtaccaagtacttctacctgtagcattttccctggctggaatcctgcaattatcacagtagcccgagatccaagaaggcagagcaggagcatcctgtcccctccccagcaggtgcaagggaggctggggggtgaggcacaagcccgtgggagggtgaggagcaggagggatgcatggtgagcctctgttgactgcttgctgcctcagctggaaggtcaggaccaaatgtctattacaggttaaattacagaagtatttcagattttggatttttttcagattttggaattcgaaaatctgaaatccaaaatgctccaatgagcatttcctttgaatctggccttcgaacatcatgtcggcactcaaacagttttggattttgaagcatttcagattttggattttcggatgagggatgctgtattatcttctgaatgaggccactcattcaggaaagcccagagcttggggacgtggagctgcagaccaaagaggtgatttctgtagtggctttcagtgcggaagggcctacaaagtggtttaaagcaagccacaaaataggaaacccaatatttagctaatggaactctgataaaacctgctcaagatgtctgtctctactaattcagatggagccaagccaaagcatcattattattttaaaaaggcaccaatccctctgcaaaagcactgaattatatcatgatacaatcatcaattgtaccatgaatcaccatcagcggtggtcttttagggatatgaagaaggggttttcacaatacatcgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnactgtgagaatcctacaacaatagtacctacagtataacatgccatcaccgcccacagaaggaaagcaactggtgccctcgtcacgttatgttgttagtacttgcttacatgatgtccctccctgacaatcccttccaacctctgtcagcctccttccccacaatcacacacacacacaaaaccacactgccaggaagggaagccattgagtgagtattgtgaatcctacaagtggctctgtagtttaaaagggcaatgcctgtgcctgaagaaaatttgtctttagcttcatcaggtgaagaaaattggttttataacacaaggcccaccaaaccagaaaagcccaggaacgcttctccacaggactcacttagcacgagaaatcactcagagcaaactgacgcacacagtatttgtcaaatttttctttttcatttagcagaaggtaaggtaaaggactacaactgaagttaataaatgacactctagccattttgatcatttgtcactataaatgatagacatttaagctagttccatctggggaagtgaaacagaatcatgttcatataataagccagacgaaccaaattcagtggaatacgtgcacccaaaactggaccagacttgtacttaatgcagcctgcaaatccccaagagtccacgacagaatacaagaacagtaacactggtttatctcaactcatcttagctccctcacaaacttgccaataatgacctttcaagaactgcaccgttggtcctcatctgggcaatcccgtggcttagaaaaactgaataaagtgcttcttcgaaaaataaaacaatgcggggaggggggagtagtaacaaaaaaaaaggcacactggtttttactgcactgaagcaataaattctccaactaacttcattaatgagtatcagcaaagaatgaacaccaaaataccgctcaatccaactttcatcgtgaattcttgaattcacagtaggatcattaaatgtgacggtatcactctgctataaaaactatttccaaaacaaaacaaacctatctaccccctttcttgatttaaaaaaaaaaaagaaggaaaattttgagggtttttgcttttttcaacttcacataccggtttgcctttgcaaaaaaaaaaaaaaaaaagtttagtctcaaagtatagctgcaaggtggaccggctgcacgggtcccagagggccgctcgcctccgacggtcgcagtttcagccgggccgcgcccgcgagaaacagcggagaggccccagcaggcgggcgccgccggacaggtttaccgtccgcgtcggccccggggaaccgctccctcgcgcccgcagcacttgttcgcggcgcggactccacaccgcggccgcccgccccaggggaggagtgagtccgccccagcggcgccaacccggggacccggggcaagggttcggggccatccgccgccgggcgcgccccccatccggaaagcggcgacggcccccaagttgggctgcggagtgggaggcgcgccgagccccaagcagacaatgcgggagaagggtgatgcgcagggaggaggggtccgcaaagctgaggtccccgcgccgcccggctacccatccgtgccgcccgcccctgaagccccgcgcagcccccgaccctcctctggggcccgccccaccgagcggccgcaggggacgggccgcgctccgcaccccgacccctcctcaaatcacaaaacttcccccaactccgccaactaagttgcgctctcaccgtgcggctcccgggggctcccccgcggggccgagcccgagacagctcctcacctttcgccgcggaaaaaaagacaataggctgcctctccccccggcggcggcagcatcggctgcggctaaagcggcgggcaaccgaagcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatcctacacaattcatttacttcatttgaatgttagagccacttatgtttatttgtgtttctaatttatagtttaaatttatttgtgtttctaatttataatttaaatttatttgtgtttctaatttatagtttaaatttatttgtgtttctaatttataatttaaatttatttgtaaaaagttaaatgagagtgggtctttctctcatgttcactctggcatcttttagcatttttttaatttgataattataggacgttagcatgcatatcgagtttgcccttatgtggtgggagttcaaacacacaaagacccactgtatgcacacaactgttcttgctggtttgggataggctgccatgcttttttaatgttagtacagcctgtatattcattacggaattcagataaaatttccttatgttctgctgttatgtttgatcgaatcctaatcacagtgagctcttcattagctcaatatgtggtttgccctcaagtgcgcggtctattactttgtaatatgccactgtgagtactgacatttacagttgtttaaaggtggagcactggaaacagcctttccccctttttctgtgtattggggatgggagtaataacattttggggaggtttttaaatctcccagaagaggaaagtggcctgctttggcaggtgtgtgcaggatagaatatgtttcatttgttccggtgccaagaatgagcgctgtactacggtagttcccttaggatttgtatgtgctctgggctcatgaagatactgcctcatgagctgtggcagttgtactcttttttgatgacctgaaaagggattatttctgaggaatgaaaggctcccatcatgactgtggatgtggaaaaccttttctagctgagagcatttatatctacaatacattttaaagtcagagttcatgttccctgttttaatcacatgactacatgtcccagtacacaaaagggcactggttggcgttctccttaatgtatttagtaaagatcagaagaaatcctttaagagtttaaatgcccctggaacaggcatatacaggctctagtcaagaatgaattcgagtgaaggaaagctgtgtgacacctggcattcctctgtgttcatggagcttatttgaggctagaagatggattttaccatctagacctctctggctaatagctagtcttcaaccatctgacataggaatttacttcttttccttgaatggagaacactttaaaaataataacaaacattattataaactaatatatgtgagagtacttagttgaaacaaaaaggagttttagtagacagtattatactacatttgaaaatcaaggagcagtttatgcaacgtaaaatgtttacaaactgcagcgcaatctactgtttgtgactgtcaaagtgtcatgaggaaagtgtctatacaatcacagagttatatttcctcacaaagttctttacaaagagtgaaatatgtttttatacctctcagtttcagttagaggcatattttgtgtaatatttatggcttaaaatggactaaaggtcctgttcttgccttgtctgaacttgccgcttttgcattctttgagttcagtttaaagacacttactttaactccattttaaaccctcaggctagaaatcgtaccactgttaattagccacgttatttggtctaacagtttttgtttatcattctgaaactgagcttatctaatacattgataaattatttcaaaggtatttttatagttcaaatcgcttcacttttaccctgacacgtataaatgactaggaatgaccttcagatagcgtttagcaactgtaaccaatctgacaataatgtgttcatcaggtacctgtggattaaatcacatactggcatatttaagctgaatgtcagtctgaaaaataaatgtactatattaactcaaataccactctctgtgtaggtattttgtcatatgtttaagaaaaagctaaagagaatggaaatcctatgacaataactcaagtctttcttcaaagtgcatgcagtctcttgcagtacctcattcagccaagtatttgttctcttcctcattcagtataaggcagctttcaatttgcttagaaggcaatattagaaggttagagttcagcagaaagagagaattttaaaatgtgagttcgactgaataaatttgaatttctgtaggaagtaaagaatcaaaatacctatttaaagactgcaatatatgataattatttttaaagtaatagattaaacctgataggttttcctgaaatgaaaaacaatcagttctaaaaccaaagctgatttttagaaaatgtgaaaatgtaaatcaaccctatccaaaatagattctctaaaactttatcttacagtcactttcaaataactattcaaaaatgtaactgttaaattaatgtcttaaaataatttaaaacattttaaaatacgaatactgtagcttaaaacaaagaatctaggggaaggaaaagtagagaaagaaatgccaattccagtccaaagctgtatttgccaagttttcttagaacaacttttaccgatttatgaattcttatacacagaatgcatgatggaaatactgatttttgtctaaagtggcattattgactgcttctgtgatgctactgtaatgtaataaattattagattatttcaaggtgctgttttgcctaaaaattttgtgtgtcttgaaaactatagtattaaaggtattgagactgtgcaaatgctgggcatgcttggcatgagataatcggtttttattcttacaaaattgtaaccatataagtgtgtttattaaaagaacacaaactaaaaaattacaggaattaaagttgtgggatgaaaaagttacgggataaaaaatactgtggaaaagttgtggcaaaaaaagatgtgggaaaaaagtaaaaaaaaaaagttttatgaaaagtttttttttaaagttctgaaaaagaagttacgggatttaaaaaaacatcatgggataaaaataaaaataaataaaagcaggcccctgtcagcataagcctggagaagtgggtctggagtcttcacccccaccatgtccctacaacccctccccagtcagccctttaccattagggtagcaagacaagacccctgtctaatggagggagacaaacagaccctttaccaccttgaccaaggctgagtccttacatttctggatgatgatgtttgttatttaagagccagaggttggtggagttggtttgtttggaggaggtctgacggcctccttactctcaccaaagcaacttttccctcaagggggctcccatcttcttactcagagaggcagctgaggcgggacagtggagttaactgtagacgaggcgagggcacaggctgctgggggtggccccccttcccccgtgtacatactgtagctgtgtaacattctgtattgtacctagcggaggttgcagctggcatatgaggaagaggttcttataattattcacggctgggaaacttattcattgttagcataggagcgatgatgggggtggggatggcgtcatggctccctggtgatgggaccccttttttgttttgttttgtttttttgtttttgttttggttcgcttttgattttggaataaatggatttagccatactgctcggcctggcatgttcctgtttccctcactgggtcctgcagtttttcccactcaatgaggagccccagagtgtctcagcatgtccagctgggctgtggggaatcttccaggcctgttacctgtatgctgcctggtgatacctggtggatttcacgaggactgccatggcgcctctggagtatagtccggccctgagagccaacaggttgagaagcctgatctagctgtggtcaggaagacagataccagtgcccaagggcactgacttccatccaccccacgtgtcttccattccgtccccctgcctccctctcctgtctgcaccgggtggcctgtctgtccctccagagtgccggctgccccacaggctccttccaggctgagttcagggccctgtgccctactggccagagccggcttcacagaataagagccagctaagctccagggactttccaggaaaagtgtcccttgaaaagggtgtgaccttttcactgctgccaacagcaccctaaaaatggcttggcctcttccctcccctgagctccatagagaacacagccagcagaggacacattctctgtcattcagaaatgggtttctcagccgagggacagcaggactggtagagactgtcaggccacacagctgcctgcacagcaccgccatgcttggccagaagggcgggagggatggcgggggctggctgtccataggccgcgcatgtcccggaagctcactggaggtggtgcactttggaggggcgatgtcaggagacagcttcctcttgctgggctacaagactccacaagcacagcacggggactgattcccagtgctagaggcgaggcagtcgaccacatgtatatgtgtatatatatatatgtgtgtgtgtgtgtgagtttgtgtatgtgtatatatatgataatttatagctatttatagaacagggcaggggcataccacagagggggcacaagttttcagcaacagtcacacctggatgtgtcagctcaccactacaacagactaagtcacagaagaagggggctggctttggggctgggggagccactgtcaagtcacaggacacccacccaggcaggcttggaaagggaggtctctgagaagaggaggaatctgtttagaggtcgaagtggggcctggggctccccggatgggatggacttgcctgacccaatcagctggcagttggagagaaagcagagagaaaacgggttagagaaaagccagagctggtgaggcaagtgcagagtatgggtgcgctgcagcagctgtggagggccggggaggggagggcgtaggtgtgggcatggcaaggttcctggaaaagaggggctggaagggaaaggggaggaagatggagggagaagccggagcttcataggtagtgcctggggactgcggcggccctccccaccccacacacgctggcctctttcatggcacccaggcagtccacccatagttcagacgaatgctcagccccctcgggcttctctcttctctggtcaccctgtcttccaactcacggcccagggccacctcttgcttggggagccccacccaacagccaccaggcctgatagaaagggaacactgcttgaaccaaaaatggtgaagctataagggatggatgactggagtgagtgccagaggcccctctgggtggtccaaaatcccagggtcctctgaagggaccctggggaaggcagggagggcaggtagctggatgccactggccatagacttataagtctaagaggggagcctcaactggttggcgggcgtggggctgcaggttgcataggtgaggctgggcccttcctgctgggaaaagcagaagagggagagtccatggcaggagaggcaggtgggctcgctaggcggagctcagctgggccagcaggcactgtggtccccttggctgaatagcacaggcgacccctaggagcaacaggccaaggtgtgtgagcctgctggtcggcgatagtgattcagcgggggccagggaccctgccttcggtcacacactagcagctatggtggtacctgggagggagggaagggggctgtgtgtccccgcctggcctgtggagtgtggagtgtgttgtgggatgaccgtgtgtatgggactctcacctagataccactggattgccgacagatagatgaggtggggccctgactatcagccctgctttgcagtggatttggctctcagcactcccaggctgggagctggatacctgccctggcagcatgactgagactgcacgacaggtatggcatgcccaggatgatgttcctagggactggttcagtgtgtgggtcaggagcaagtcgacaggccctgctccttaccccttggaagggactgccaccaggggcagttctgactaaggcctgggaacccatgactcagagcgtgggtccccaggtcttgctgggccagcctggctgctgcagacagacaggaagcacgtctgacgctcctccaccctcggtcagcacagcggggctgggactcacgctagccttcccagcaacttgctttcctgcgtgaactctggcaggctgccctctctgtgcaaagccatagctggggcctgcttggggccctctccctctttcacctgctcagagtggcctggaacttggaggtgggcagtcggcgcctaggatgggcctgtgtcactagggcatgtgtccttgggccagttacttcctcttagggccttgggctcctcctctgagaatggggcgtgttggtgtgaaatgaggtgagcatgttgatttgaggagcagcaggacagacacctgcaggcagcccccctggccacattcccctccctcccttccaagtcctgggacagacgctcttcaccaaggggttcagcctctgatgctctttcttggtctcagtccctaaggagtaattttttttcttttcttttcttttctttgagacacagtctcctccctctgtcgcctaggctggagtgcaaaggcgtgatctcagttcactgcaacctctgcctcccaggttcaagcgattcttcttcctcagcctcccaagtagctgggattacaggtgcccaccactgcacccggctaatttttgtatttttagtagagatggggtttcaccacattggccaggctggtttcaaactcctgaccttaggtgatccgcccacctcagcctcccaaagtgctgggattacaggtgtgagccaccgcgcccagccaggagtgattttcagtggtgtcctctccatccccagcatacacccagccctgagtggccgcggctgccacatgcaggctccagggctacatttgcctttcgtccagggttgtcatacgctggagagtagaatgtgagaggtgacccctgtaggctgcagggtggcccctctgaaccttagtgtcccccacctgtagaaggggcgtaacaccttccagggggagggctgaggaggaaattgtcaacggctgagtctaaggctcacagccagaggccaggatcggatccagggctgggcctgggcctgggaggacagtgtccgccccttctccagcctcccgcccctggtcaggccaggaccctcttcaaagcaccttcatgcccatctgttccctgctgtgggcactactgtctggctccatgggactagattttatgggaggggaaggggctgtgggtaggcaggtgccaggtgctggaccatagatcagcatggtaggaacctgttgcttgggctggtggtgggaaaggggccaacccaaggcagtggcaattagcccagccctatctctgggcacagagatgaagggacacgtggggacacagtagggcaaaattggccagcctgctcttcccctctctgcccgctttttgcagaagagtcaacagatagaacagacagagccagggaggtgcccatgggggccccagtccccaccactccagggggcagtccctgcaagtgacaaggtgggctcaatccctgtggaacaggtctctgaggaccacagagtggggccccagggaaggctgggagcctgagctgaaggcaggcagcaagtaagggccaagctgtgcccctgcccagaagaccttcctgcccccagaaccccaccctctgcagacaggcctccctgggcagcagccccccggcttccgaggccttccgtgcctcaccagatgccatgctctcagggactcgtttgctacgctgccccctgcagatctgccccagaggagcaggtgaaaagccgcgcctgccgaggtgctgcagcggtggagttttgggcagaggggtcgggggaagagtttctcacttttaagattccccaaatccaagatgaagtcacactgtgctttagaatggtagatgctcatttatgtaaaatcataataaatgttacacaaactgttagaataaaaaaatacctttttcgagggggaggagctccccagcctgccgctgggtagtgagagggggttagcaccattagggcgtaggggtcgggagctccgccacagcccgtggtgggcactgaggtctgtcggtcggtctgtgcatcctggcactgtcagtggcgggtgacccgctgatggcctcgggagggggagccgtggctgggcggagagcacgagcggcagcactgggtgcggacggtgggcagctggcagcggcccagtaggcgcagtgtctcacagaacccgaaggacaggcggtcccgctcacagcctggagtgggggggcagagaggcatcagaaccagtggtttggggtacccagaacctggctccccaccccaaccacctcaaggaggctccagcagctccccaccaagcagagagccccagtttctggagcggctcccaaactggacttgcaggtctccaactgttggtgtctctgtcccacctactcacggccgaccccaggactcgagaacgggcgctgctgggctgaggtttctggaggaaaggtcctgagaccgcaccctgaccccctcacatgcctgttaaagagcctgcccagggcgacgccctgccatcccatctccatccttgctcacccctggtgttccccgacagatcctggcacagaactgcggtcccggggcctcctgccaacctgcagcggcctctgcccccgactcccgccaccgccccctgccccagtgcatctgtcctgccaggcctccgtgaccacctccagccacaggggctgtacacagcctcgggttctgagtcacaggtcgcatctcccaggccagcctcccacttctcaggtgggccaggaagcctagagagagtgggccctacaggctgtcagcggaaaccagggactaagcccaggcccagtggggagggaggccggctgcaggctgtgcttgtcagggctgaggcttggctgggccctcctgccccgtggttatcagagctattttgggaagtggcttgtttccagcctcctggccttgctcctgatgccactgccactgctgacagcccccacctgccgcctgggccctgcttactccagcagacctccctggggaggaagagcaggaggacagcagccagccctgtgccagggacatccctcaggcccggcagagggcacgaggcagcaggcaggctcctccaccccagctccaggcagagctccaaagtgcacatctgcaggcctgcatcctggtcgcccggggtgacctcagacaagctgcttcacctcttgggccttggttccctcctctgtcaaccccacctccacagcaaatggatgtggccatgctgtgtcactgcagcgactgcacactctggagtttcccggctttccccctgtcccgccaactgtcccacagaccagcaaaacatcctgggaattccaggtctcaaagtccaagacaccttcccagctgcccctccactgttcactggtggcagaaaactcctcacttgggacagcttctagttcagccacctaaccagcccccatagcccactccctgcagcccactcatacccgcccctgggagaccttacaagcccagagcctcctgggccatctgtccttggttctaggcccccaggggcctcagttcctgttctctgctccatctggtcctcatcccctgggatcataaccaccccactccctgtggccagctctagccatgaaggcgagagatgtgatgccagcacccagctcaggcagcacacaggagtgctctgagatgctggctgggtgcgtgctgagggcaggcaggacagggtgggggcactgccacttggccttgaggtaatggggtttgtggcaggaaggccacccctgccagaggcagggtagcaaggcatggcagcgaggcatggcaggggccactctgagcccaaatgagggctgcccaggagccagcgcaggtagagaaggcgcattggataaggggagaaggcagactggggagactgcagggggccccgaatgccagtttgagggccgtggctgaggactctgtcctagggtcagggggcagacagccaatagcacaggggccgcagctcttcaggccacagctcctggattccttagactggcagggtcagccccaggccctctccctgaccttgcaatgggggatgacagtggctttgcgggaggggaaaaagccgccttccctgagcaccacctggatccccacgcagtgctgtgcccttcatgcccagacctcacttatgcaaggatggggcttggcagcccctttattcagcacatgaaggccctgagagggaaatggagcccaaggccacacagctggtgaggggagcccaggtgacactccagggccaccccatttcctgccctcagcactgctgagagcagctggggctgcaggaagtgtgtgagtgtgtgtgtgtgtgtgtgttggaggtggggggttgggatatccagaaccacctctagctcaggcccttccaccaggacccagctggccaggaaaccccccaccactgggattagcaggaccctggaagggaggcccttcctgtggttccattgctcactctaggcagtcctctggccagggaatggacaggctagggctggggaggggacagggactcacccaggcccagttttcacacagcttcagggacatccctggtctcactatgggaagactgagacccagaggggaaagagcttacccaggttcacacagcaaatcaggggccaaggccactctctctactcactggaggtcagaaagctgcctgcaggatgttgtgtagctgggacttctcttgactgactcccagcacagccaagcctccagcatgggatcctgtggcatcaggattttcagtggctcctgagcccagactacagatggagccagccggtgccgtgggtgcaatggtttgaagacccaatttccccatcacccttcccgccccacctcacttcagcagagagcttggggtcgggggactcacggggaggctcgacgggctcacaatcctcggtgccacacagccgggagctcacaaggccaggcctcgtggccacactggtcactgtcttcctcgggtagccccgtctgggtgttgacacacttgaccagtgtgtgaccactggatgccaccaccacaggggcctgagcactggggggagcaggggaggaatgagtgtctccagggccagccctagcagtgggggcagggacacctcctctgggaagccgtccctgcgccctgtgcctgactggcctgcccttgctcccagccgccctctcagtgcctcctggaggacctgttcccattcctagagcccacttggtgctggaaccccactctcacttgtgggatcggctgctgcagagggaaggggcatgagaaccatgggacagcccttggggcggcagggcagtgagcccctcacacgggacatgactgagaggcctgggcaggggccccgggatggagccctgatgcagcagtgagcagagacgtgggcgagacaccgctgtgcccgagggacagggcagaggacctgccgcagcccatgggcaggaggggtggagacaatttcacagccggggcccagcccgccaggctttgttgttaacaggtgcaggtctgaaagccctaaacatgtgctgagtctgtgccagtgtcgtgctgtgcccggccctgtgctttgttgcgttcctccatttaatcctcctgaccctcctctcccaaagcgtcccaattttacagatgagaaaactgacccagcaaagcaaagcaacctgcccagagtcactcagcagccagtcggacagactcaaacgctggcccagctgactcccggacccagctcagggcccaaatctgagatttctgaacccctcagttccaaacaggcccagcagaaggtgtcctgcccatacgaggcccctcttctgcccccttctgccgctggcctttgctgggctccctgatctccccaagctcatcattcctgcctcagacttcacacctgctgtcccctcgatccctgtccttggcatcactgactcctccctcgggtctcaaccccagacccctcctcggaaggccttccctgacatcacagcacacatgccctttccttgtctgtttctccctgtcaggtgtgagcaccagcatggcagggctttgtccagtgactgctgcatgtgcaggggccacagacagcctggctcacagcacacactccacagctccttcacccaacccaggactgaccaggcgctaccaagcacttgctccctgctcccccccgcagcctggctcacctggccccagggccccaccacccactgtgtgcaggggtgggtgttgcagggccgggtggtgttgggtctcagtgcctcctcgcagaggtctggctctgggcaggtcaccagacgctgctgctcaccaccgccacaggccttggagcactgggtgggcagggaaggagtcagggcacagccagggtctgagggtgtcccctccccccaactcaacgcccaggcctcacctccctccaggaagacatgtaccagctgaggcagggctgggccccgcagggccagtgcacaggcagcttggcaggtccaggctgacaatggaagggccacagtggccagaggtcccatgtgtccacatgctgcatgtcccacactgaggaacctctgccacagctgtgggagcactggggaccgagagacttgtgtggacacatccccacgtgcaggcccacaggcgtgaccccgtgaggcgtgtggcaggaaaggcatcagacccacgccccagccgggggcaaatccctgaagagccccagcgagaggccaaggctggcaggccccaggcaaaaggtggcatggccaggggctgccatgggctgggacagacagagaaagggaggaacaagtccagatggggtcaaagatacagaggaaaggagacaggccaagccagacaaagatgagatgactcccaagagattcggaatccggtgcgatcaggcacatagacatgcagcctggagccctccccttccctgccgctctcggaacacaggccgtggggaaccagggctccaccccatgccctggggatgcctgtcctggctccatcctcatgcaccttactccagttgcctgagtgccaggtggcacagggccacaggtggcagcggcgggcaggctggggccggccagcggggtcgcagtcctcatcccggctggagctacagcacaccggcctccagagggcacccaggccacaggtggtggagcactgcggggcacagacccgtgaaagccaggcagagcccatcctcgccaggcctccacagccaggaaactacccacctaggctagcaagacctcagcaagacaggggccctcttctgggcctcagtttccttatttgcaaaataggctcctccacccacctcccaggaagaccatgagaatgaaaagtcaaatccccccagcaaccagccgtccctgctcacatgggacaaagggcctgtgtgccagtgtcattggtgcagaggttcgggggaggagaccctgtgggcacccctgaccagctatcctgaccagcctcgtcgcttcccagaggcaccagggaaggaaggctgggtcctggtaccagcagccaaatcgctgcctatccccgcgcaaaacaagccctgtgggcctcagcctgccccttcccaccccaaaattaggaatctgaacagaagcttgcttctcctgcagtgaccatctggggacccagggagggggcactagccagcttctttcatgcagctcagacgtctgcaggtcactgccaaaggagggtggagccactgagggcagagccaggtagcagtgggctgagtccagcctggaggagccagacagagcctcagggaagctgctgcctgctgggcaggactgggcctggtggccacacagggaccctccccactgcacagctgtctgagccagctccatcctggggcatgctgtgctgccagagtgtgcctgcccctgccttccctgaggccccctgtgctgcccaggaatgggccccaggtcccctcattcccctaatcctgggaacccccgccccaaggaaggcgagacagatggcgcctgcgtcccactctgctcattttcagatgaggaaatagtcaccaaggtcctgcgcaaactccctgcccacccagcccacaccacttgcctcgctccagtttcccacttgtcagccggcgttcctgacaaccaacgggtccgtggggggccccgcttcagccaggctgggaggcagtggctgggtctcaggggctctgtggctgttggcggggctgtcccaagctggcatggacagcagcctagagctcaggggcacctcagggctgagggactcaggctgacccttgggtcctgggttcagggcaggctcaggcgtgtgcccgaggccagtcagggttgtggggaggaaggtcccccacactgccacagtctgcaggtcccataagcctggtcctggggttgggaaggagggagtccccggctgcaggggactgtccttgcccttcatctctggcaaaggggctatgggaggaggagggagagaagccaccctaacagtgggccacagttcactatccacaggccccaggccaccctccagagctgactcccaggctactgtccctcctgtccacagctccgccacgtcaggactaggagaggagtgggtgctgctgaccgggtacaaagtgggcagcgtggggctgggtctcgggggcaggtggggtgctccgcagcccttgggtccctcatcatttgaaaacctcgttggtcctgtcctgccatggagagggcagctggctctggctgtccttgccaactgggaaatcattttggctctcaggggcggcaggcgtctgcaggccatcagtggaaaccctgggccagggcaggctggggagcccaagatctggggcccctatgggggtgtcttcctcaggcaggaaattgatcaaagggttcccaggggtctgctctgagggtgggggtggggagcggccggcctggctaggccaagggctcggggaccaaggtcccgttgccccttcctccttggctgcaggaggctctgtggcaggcacagggctacccgtggagggcgcagcaggacggctgtgtggtgggggcgtccgatcccctgtccccgccaggtctagatcaggctcctcagaaggcccgtaaggacagatcctcgtggaagctgatgaaattgtagtcgtagtagaagtcgtccacaaacacgggccccggcaggtccagctttggagcctcctcctcaatggcgttgcccatggtgcctggcttgggtgatgaggcgggtgaagggcgtggggccaggtggcgcgggatgaagtcagcctcgttgaagagctcgtggctggaggagccgctgcctgagccttcagggcccagtgtgtccaggggccaccaacagggtggcagagagcaggtgacttcgctggctggctgctgggcctcgtcataggggacaccggtgtcactgatgcagaggacatttcggtgctgagtcccttcctcatatgtcactgagcactgcaggggaagccagggtgaggggcttagcctgggaggcaggctgccaggggacgctggggcaaggctgggtaacctgtccactgcctgatgtcagagtggcagagaccccagccagccctctctggcccttcccagctcaaggccatgactgtggccatgcttgccaggggcttcctgatccctgaggctttagagtcaggggctggaccctggaatgcccaggttccctcccacccacaaggtctccaggaaggctgtctgcctccctgtagctgaagaccaagggtggggctggaggcgggcaccttcccatcccacactcacctgagaccagttccccacagcctacgtggccggacagggcacatggtggttgcaaggggtttcagtagggggccggggaaggtgttcacaggcgggtggcttcagggcgctctgctcatccagccccacgctgcggatgcagagcacagcctggcaggagaggcccccaggcccgcaggagctggagcacagctgccactcacctgcccaccacctgctgagggcacacaggtgtcatcagtatggcatcagacaggtggcattgacaggctcaccagcagggagggccaggctgggtttccaggccctcggggtttgggcagtgccagaagccagtggatgattctccagagctccaagctcaggtaagtgtcctgccctcaaagtctggtgacaaggcacagcccctccactcctgccaccttcccctcagggaaactgagcatgacctgaggcctatttccacatccagggacccaaagaggaggaccataggtgtccaggctggcccaggctggggtgagaggtgaccgggggttggggcttcagccttgggaagagaatgaaagcccggctccctctgctcctccctggggcctctggggacccagatgtaggggcctgtggcagacccaggatgcctgggggtggggagttggtaggggatgggggcgggctcacctggcagggcagggctgctggctgcacttcctctggcagtcatcgggccggcccagggggtcacagtgctcctcgtccacgggccctgcctgccgctccgagcagtacacactctgcctctgcacacctaggggccatggcgttcagcctgggactggcacccaggtgcccaccgcccaagacccaaagacaccctctctgccagaaccctcccagaacagcgccttactgcccatgtcaggatgaaggcagacctccaccgtcgcctccttgctgtcctcctggttctcacccaccccctctcctatgtagcttcccctctgactgcccctggaggggtggcagagtgtggaggtttagtgggttgggtgcccagaccctctgcatcctagctgagatgcctgggcagctcatttggcctctctgaacctcagcgtcctcctctgtgaagtgggagcaacaatcctgcctcctccatgtcctggagggaggactgcatgtgttcttgcatgtgcaggctcggcccgtgcccggcacatcctaagagctcgatccatgccagctgctgctagcatgcaaacccagccgtggctcctgccaccttcccctcagggaaactgaatgtgacctgaggcctatttccacatccagggacccaaagaggaggaccataagtgtccagggtggcccaggctggagtgaggggtgaccggggtctggggcttcagccttgggaagagaatgaaagaccagctccctctgctccttcctgggattggcttgggtgatgaggcgggtgaagggcatggggccaggtggcgcaggatgaagtcagcctcactgaagagctcatggctagaggagccgctgcctgagccttcagggcccagtgtgtccagggaccactgacacacggtcccaccatccacacccttcccaatggatcagagaatgtctggacaagaaatggggcatcaatggacagcccctgctctccatccccacaccagccttggcactgctccagtcctttacattctctgccactgtccaacctggggactttgcacagccacgttcctcaccttggacactcacttccatactgcctgttgaggcccagctgcaggaccccgtctgctggtggctctgccttctctgctccaccccctgccccgtggtcccgagagtaagttgtccctcccctgagctgccagtcccacatccatccccctctttcctcaccaacagagtctgattttgttcaaggcagcagtgggacctgctgaaaacacaccccactgccgctcccttgcaactaggggggtctgggacacagtcctggctcaggagaaaaaggcacaagtccctcgctgggagtcagccctttcctctctccttcttgcctagaacactgcaagagccctggaagggaggacaccatctgtggcaagcaggagtggaggggaggctgctatggcaaggatggtgtggctgagggccagtcagctccaggtcccgccagcttggactgtgcacctgggacttcctgcctgagacaaagaacccctgtctcttccagccaccacagggcacttgcctctgcagacgctcctaagtggtccacctgcgaagcagccaatttgctgaaaggcaattccccaaatgtctagtgctgcaaatgtatttgttggttttcacgtttgtccaattaaagacacctgtattaggccaggcacagtggctcacgcctgtaatcccagcactatgggaggccaaggcgggcgaatcacctgaggtcagcagttcaagaccagcctggccaacatggtgaaaccccatctctaccactaataaaaaattagccaggcatggtggtgcgtgcctgtaaatcccagctactcgggaggctgaggaaggagaattgctggaacctgggaggcggaggctgcagtgagccaagatcgcgccactgcactccagcctgggcgacagagtgagactccatctcaaataaaataaaataaaacaaaataaaataaaataaagacagctgtattagataaaatgggtttcctagctttggaaggtaactgcccagttctccattttcactttgtcatcataatagcatttgaaggaatgctcaaacgtctgtatatcagattcccgattctgagaccctgaggatactgagtgtcaacgatgggaagactgagggggaaaggggaggactaagagacaaagggggagactgaggtgtggggagatcgaggaacagcagggcagaccgagcagggggaggaagaccaaggggcgtcgggggggactggggggctggggggagaccaaggaatggcgggggagaccgagccgggggaggaagactgaggggcgtggcgggggtactggagggccggagggaaactgagggatattggggggagaccgaggggtatgggggcagaccgaggggtatggggggagaccgaggggtatggggggagactgaggagtatgggaggagacggaggggcagaggggagactgaggagcagtggggaggagacaaagagacagagaggggagactgaggagcatggggggagactgagggaaatatggggaggaagagtcggagttaatgaaattgccctacttttcataaatagttcagggaaataagtcatgtggtgaggggcctgggctggtctccgggacgcagcagaaatgcaggcacaaaacctgccggagctgagcaaggacaaaatcaagggggagctgtgtccactggagggagaacgccaagagctgcagcacactgagcacacgccgcgagccagcacccacctgcctcatccatttaccctcccagtgggcctgggacatggggcggttgctagcctcatctcacagatggggaactgaggctcagagaagcaaacttctaaacccatggtggcccagcagtgagctgggagctgaagccggtgtccctgtccagagatgaagcccctgctggcggggctgtgcctgccccacttctcacctctgccacaggtgactgtacacttggtccagggcccacagtgccaggagaactcgggcggcaggacctcgccatggccacctgcctccctgtgaatggtgtactcgtagtgcaccccagggttgctctcctggaacagcagctgggtgggcaggcgggggcccgtgagcacgaggtgtcttctccatccacccagtcttaaaggagctgaccccagccacctctgtgaactgcagctacacagttgggccatcttaaagatggggaaaccgaggtagaggcctcagcaggagggtctggctcagagccaggctctgtgactaacccagggctcactcctccaggacgagacctaccatgggaggtgctgggcctggggactccgcctctgctccccacgcctgggcctcgggaggcaggcacctggatccagacaggctccttggtgggacccggggacgtgaggttctcccagttgcccctgcgtgcgtatgtgacggtggtccctgccacctggtagtccccgttctactggatggtccagccaccattgaggaagtacttctccgggtcctcgctctgcagtgccaggaagttggcagcctcagccacctcctggatgcggacctcacgtgtgctggctgggatcagccccacgtccacataccctgtcaggcaagggttgtgcctggggtgagaagcttgcttatccccacctgctcccctcacatctctccccacttgcctccgcctgctgatgccaaagatttcgccattagctttaaagtctgagctccccaaattgctcggatctgtcatgggtcaccaaaaccttgcggaggtgccacaaatcctgaccccgtggccatgccccgtcactcctctcttggggacctaaactggtctcatcataaggctggatccatcccctactctaagggccggctggcattctctttctaaaaaaaaccaaagtgcccaggcctttctcctgggacaccctcctcatccccacgcagcctgcttttattcattcacttccatcacacccatcacgtgccgggcactactctcagcacttcacatgtgtaagctcatgggtaacggccctatagcatggtactattgttaaccccattttacagatgagcaaagtgaggcagacagggagagtaacgtgcatgagcgtcctgctgcaatataagcagcctccagggccagtgctttatccaccacactgcactgcatctctgggatgaaatctaagcttctcagcctggcactcaaggccccatagctggccctgccttcccttcttgcctccagggctctggcgcaagctctttcctccatttggaatgcccattccatctcttctgagttttatgattcagctcaacttccgcctcctgcaggaaaccttccctgacttccccaggccaggaccttcttcctcagtgctcccacagccctctgggcctccctccactgcactgatcacaccagaaggttctgtcccccttcaggactgagcgcttcacctgcatgtcctcatcacctagcacacagtcagtacttcagcaacatgtgcaaaacagaccagaggtgagggcatggagctgggggtctcagaagattcaggaggagactaccattctttgaaaggcccaggggccacacacaagtcggggtggccctgcctggggtctctgggacaggaagactccccatggggacaggtctctgcgtgtgggccaggggtcccctgactcctgcaagaatccaccccagcaagccctccctgcttagccatctctaggctgggtgggggccacgaggccaaggacaggggcccgggggagatggggaaggggccaccaggtgaagagcacacccctccccacagtggtcccaccccatacccaggccctcggcctcctcgaaggtcccactcacggtgtggcaggtggagccgttgccgtggcacacgccacagcggtcctccatagtgccagagtcaatctcaaagtcacagccccacgttctgcaacacacgaggaggggaggcccctggtgctggcggccagccctctgtggccccagccccgggggccagccagggtcaggagaagaaagctgggagtgggggtcgggaggcctctctctggccctgccccaccccagctgtgcctctgacccaggtgaacttctctacctccctgagcctcagtttcctcagatgtgagacagggagacccacccctcccttaaaggcatgtcatgagcatcacaagagacaagagaagggaagagttctgcaaagcctgcgggcaggcaggggatctgacacgccacgggctcctgagcagcgcgtgcagggaatttcaacgtcaaaggcactgggggttggcacctccctcctggtcctcctcggagcccaggccttgataccccagtggtttagagggcaagaagcaaggacaagtaggtggctggagacatgggtaaagaggagaggccatcgttgttattaaaaataagaatataaattgttaccaaacactgaggcctactcttcagggctcagagcccttcatgtcacctgtgccacctcatttaacccctctatcagggagcaaaccactgcctggggtcagccagccagcaagaggtcaagccactgcctggggtcagccagccagcaagaggtcaagccactgcctgggctccgatttcctggctggggcggtgctggtgcaggcatccaaggagacgcagtggggcgaggcctgactggggggggtccccagtgccaggaggcgtggtaggggctttgccttagaggtcatagaggataggggctgggaagcccaatggtagagcatggggagggtggcccgaggaggaccaggagagaacctggggcccgccagtggggctgggggcaggcagtgctgggagagcctcttcctaaccaggcacaccttacagatgccattgatgcagaggtcccggctggctcggacctggtagcagggggtgccatcaaccacggcgtcccgcagcttcttggcaaagtactcattcgcgggccggcagtgcagctcacaggggttcactgggggcccaagtagaagagtcatcagcaacagctggagcgggagtatggaggccaccaggaagacccctccgtgacacacatccatggcaggctggaggctcccaagcagcacaaacatgctggaggctccggctgggctggtagctatctgcaaggctgcagactggggagctaggggcgagcagcagccccaggggacagtgggagtggcccaggcttggggtggagactgggtctcctgcttgcatcacagggtaaccttggacccacaccccgctcgccgccctctgagtctcaatgtttccatgggaggcagcactcaccgtcattgaccatgggcacccatgtgtgcagctggccctcgtagagcatagcgtcaaagtggctgcactggacgtggcggaaggaggggcggccagcggggcaggcctgcaggttgcagaggcggaagcgcttccgcttacccacacagtatctgcctttgtatctgggcctgtggggagaaccggggtggaccccagtgagggcccagtgagtgctactgcatggccacagcccagagcaagcagcttcctcctgcacccacaccccaagatccctgctgcccagctttgtgcacgctgcttccctcccttgggttgcccaccctgtggcccagacacaccctccctgtctgtagggacctgtggggaggtggcagcaggaagcctgagctctgcccccaacctgctgtgtgatcgtggacaagtcttcggccaccctctgggcctcagtttcctcatgtataaagtggggttggggctgcccctgcagagggctgttgagaagctgggacaagctgcaggcatgactggcactggctggagggactaatccgagtctccagcccatgacaccagcatcctaacgagcccttgagtcctcagccttcctcctggtggcagtacccccagcctgggtctaaaggaagcgcccagggccccagccagctgaaaggtatgatggagcacagctcctgaaatcctccacatttaggccagggtcgctggcctccactcagctcagacctggaggccaggaggcagggaggggcacaggccagtcttgggtaagcgcagggccctgggtggggccgactgtgaaccccatgcctgccccgggtggcctcctgaagtgaagatcagccgggtagtgcctcggtctacagtaccactggcctctgcttctcaccagatcttcacaccccctgcgcccccccatttagatggggaaacagagatccagagaggtgaagtcactcacctcaggccaccccttcagtgctgtcccatcctcccagctgctccatctcatctcaggcccttgttgtgtctctgaggccaccaagcccctcctgctgagtgcccactacagatgagctgcagggctgaggggctggcctgcataaactgcatttgcccctgactacaactttactggatgggcactgctattatacaggtggggaaacggaggcccagagaaggggtgaagaggggattcgaaccctgagccatctaaggtccagggcccatgctcttccccactgccctctcctgcctccttccagccagcagctgctttgccatgtggcctctgatgagtctctccagtctctgggcctcagtgtccccctttctgcaaaggggtcagcagtggggaccctgtcagccctcagaacactccttgaaagtgactcaaggtggcctggacactcagactgaccattatgaggacacttctaagagccaggggctggcacagagccaagctcctgcaatcggctgactgcctgggtccctctgtcccattgcccagggcaccctgggccccacactcacataggctgcatgcactgctgcttggctctctgtatgcccacgccacagctccgtgagcagatggaccaggcgctccagccagaccagccaccatccatggcctcgggctggaagcccacaggtatgcactccccattgagacaccactaccgagacagacggaggtagagccaccccacccccaagcctatcagtcatcctcaccctagtaagaacaaggtgtgtgagaatgctgcaaaaggcacagaggggaaggatggaaggtgagagaggccccctcgcaatcatcacaatcatctgtgacccaggccacatggaggcgctgagcagggagtaaaacagcccacgtgctgactcagctgaagacaccctggagaatcatggaatcaagccctggccccaatgcctccactttgcagacgggggcttgggctgcagagggcatggggctctctgtgagccggggctgactccagggcccggtcacagcaggaggtctggcctctcacacatccactgccgggactgggaacatcgcctaccttattctccccacaccggatgccgtccacggctgcatccagcttggagtgacaggtggtccccacagagcaccagagtgtgtggcagacattctgcgaggaggagggcatgggccatagcctcacctcctccccagtgccgccacccaccctgcccccctccctgtccccaagggtccctgggcacccctccacatggcaggggcccacagacccccagaggtcccttcttgtgtgtctgctcccaccttcctccccagaccacgtggtggtgtggggcgcccggggctgcactgctcagagtggtcctcagctgtccacacctctcccggcccagcgcctcctctggaaacactcctgttagaagatcacttcaggcgatcttcgccaggataaatagaccctccccacaggggttccttttccctcttatgagccagctccagagaggcgaagggacttgcccgaggggtcacagtcggtccatggttgacccagaattcagagctgggtctgtggccgcccatccctggcctctcccacaggccacttgacgtctcacagtgtcactcaggggcgtagcccagcccaggcgaggttgctcccaagctggcatccacaggctggtgaaagctgtcccctaagccctcctgtcgggtccccacacccccacacccacaccggccccactcacatccatgtcctcgcagaaggcagagtaggccccatactggaggtggcactggtggctcacatcatagaggaccccaggcagcactgatgggaagtcaatgatgtccttggcaggcgggtcatccaggcacaggctccacccatggctagagatgggacgggaggatggaggggggcgcagcctgtgagacccatcggagaagcctcggtgggaccaggagaggaggagaggtgggagggggcacagagccctacaactgtaggaaactccagcctccccgctcggctcagccgatcctccacctgcagccagtagcacaggccctcccagccaatctcatctcacctcctgggcactccagctggctaaacaaccccaaccccaatcccaggcctctgcacacgctgccagggcccttccctcagaaggcctcctggaccgccaaaccctcatgtggccctgctctccgaccctgcagcctccgtgtctgagcccagaccctggagccaggcccgacaaggatccggagaatatcacatcacagttgacacaacagagcctccgacggccccacccaggcagagacctcgggtcatctgtggaagggcaaggtctggaaagcagcccctcccctgggagagagcctagggcatccgtgcctgtcccctgtttcccccactccccaacagggctggcctccagcctctgtcataccctatctactcctgccttcctccagctggcattccctggcagcggtggcggggaaactggcagacacgagcaggtgccatctgtgtccaccacacgctcctgctgctgcggtgtggcgaagacaaggctgcccagaccaccacgaggcagcgagcgtggagtccggggccctggggagggcggcccaggcccagctggcacctgcttctgcccctgcctcactctgtacagccctcaggcatgctactgcttctgggaccagtgaccagcctgctgtacctgctggaccttaggcggccactacaacggcttagcagcaggagtgccctggcatgctgaccagcccacccacagctcattgctgtcctggaggaaggtttggggccctctgcggggcagcagtggctggggagaattgagccatgcagacatgcggggctggggatgacccaggcagccacgacttgggcagaagcatggaaggaggcaggacccatgggacctggggcctctagccaggcaggggagatggggaggcaaaatccctccagttctccagtctgggtggactcagggtaggtggtgccaggccagatggctgggatgagcatacagtcctgattgggacaggcagggggtcgcacagggaagaagggcaaaggtgatggatcctggagtccagcagggagagaaagagacactccgagatgtggagaggctgggagaacacgaaagggtcaggaaacagggccaagagtgctgaagacaggtgtggagagaggctaggagggtggatcagaccatggaatcccgaagcccagatttcagaggagggggcctggcagctgggagacccagggtggggtgggtggtctgtgtggtctcctaagtcccctggccagtgacaggcccctgactctgcccagagctgcggagaagaaagccaaggtgaccagacttctactgagaaccctggaatcctcctggaatcactcagactgcccatcatggctggaaacagatcctctaacatgggcgttggcagatgagcagctgctggatgcagtcctagtgcccaagatgaccacgtgccagactggtccagggtgctgggggcataccctctcatttgctcctcacaacatcctgggcagactctaccatcatcttccctcatgcactcagggcccatacgtcacttgtcccgggtcgcgcaagagggacgtgatggccaggacctggagccaggcccaggctgcctgcaccaggctgtgtctactcactgggctacccccagtgcagggctcctcccattcaactgcgagcctggcctcaaatacttcaccccacatacaagttcaaaaccatggcagcgaggcctggcagggagaaaggagtgtcccaagttctcctgcggcttggggctccctgagcctccctgggcctgcacccagggcagagtgtcagccgggggtggtggggtcagctggccctgggctccctccttcccgccatcattccgtggctcgaggaggtagactgggggctcacccatcccagccagggggtcctctgacccaggggctgaggggtccaatgcgcctcatcccggcaccaacagtccctgggctgcagccgagcccttttgtttcctggctgccccagtgctgactcgctgcacatgtggctcctgcaggcctgctgctgggcagctgaagccgcaacaacctctcagcccaccctggatgttgggagaagttgggagcataaggtgaccctcacagaatccactgccagaatcaggcccaggtgctgtcttgggagtcagaaactcaaggtggccgtcagccagcccttccttcctctggcaggctgactgccaggttctctgcactgccgacacacccggatcccccaaaccatcagcccttcccctccacgcccctccttaagctaactatagcagggctgggcagtcccacaagaggtcaaagcagacagtaggtgactccagtcagaagcttcactctcacctcaagactgcaaagagctgcccaccactgacaggagagacatgtgggcccgctcccctggccacccctgggatctggtcatggagtcactgcatggggtgtccatggggtgaagtgaaggaccccacatgttacctagcctgcctctctccctgtagaaatgctggctttgaggaaaccagggaccagggcctcccctcctccccacccaggtccaagttgacactggcgaaatgctgtgacctctccccaaggtcccataaagcacctgtcagcccagaaaggttcttagagttcttcaggtcaaccctcttggacaggccagtctaggttcttaaccaccaaacaaaactcttctctgcttccaatcccaccccccaccccagtaatccctcttccactggaggccagtatccttgctcttacatccctaatggacctggtcacatccctgcttaagccccacagtgagtggacttctagaaaaacatggcacattgagcagacagatttatcgctgcttccttccaagactccactataatgacagtagaggaaataaacaaggcataaatccataaggggtgatgatgagtaatgaaggatgtcaacaagattctggaagctgggaagcagatggccaggcagtagctgacttgctagagtgatgaaagctgagagtcagattcctgcaggggggaaccacccagaagcagaagcccgaaaaggctcaggaactgagtttgcagggactcctcagggccttagtgccaggagggctgaagacagtagggctgaaagtctgtaagaaccgatcagaccctagatcccctccccaaccctgagtagccaagtgacggccacctgccatccagcagagggccagggatcacttcctggagagggtgaaccaggaggctctggcccaggaacggtggacacacatgaaggcccaaggcagaaggacctacagagaaaaggggacaagcaaaagtctacacattgaagggtaagaaacacgccaagcccctttcccacttggatgctggaatgctgcagccagacatacactctcccaggaaaagtcgagaggattcctctcaggaaactgaatcactcagaaaaatgacctcagatagtgacattagaggatctccccaaaatagccccatctgaaccagtccttcagcagtgacttggaaaagtcctgcccaagtccacaaactgcccaattagtgtctctgcatctccttgctatatatgaaatacagccaatgcattttaagaaaacttttctttgagacagagtctctctcttttgcccaggctggagtacagtggcagaatcttggttcactgcagcctttccctcccgggttcaagcgattctcctgcctcagcctcctgagtagctgcaattacaggcatgagccaccatgcccagctaattttttgtattttttttagtagagacaggatttcaccatgttggtcaggctggtctcgaactcctgacctcaagagatctgcctgcctcggcctcccaaagtgctgggattacaggcgtgagccaccatgcctggccaagaaaactgttaacatgaaacaaatatatttttttaaataacccaaaggaaataaaaacatttcagggaacagaagaaaaaagtcaaatccgtgtaagtaataacctcacagagataagagaacacactgtacccacaaaacaggaataggatcaaaaggtgcacaggttgagtatctccaatcccaaaatccaaatgctccaaaatccaaaacttttgggcactaacatgatgctcagaggaaattctctttggagcacttcagattttggactttcagactggggattctgaactggtaagtataatggaaatactccaaaataataaaaaaaaaaaatccaaaatctaaaacacttctggtcccaagtatttcagatatgagacacgcaatgtgtatttagtgagtgagaaagttcaagaaattaaaagtacaatgaaaaaaatcaaaaatttaatagagggattgtaaagtaaagatgagtcagatacctcctagaaaatagagatggctaggcacggtggctaacgcttgtaatcccagaactatgggagactgagagaggattccaggagttcaagtccagcctaagcagcatggcaaaaccccatctctacagaaaaattaaaaaattagctgagtgtggtggcatacacctgtagtcccagctacttgggatgctgaggcaggaggatcatttgtgcctgggagctcgaggctgcagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagaggtgaattttcttatacacacattttaatgggctcgagcaaacatttttggactgaattcatagaagtagaatttctggaggaaaataatttttagggtttttaatagaaattttcaaatcattctccaggaaaagtgactcaggttatactcccaccaacaaggacagagctccagggtcccctttccatttgtcatctttcctgcctttatacagaaaatctcattgttttcatgacatttctttgatttcttgtgcttttgaatctttgtatatgccattggccatttttattcttgtgagaagtgccagtttctccattgcccattttcggttgaaaatcatttgtttttttttctcagtaattttaaagatttctttatagtctaaggatacaagccttttatctgtcattgaggtgacaaaactttctcccagtaagtaatttgtcatttcattttttcttcttttctttttcctttcctttccctttctttcttttccttgtttctttctttcttcttcttccttccttgctttccttttctttcttgctttccattcttactttcttttcttttccctccctccctccctctctttctttcctctttctttttctttctctctttttctttcttctttccctctctctctttcttcctttcctttctttctctttattccctccctccctccttcttcccttttttttcttgctttctttcactagccaagctccaaagtcacatttcacttaatttttatcctgccaaatttgaaagccttttaacttcgtgattttagtgtaaacaggagcaggagaaaatgtaattatctaagtctcgctgtgtcacccagactggagtgcagtgccataatcatagctactgcagccttgaactcctcgcctcaagcaattttcccacctcagcctgccaagtagctaggactacagctgtgtgccaccacacccagctaatgttcaaaaatttttgtggagatgtgaattctttatgctgcccaggctagtcttgaactcctgacttcaagtaatcctcccacctcggcttgccaaagtgctgggattacaggtgtcagctactgctcctgactgagagtttagttttgtttgctagtggtgttcttggtatcttttcatatttgaggttttgggctagtgctgaagtattacactcaccatccgaggtctacaggacttttggtttaatattgaacagatggaactgtttagttctgcatctttgcaggtatacagaatgtgcctaccaggaatctgctttatatccattgaaagcaagaaataatacagtaaaactttgcctggctagaggctttgaaagaatggcgtattctggtttaattctattactttggaagtataaaggtgaaaaaaattcaaaacttaaatttcctgttgaatgcaatttgaaaatatagccaatgattccacttttcttctctagtaaggttggacattctgatctacttggtgttttattatagaactgctagtgtgcgtgagtcttacattgtgaagatacttttttaaaacttgagatgtaagaggatgtaaacggttttgtaggagatcaggctggatgagaacggacacttgtaaacatactttttagactaaatctctgattgccgcttgtttttcttatggaactcatacaaataaaacacattggatggagggtgcgagtaggaaggagattcttgtcttttaattgcatgtcattgtttcataacaaggcagaacatatggtaaccctggctttggacctacagaaggaaacacatttttctacctgctgtatgccagaggttcttgaacacttggagggattactgcagcacagattgctgaaccctactccagagtttctgattcaccaggtccagggtggggcctgagaatttgcacttataaaaaggtctcaggtgctgctggtgctgctagtccatagactacattttgagaaccactcttgtctattaagtgtaaattgtagaactctagaaaaaagcttagttcagtctgggataagaagcacacaggttatggagaaaatcatgaaagattcaacccttgatcccagcctagtgtggatttcaggtaacaagcagtacacagtgacataacacaattcttggttttcatgattgcaagtcatagccaggtatcaagtgagaaattcagtttcatttgcaaggcctagagaggcctggtgattctagaaaaatgggccttgtatttgttttaaaccagtaaagagctttaagtgcttattaaattgtaagttttgtgttcctacttattttgtatcttattttattttattttatttcttttgagatggagtcttgctctgtcacccaggctggagtgcagtggcatgagcttggctcactgcaacctccatctcctgggttcaagtgattctcctgcctcagcctcccaaatagctgggattacaagcacccaccaccacacctggttagtttttgtatttttagtagagacagggtttcttcatgttggccaggctggtctcgaactcctgacctcaggtcatccacccacctcggcctcccaaagtgatggcattacaggggtgagccaccgcacctggcccaaaagctttgtgtttttaaagatattagacatgtttcttgtttttaaaagaaatcttaacaataatgtaggagaataagacaaacatttttccaaaaaagagaaattgttgtgattattctctgttattggaatgtcggatactatagtcagcttcattaatcatcaagaatgctatggattttccatttttatagggtctatatctcagttaaggtaatacttgtaattcttgtgctccatttgaagatgaaaaatataggccaaaatcatagactttgcatagaagctgcataatgaagacagctctggaggaacacatagatacacacagacacacatatataaagtatatacacatatattttttaaagtttatttttaacagttttaaagcttttaaagcaaaagccagcccctcccctctcccagagtgggcggcccctcccctctctctgagtgggcagggacagcggttgcatgggcagctttccttatgatgctacaggtccctctggacatgctgcgcctggccacgcctcctttccctttcatctttctcactgaccaatgggcttggaacattaaggccacgcccctattctgcgttccattggtgccctggttacgccacctgtggctcagttgcacagctgcctggtaggtgactggaggcattgagcagtgctcactggtatttcgctgatgtggccccaaccccacctccctccccaccccgcgatgtcagaaaaaacacaacaggggaaattggccgcagccaagaaaaaggtaaaacacaccaggtcatggcccccaacccagccacagatcccctccgatgacaagaccggtgccagagtccataccactcctgaggcataccagatggggccccccaaccccagcccctctgggctcccccaaccaaagcctagtcagtcagccccaccccttcagcaagcagcccagtccctgcccttgccaatcaccccagggtgactttgggcaggtgactcctggggctccctgctccataatcagccctcacctcctgccaccccaagcccaacctccctgggctctttgggcttgcgtctcccaggacctgggtcccccagccccaggccctgccctcaccagtcatccctgggtggctttgggctggtgactcccggggctccctactgcagactctgccctcccctcctgctgccccaagctcgacctccctaggcttcttgggctggcgtctctgaggacctgggtcgaaaccgtgtgtttccctcccccatcgtggagcagcgactcgggcatcgcgctgatgtggtcccctcccctgggaggagtggaatgcaatgatgtcacagtgcccctaggaactgtcattactgctgcaagaccagcctttgatcttacaacccagtcccctaagttttctcaccccatttctggttcctctggttgcagcacaaatttccagctggaaggggagtggagactatgggacctaggagcaagaggtttcaggctgccttactcccttaacatagacattgacagtgggaaaagcctacacttcccctgtgagctcaaaatgttcacagtatctctgggtggcaatgggagaatgggtttggtttggttttttcccaggcttctactttccagagagactttaacatttttttctgagttctccacggttctgggaccagactgcccttcagtcagtggcctctgaagtgagatttgctcatcttctgtggaatagatcttgggaaactgaacttgacagcttgaatcttcctcatatcgtctcaacctggggtactttgagtgccacaggataaatgcgggacatctttctgaagcatcattttcccttgattctcttgagaaaatgcattaatgtacttagggatgacagacacataggtttccaagcgtataccagacttcgctctgaaatgaggcttgggttgtcctctttctgataaattcccagatttaatagaaaagctgccttctgccatgaggacacattgatatgaaagtgtgagaggtactggtacgcttcttcacgctagcagacctgtgaggatgtatgactctaaaccacacggcctacagttcctgcctgcttaatgtgtgcttttctacctctgcccctggttttggtccctggaagctgctgattcatggcaaaaccccagagcttggagtcagaggactgagtttaagttccagtattgccttttttgatctttctttttttttttttctatccatgatatcagtccctctcagtcactaagtgattgtgacaacaccttgtacagttgttggtggcattacatcagatggtatataagggtattttgtcaaaactgtaaaggaggatgtggctgtaggggctgatcattctcatgagtgttaccgctcttctttcccacagttaaaagcatattggcagaggaagagccctggcattccagcaggagctaacaggaaaaagaaaatcaatggcagtagccctgacacattcatttctggtggttaccactcacctggggatgtgagtctcggcgggccaggctcctggggacagggagcccaaggggcagtagagggtaattgttaagattgtagatggactgttgggtactggttaagaattctggatttgaatcctgcctctccgtctgctaagaattgattagggattgattagcatatgatttagggcaagttgcttgaggtctttgggcctctcttttcacatctgtataatagaggtggtattttttgacttccatttgtgaagtttaaatgagattcgttattgttgcttttatgtgaatccttagtacatggcctgctgcaaacacccaggacaccgaggaaatggtcgttgctgtttgattttcctcatccccagtctcaaggggaagccaggccaatgagaagagccacttgccatcaggctgtccctttaggagtcactgaaagggccccagggtgggatggtggggagataagaaccacgagagaagttggcacaaaggagttatgggaaaaaggttccaagataggcagaaaagaagcttttgccagttgatgggggaagaaaggaagtcagagggcttagacagtgaggggggacagaacatctccatgtgcactctcatctcttggagtcagcaacaggtatctacggggagggccgtgcatcctctactaccctgcaggatctggaggtaagaggccctgggccgaggtgcagtgaccctgcaggccagccctccaacctcctcccacagcaggggcttgttgcccctctgccagctgaggcagcccacacacccccaccagccctaatgattattctctctacccctccccacaatcttcctccaactccttctctctgcatgcacctcagagccagtaccaagaactagcagtagccctggattcaagctccgcaataatcagtcaactcactgaaaacatcaattcactggtaagagtccagtggggtcccctgattacagctggtcaatcctggactccagtttcctcttggggccctgaagaaaggggctaggggcccctgatgccaagggcaaatggggagctgggcacccaggtctcacctggagggaccccagagcacagaacatgcagcatggctcttctgcactgccctctttgctgactctctcttctccagacacccctgctctagtccttgccacacatgccctggggttgtcacctctctgggaagcactagcctgactggttgtcagaggtccatattcctgccctgcctcagtccctaatttgctttttgagtctggacaagccatctctcctctttatgctcgtgtttctggaggaggtagagagtatcaaaggtctcggttagctctgaaagtcagagatttaaaggcccctagaatggaaagctcagggcgaagggctcctgtctgtcctttgctgttttatatctctgctatgaagaactgtacctggcctgtacatgctcagtaaatgtttgttgaatgaatgcacgtttctaaatcacaaactggcagaaggggggtgggcctttctcaaactctgtctctggacgttcaccagcccctccctccaggacccttttccccctttgctttgggtaggttcgcacatctaaggaggagaagaagcatgagatacatctggtacagaagcttgggaggagcttgttcaaactcaaaaaccagacgggtaagatggggctggcatgacctggcagctggactggcattagagggctgtgggggtgacttagaatgccccagggaggtgggtggatggaagggctttgaggcagagggaaagaggtctgtgccaggggaggacaagtcttgtcatctccatgagcctcagtgtccccatcagtaaagagggaggagtgcccattgtcagccacccacagtgctctctatctgaaagtgacttggaagattgtctaccatccgggtgtgaggagtcattagcagtgaggccaagtttgggaagcctgagaggaggagctgtgcaccaaagggaggattttttttttttttttgagaatccagaggcccttattctctgcttgctttctcagctgaacccctggccccacagcccccagcagggccatctaaggtggagcagctacaagatgagaccaaccacctaaggaaggagctagagagtgtgggaagacagctccaggctgaggtggaaaacaatcagatgttgagtctcctgaacaggagacaggaggagaggctacgtgaacaggaggagaggctacgtgaacaggaggagaggctgtgtgaacaggaggagaggctgtgtgaacaggaggagaggctacgtgaacaggaggagaggctgtgtgaacaggagaagctgccagggcaggagaggctgctggaagaggtggagaagctgttagaacaggagaggcggcaggaggagcaggagaggctgctggagagggagaggctgctggacgaggtggaggagctcctggagcaggagaggcttcggcaacaggatgagaggctgtggcagcaggagactctgcgggagctggagaggctgcgggagctggagaggctgcgggagctggagaggatgctggagctggggtgggaagccctgtacgagcagcgggccgagccacgcagcggcttcgaggagctggtgcgttgccccacctggggaggctgccctcttccctagccctcaaggcctttgtttccccacctgtaaaatggggcattgtagccttcacatgaaatggtacttctaaaggcatctgtgagccagagccctgctctgatggctgtgggagagaggggatatttttctaacctgcctccacccttcccggtgccatgggaggcagacactaagttctggggtctccagttttagtgggtggccactgattgcttctttctgtccagaacaacgagaacaagagcacactgcagttggagcagcaagtaaaggagctggagaagtcgggtgagctgaaagagactgtaacctccgacccatccaagaagatgtgggaggcgggcaccagcctctggggaggggaggtgccaggccacaggcagctgcagcctggggacaggtgaccccagcaccctccggggcagtcctatgactgtttcttgcttcctgccctctgacttttagaggtgggtagccctggggtcctcccaggtctggacatcatcatcccagctagaggcatggagccccccaatcacagaggaagagacagtggtataagaggctccttatgtcgggtgtggtggctcacgcctgcaatcccagcactttgggaggctgaggcaggacaatcacttgaggtcaggagtttgagaccaacatggccaacatggtgaaagctcatctctactaaaattaaaaataataataataattagccaggcctggtggtgcatgcctgtaatcccagctactcaggaggctgagacacgagaatcacttgagcccgggagatgaaggttgcagtgagctgagattgcaccactgcactgcagcctgggacacagagtgacactctctcaaaacaaaacaaaacagaaaaacaaaaaagactccttagattcaaactggattccggcctcggttccactggtcataattcaactactttgcatctctaagtctctgtttctttaacttcaaaaggaagttagccttttccttgcagaggtgctgaggattaaatgagataatacgtggaaacattaggcatgtagcacacttagcagatggtggttggctccgcctgcttttccaccagtctgtggcctacagtttacatgctgggaaaaaggacgtgagatttgatgctagggaaggaggcatggggttctaagcaagggagacagtctcttaggcctggagcaaggggccaggggcctgggcaggccacagagccccacagtgccctcgctaccctattaatgggccaggaatctggaagccagccaccacatgtcctcatgcccagggtcttccggcaggtggagctgaagagccaagaggctccgagtctgcagcagcagccagaccagtacctggagccccattcccacaaggagcttggatgtgcggacaagcagggtggtgagtagagccctcaggcggggtgggcaggcaggagcaggggaggctcgcactgtgcccagattcccaccccctccctctctctgaagatcttagtgagctgagcctcactgatagcatggaggctgcaccgggagaggacagggagggttctcccccatgacaaccccactgcacagcagatccagcagctgcttcctctaatgcaggactccccaggagcacccaggcttgagtggagaagctgttggtacaggagaggcggcaggaggagcaggagaggctgcatgccattcttttcgggctgccgagaacagggagctaaacatcaccatcatctaagagcgggtcaagaaattgaaaaaaaaaaaaacaaaacatttaaggggttaatatcctacacaattcatttacttcatttgaatgttagagccacttatgtttgtgtttctaatttatagtttaaatttatttgtgtttctaatttatagtttaaatttatttgtttctaatttatagtttaaatttatttgtgtttctaatttatagtttaaatttatttttgtttctaatttataatttaaatttatttgtaaaaagttaaatgagagtgggtctttctctcatgttcactctggcatcttttagcatttttttaatttgataattataggacgttagcatgcatatcgagtttgcccttatgtggtgggagttcaaacacacaaagacccactgtatgcacacaactgttcttgctggtttgggataggctgccatgcttttttaatgttagtacagcctgtatattcattacggaattcagataaaatttccttatgttctgctgttatgtttgatcgaatcctaatcacagtgagctcttcattagctcaatatgtggtttgccctctggaaacagcctttccccctttttctgtgtattggggatgggagtaataacattttggggaggtttttaaatctcccagaagaggaaagtggcctgctttggcaggtgtgtgcaggatagaatatgtttcatttgttccggtgccaagaatgagcgctgtactacggtagttcccttaggatttgtatgtgctctaggctcatgaagatactgcctcatgagctgtggcagttgtactcttttttgatgacctgaaaagggattatttctgaggaatgaaaggctcccatcatgactgtggatgtggaaaaccttttctagctgagagcatttatatctacaatacattttaaagtcagagttcatgttccctgttttaatcacatgactacatgtcccagtacacaaaagggcactggttggcgttctccttaatgtatttagtaaagatcagaagaaatcctttaagagtttaaatgcccctggaacaggcatatacaggctctagtcaagaatgaattcgagtgaaggaaagctgtgtgacacctggcattcctctgtgttcatggagcttatttgaggctagaagatggattttaccatctagacctctctggctaatagctagtcttcaaccatctgacataggaatttacttcttttccttgaatggagaacactttaaaaataataacaaacattattataaactaatatatgtgagagtacttagttgaaacaaaaaggagttttagtagacagtattatactacatttgaaaatcaaggagcagtttatgcaacgtaaaacgtttacaaactgcagcacaatctactgttcgtgaatgtcaaagtgtcatgaggaaagtgtctatacaatcacagagttatatttcctcacaaagttctttacaaagagtgaaatatgtttttatacctctcagtttcagttagaggcatattttgtgtaatatttatggcttaaaatggactaaaggtcctgttcttgccttgtctgaacttgccgcttttgcattctttgagttcagtttaaagacagttactttaagcccattttaaaccctcaggctagaaatcgtaccactgttaattagccacattatttggtctaacagtttttgtttatcattctgaaactgagcttacctaatacattgataaattatttcaaaggtatttttatagttcaaatcgcttcacttttaccctgacacgtataaatgactaggaatgaccttcagatagcgtttagcaactgtaaccaatctgacaataatgtgttcatcaggtacctgtggattaaatcacatactggcatatttaagctgaatgtcagtctgaaaaataaatgtactatattaactcaaataccactctctgtgtaggtattttgtcatatgtttaagaaaaagctaaagagaatggaaatcctatgacaataactatgacaataactatgacaagtctttcttcaaagtgcatgcagtcttttgcagtacctcattcagccaagtatttgttctctacctcattcagtataaggcagcctttaatttgcttagaaggcaacattagaaggttagagttcagcaggaacatagaattttaaaatgtgacttcaactgaataaatttgaatttctgtagggagtaaagaatcaaaacacctatttaaagactgcaaaatatgataattatttttaaagtaattgattaaacctggtaggttttcccaaaatgaaaaacaatcagttctaaaaccaaagctgatttttagaaaatgtgaaaatgtaaatcaaccctatccataacagattctctaaaactttatcttacagtcactttcaaataactattcaaaaatgtaactgctatattaacgtcttaaaataatttaaaacattttaaaatatgaatactgtagtttaaaacaaagaatctaggggaaggaaaagtagacaaagaaatgccaattccagtccaaagctgtatttgccaagttttcttagaatgacttttaccgatttatgaattcttatacacagaatgcataatggaaatactgatttttgtctaaagtggcattattgactgctgctgtgatgctactataatgtaatacattattaaattgtttcaaggtgctgttttgcctaaaaattttgtgtgtcttgaaaactatagtactgggtattgagaccctgcaaattctcggcatgcttggcatgaggtaatcggtttttattcttacaaaattgtaactatgtaagtgtgtttattaaaagaacacaaactaaaaaagttaacaggaattaaagttgtgggatgaaaaagttacaggataaaaaaatactgtggaaaagtggcaaaaaaaagttgtggaaaaaaagtaaaaaaaaagttttatgaaaagttattttaaaaagttatgaaaaattagttacaggatttaaaaaaagtcatgggataaaaataaaaataaataaaagcaggcccctgtcagcataagcctggagaagtgggtctggagtcttcacccccaccatgtccctacaacccctccccagtcagccctttaccattagggtagcaagacaagacccttgtctaatggagggagacaaacagaccctttaccaccttgaccaaggctgagtccttacatttctggatgatgatgtttgttatttaagagccagaggttggtggagttggtttgtttggaggaggtctgacggccttcttactctcaccaaagcaacttttccctcaggggggctcccatcttcttactcagagaggcagctgaggcgggacagtggagttaactgtagaccaggccagggcacaggctgctggggttggccccccttcccccgtgtacatactgtagctgtgtaacattctgtattgtacctagcggaggttgcagctggcatatgaggaagaggttcttataattattcgcggctgggaaacttatttattgctagcataggagcgaggaaggaggcggggatggggtcatggctccctggtgatgggactcctgtttttttttttttttttgcttttgattttggaataaatggatttagccatactgctcggcctggtatgttcccatttccctcactgggtcctgcagtttgtcccactgaatgaggagccccagagtgtctcagcatgtccagctgggctgttggggaccttccaggcctgttacctgtatgctgcctggtgacacctggtggattttatggggactgccatggcgcctacggagtacactctggccctgacagccaactggttgagaagcctgatctagctgtggcagggaagacagataccagtgcccaagggcactgacttccatccaccccacgtgtcttccattccgtccccctgcctccctctcctgtctgcaccgggtggcctgtctgtccctccagagtgccggctgccccgcaggttccctccaggctgagttcagggccctgcccctagtggccagagctggcttcacagggtaagagccagctaagctccagggactttccaggaaaagtgtcccttgaaaagggtgtgaccttttcactgctcccaacaacaccctaaaaatggcttggccttttccatcccctgagctccatagagaacacagccagcagaggacacattctctgtcatccagaaatgggtttctcagtcaagggacagcaggactggtagagactgtcaggccacacagctgcctgcacagcaccgccatgcttggccagaagggcgggagggatggcgggggctggctgtccacaggccgcgcatgtcccggaagctcactggaggtggtgcactttggaggggcgatgtcaggagacagcttcctcttgctggtctacaagactccacaagcacagcacggggactgattcccagtgctagaggtgaggcagttggccacgtgtatatatgtatatgtgtgtgtgtgtgtgtgtgtgtgtgtgagagagagaatttatagctatttatagaacagggcaggggcataccacagagggggcacaagtttcagcaatggtcacacctggacgtgtcagctcaccgctacaacagactaagtcacagaagaagggggctggctttggagctgggggagccactgtcaagtcacaggacacccgcccaggcaggcttggaaagggaggtctctgagaagagggatctgtttagaggtcgaagtggggcctggggctctcaggatgggatggacttgcctgacccgatcagctggcagttggagagaaagcagagagaaaacgggttagagaaaagccagagctggtgaggcaagtgcagagtatgggtgcgctgcagcagctgtggagggccggggaggggagggcgtaggtgtgggcatggcaaggttcctggaaaagaggggctggaagggaaaggggaggaagatggagggagaagccggagcttcataggtagtgcctggggactgcggcggccctccctaccccacacacgctggcctgtctcatggaacccaggcaatccacccatccacccacagttcagaccaatgccacctccctcgggcttccctcttctgtggtccccatgtcttccaacccactggcccagggccacctcttgcttggagagccccatccaacagccaccagacctgatagagaaggaacactgattgaaccaaaatggtggagctataagggatggctggctggagtgaatgccagaggcccctctgggccatcagaaagcccagggtcctctgagggaccctggggaaggcagggagggcaggtagccggatgccattggccatagacttctaattctaacaggggagcctcaactggttggcggggggctgcaggttacataggtgaggctgggcccttcctgctgggaaaagcagaagagggagactccgcggcaggaaagggaagtgagctctctaggtggagctcagctgggccagcagcactattggctgaatagcacaggcgacccctagaagcaacaggccaaggtgcgtgagcctgctggccagcagtagtgcttcagcaggggccagggaccctgccttcagtcgcacgctagcagctatcatggtacctgggagggagggaagggggctgtgtgtccttccatggcctatgaagtgtgttgtgggatgaccgcgtgtataggactctcaggcttttatcctagatcaccactggattgctgacagatagaggacgtgggaccgtgactatcacccctaatctgcagtggatttggctcttggcactcccaggctgggagctggatacctgccctggcagcatgactcagactgcatgacaggtacggcgtgtccaggatgatgtgcccaggcctctggccgcctgagtccagccccccacacaaccccctccaagctcccagcccctacaccataaaccatgagctctgtgccctctctgatggttccacatctgccaccttgggcatggagcctgttgtaagagcccccaggctcagccatggagaccttgagcagtggcactgagtcccgtggctcacagggagcaaagtgagacagccagcagcacaaggacagaaagaggaaagagcaagtctgcagctccagaagggaggggcagggagcctggctctgaggctccaggtatgccccctgtgtggagctggggcagcggggcaggcagaccattcatgcagcaggcagtgaggcatgtacctaccatggctgatgctcctcaggggccactgatagtgattctgaaagacagcttcaaatcacatggcaggtcacatgcatgggtggggcaggcctgggggtgggggacacacacacgcacatgccggagtgtgcacacacatgctgtgaggccccacggcccacatgcacacgctaacacacatgcccacaaacaacacgcatacgtcgccctccccgccacctcccaatgcccagcaccctcaccggccggcacgtgccacatggatctggggcgtgcagccacacggcacactgaagcacatgcgtgggcagagtcacaacacagatgctcacctgcacacagaggcatttgcaccagctccctgcacactcgtgcctggcgtgctcagaggaccacccatgctgctcacggagacagggcttgctcactaatgtccggctgtcatttctccacctcagagccttccatggctccctactgcctacagcgttgaatcccaacaagtcatactctttggactttgaaggttctccaccctgtgccccaccctccccacagagctcttcctcattctgtctctgttccctgctttggccagtggctatccgcgatgtgacccacactacacctctgcccacactgcagctctttacccagttaccctccagttcctcaccatgtatgcctacctcagtcatgccccagactgcattgaagccaggctgccttgaagaagctctcccagactgcccttttccccaaggcagggtcatgatttaccaaaggtttcgtgtgtgttagcaagactggagtcggagcaggcatcaaactttacatcccatatgtcacacctcaccatagatctgggtgccaaatagcctgaagagtctgaactcacgctggaagttagcaaagtgctcctacagccgcatctgcagttaacatagtatccctatggccactgtctcccttgatccccacagccatcctaggagaaaggcagaacgtcatttgctagaagggatgctgaggctctgggagggaaagggacttgcctaaagccccagggtgaagcagcatctctggactctcatagacagcctagagctgccagcattcccttaggatctgtgccctcaggcctggcttaattttttcctctgcaaagagccatctgtagggccagaggctggcaaagcctgactcattactggatgccagttcctttgcctgactttcagtgatttctaccttaccctggggttttatgttgcttgtctcaacactgtcacttctcattcctccacaagttgaattgctcactccagccacttgaagcatgctcttcttaacacagttagctctaggcacatggttggtgctaaaaaggaaaaaaaaaagaagagcattatgtcaatttcattgattaacaaaagcgatggctccactgcaaagcaaagttgatactcctgggcctctgagttcaagagccttttagacaaatggctctgagctaaaacatgatcatgcatgcatatgcatctgtcttggtctgatgagataatctggatacttgcttgttatccttgagcattttcctgcctcattaatgtatgtgtagccaccacaataataatcatagctaataatggctacagctgagggctttcctgaaccaggcagtggttttaaaaactttaacccctaaagctgaggactttcctaagctagatagtggctttgaaaactttaaagttttcacatagactgtcattgaataatttctgtttttcagatcaagaaactgagacttactatcatatttgggattaagctaaaaaaaaaaaaaaaagaaaagaaacagaggctgaacgctgtcaagtatttcacagccagcaggaaatcggaacttgaacccaggcagtctagccctgggatcctttccccttacccattatccagtgttggctacacaaaactaatgagtacatattttcaactatagtttaagtgggtgacatatttttcactatattttatgtaggtgactttcagtttgggggtattctacttacacaatctattgagctggatattaactgagagcaaacagaaactaatgaactctgaaaaacataaaacatgagcaacatgacgtcactgcaagagacaaaacagcacatagccttcttgtgactgtattttgctgacagtccatgagctgatagcctgaactcagcagtgctgttcccttgggagacacacacacacacacacacacacacacacacacacacacgagttggtggttttctgccccccacccccaccccaacacacacacgagttggtggttgtgctgcccggagcctccagtccgcgagtgtgaagaacggaccagatgggtccagcagtgctgggtcaaggcgaggagggggcagccggaagcgcgcgcatgctctggactcctgcagccgccgaaacgggtgcgcagggggcgcgcgggttgaggggagaggggcgacgggtgtgaggggcgagagggacgggagcggggtaggggcagccctttcccaggcggtagcggggactgtggtgctgttgcccttttaagctgcggcttgacaggagcagcgtctcctgtcggtggagtctgttacaaggggagcagccgcccaggccgccacacagctccccgcagaggcctcggtgccccttgccattttccagccctactccgaatagagttgaggcatcagggagaggcggagctgggagagcgccgccgagaggtcccgcgggtggttgcggccgtgacagcggctcccgacgggctcaccttccgcgcccctcccgccagaggtgagagtaaaatgtccgtgtgagggttcaaggccaagctgaggttgttggcctctatcttccacaagaaccaggagccgccgccgcagctcacgctccactgcaacatcacggtgaggcgcccagtggcggcctcacggggcagggcgagggcggagaggaggcgcccagagtcccgggacaaaggggagcctgcccgggagaggccccggttccccaggcggggcgagcgcgcccctttctcccgcgtctggcccgccccgctgtgtgaggcttgcgtgggaggagggggagggcgcgtctctctggctccttgccgcggggctggcttgggggctgccggcacctctcgccccagtcgctgcgccctgaggtgggagcccgcgtcgcccgcagaccttttggggcccatgatcgccctcagtcagctagcctgctcccctggaccgcgacggggcgtggcagggcggctcccgctgttgtttgagcccagtgagggaaggggaaaggcctttaagattttcggttttttggccgggcgcagtgctcattcctgtaatcccagcactatgggagactgaggcagctggatctcctgaggtcaggagttctagaccagcctggccaacatggtaaaaccctgtctctactaaaaatacaaaaattagccgggcatggtggcaggcgcttcttgagatggagtctcactctgtcgcccaggctggagtgcagtggagcgatctcggcatactgcagcctccatctcttgacagtctgtcggttcaagcgattctcctgcctcagcctcccgagcagctgggattacgggcgcccgccaccacgcctggctaagttttgtgttgtttagtagagatggggtttcatcatgttggccaggctggtctcgaactcctgacctcaaatgacccatctctgcctcccagagttctgggattacaggcctgagccaccgcgcccagatccaaggcccttaagcttaaatgcctcgttcttcagtcaggttttccttgttcccgcatgttcagccaatcgtgtttaaggagaaactaacaatgaaaacggactcgttgatggaggaaaagttggaatgcagcctctggtgctgtttgagcgatccctctaccccgggtcgctgctgtgttctggaaaggcgcattgtaccctggatgcagcaggtaagagtcctgtccaggtgctctgcccgcttttcctttcaggcttctgtatcagctgtttttcccctgtagaatgtgcccctgacagccaccccctaaccctacccaatttgtctttacgtgtctgaccatcaaggctcttctgggtcatatttaattcatgctgatatttccccttcctcccctctttagtcctatttttgctttggttatgttatgctatattctgtaaggctttaaaaaaatttttatggtggcaggggagaatgttttataattatgctttgtgctttttatcttccactcaataaatgcttggtaaatatttgttttattgaatgtatgaccctattctagctatattgtgcttgaacaaaaaccttaactgcctagtaagttaactgctaagaatttgtcagaagtgcagacataacatcaagaacttgtcatggatagtgcaaaaacgtcacttaagggcttggtggaagcctgtaaattgacttcctatgaaagagagtgtaagaagtgaaaatgtaaagcatgactggagagccagagtgatgaagccagggtccctttctccagatcctttgtaacagtgttatgtgatctcttctagaagatcgttctgaaagataatgccaactcggaacctaggaaaccatccagtgggtttctgcagcttaggtgtttcaaatcctcatcagcacgtttgttttctctgcctcagtttgcttacaatgatgttctcagtagctacaattgctgtctttgaatacgtaagcatttttttttaggtgacagggatatatgtgcatttttattttaccaagtgttagaattttgactctgcttttgtgggctctgggttagctacttggttgttgtaaaatgattagcagggaaagctgtgtgtgtgtgtgtatgtgtgtgtgttataagtttcttttgttgtcagaggacttagaattttattttatatggtaattctgtcaatttactttattctccaccccacatttattgaacagcaaattatgaaagtaatgtgtcccataagcagccttcagaagaattacaactgctgtatatctgaaattcttttttttattttttattttgagatggagtctcactctatcacccaagctggagtacagtggtgcaatcttggctcactggaacctctgctgcccaggttcaagcaattctcctgcctcagcctcctgagtggctgggattacaggcacctgccaccacacctggctaatttttgtagctttagtagagacaggtttcaccatgttggccaggctggtcttgaattcctgacctcgtgatctgcctgcctcagcctcccaaagtgctgggattacaggtgtgagctaccgcacctggctgaactttcaaggagaagtttgtgcatcagttttcaaaaaattatgatatcaaaagatagctgtgccctacatttggaaagatacaaaaactgaacatactggcaggcagttttgcttgctggtgcttgagatagaggcacacattggtctcagtggaattatggagaaaaatagataaagttatttctaaataagaccaaaaaatccttttcttaagcagtgacaggtaaagaggttgtcttggctaaccttgaattgtgttgcccttgattgagacagttttatggtgggatggtagtggtgataaacttgctggaaatttgtctgcttatagtaacctttgtggtagctgtcacagacaacttcatcctcacaggccttgaaattagtataaaactaacagaatggaggagaaacaaaggatctgaataattagatgcttagataattgttctgtgttttcattactggtgaaaaagagcagtattagaagcacttacacattctatagaaggaacactgcctgaatttatattgcgatttttgagcaccattaactgtataaaaacaggcatattgtaggtaatattttaaagacaaacagaaaatttatcttttcaagatggatctaaaacttatcaaaattacaaaatttaaaacgtgattgaaaaatattaatgcataggtttaaatattggtcattttaaatgtctttcaaaatagattgtctcttaaatattcaactgaacaaactttgaacatgttgtagagtttgtgccgaaggttaaatttcctggggtgatggatattttgtaatatggaaaacaaaaccttcttattttaagaaatttagaaaacttttaggcaaaactagaaaatattacctatgtaattctaccactcagaaggtgccactgtcagaaatttgtatctttccagtcatctgctcacctcttttctcctgtgcttgtgtatgtttcctctcccttaaaaatcagatatttgtttgtaatctgctttttcactcaacagtattgtagatccatgttataacttactcctctacattgccttcagttattgtgtgctttctgttggatgactttaccatgtagtcagtcatgttttctggtactgaatacatacgggtatgtgtgtgtgtgcgtgcgcgtgtgtgtgcgtatttttttgtaacttaactaatgctttagacatcagtaggtagacgtaaatccttgaaaccttccacgtggtgactttcagttctcattgctgaatttgtttccagagatggaagaaattatattgtatgggaactttttttttcttttttctttttttttttttttgagatgaagtcttgttcttgtcacccaggctggagtgcaatggcgtgatctcactgcaacctccacctcctgggttcaagcaattctcctgcctcagcctcccgagtagctgagattacaggcgcatgccaccatgcctggctaatttttgtatttttagtagaaacggagtttcaccatgttggccaggctggtcttgaactcctgacctcaggtgatttgcccacttcagcctcccaaagtgttgggaatacaggtgtgagccgctgtgcccagcctttttttcatctcagtaccagcttttatttatcagattggtaaaaatgttagaaagtgtgcaatgaaatgggcattcttacagtcatggcaaaaaatataattatctttgactttctagaaagtagtttggctttctagaaacttgtttgaattctccctgtttaggcaggatgaattctcactaccccaaggtggccaaccttgtccctgtgattccatctctcccagaaagagaggtctagtctcagggaaaacccagatttgtttggcttagcccatctgacagctaatcactggaaatggggtaggctggtagaatgctttggtcaggttttgtgttgagagagaggtggaaagatgggagggaggtagcaaaacttgcctcagtggaactatgtaagttaatatagaatggcaaagggatgtttcttccaaggaagaaattctagagaaggaagaaagtggaggggaaggcagcagttctccaagttttggggtcaggattcctttacactcttaaaaatacattgaggtcccaaggagctttggtttatgtagggtatatctattggtatttatcactagaaattaaatcagaaatatttaaaatattgtttaaaagctcaccacatattgttataaatgcttttatgaaaagaaaatttctaaacccaaagtagtacagtcttacatcttttgcaaattattttgatgtttgatatgtcatttgcatgatgtttgatatgtcattagcaaattgatatgtcagtttgcttctgcattcaatttattgtgtgatattttcttgaaaaaatgtgaacaaaggccaatctcatacagataaccattttagatcattgtggatatatatatatttttcgagatgaggtcttgccctgttgcccaggctggaaggtagtggtatgatcatagctcactgcagcctcagtctccagggactcaggtgatcctcccacctcagcctccagagtagctgggactacaggtgtgtaccaccatacttggctaactttttgtattttttgtagagacagggttttgccatgttgcctaggcttcttttttgatactccatcaaatcttggtttttcttgaactttggatcttccacccttgcatgatattacaacatcgtgcattggtcacttataaaacagtggttcactaagatcttctacatgttgatacatttgtacagtatcaaaatacattcatcagtaccaccatcaatctcatcagaatacttttggaaagcgatggtgggcataagttttctaaaattctaattttttgttcaaaagcttgaattttattagtaattttgttattgaattttattatagcctgtctgttgttttccttgaaatgacagaatctcatgttttgagaaaatatctgccagaaatgcgagttaaaataacattttttgtcagtcagcctttcaagtaaaaatggtattccattaaagtggttaattcacttcatgacttagccactcaagggtttttcctcaggcagcctgtaggaatgctcatgtatacttcccatttcatcacttgaaatattaaaaagatatattcaatgatttagatatagtaaaatattcactgcttcatcatagacattcttttttttttttttaattttcgagacagggccttgttctgtcacccaggctggagtgcagtagcgtgatcacagctcactgcagcctcaactttctgggttcagtcaatcctcctgcctcagccttccaagacgctgggactacaggcatgcagccactgtgttcagctaatttttgtattttttgtaaagatgaggtttcaccaggttgcccaggcaggtcttgaactcccgggctcaagggatccccctgcctggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgaagtattttttcaggtatttcagcaaaaattaaatacctaggaataaacttagatgtgcaggacttttatcaaggacaggacaaaattttgctgagtggaatgaaagatttgcattctatgttcctggatgagcagatttcatgttataaatatgttagttatcaccatgtcttcatattaatttgtaaatgtaatttctgctgggcacagtggctcatacctgtaatccaaacagtttgggaagctgaggcgggtagatgacaattagctgggtgtctgtggcacacacttgtatttccaactacttctgaggctgaggtgggaggagcacttgagcctgggaggcagaggttgcagtgagccgagatcatgcctctgaactccagcctaggtgacagagtgagaccctgtctcaaaaaaaaaaaaaaaaaaaaaaaaaaactagaaaagtgtgtgtgtatatatatatatttcatattttataaatatttatatatataaattgtatatatacattttatattttatatatagtgtgtgtgtattatatatatacacacacacacacaaatttcagtacaaattctggcagatttatttttgacacttgacaaaacgactctaaaatttgtttagaagaataagtaataaaaattaataaagtatagacgctttcaaccagatagtaaataaaatattgtggactatccctgggccggacagataaaggcaatggaagtttagaaccagagtcatgcaaacgagaatttagtataaggaaaaggtggtattttaacttaatactgaaaagatagattattctgtaaatggttttaggagaactatttgaggaagtctgagtcttaactccaatttttgtcaaaataagttagttggtttaaacacatctattcttaaaaattagaacagaagaatattggtttgaagatattttaagagttaaggctgaggctgggcacagtggttcacgcctgtaatcccagcactttgcgaggccaaggtgggaggattgcttgagcccaggagtttgagatcagcctgggcaacatagcaagactctttctctctctctctctctcgatatagatatacatataaatatacgtatacaaatagaaaaaaaaaagagttaagttttatatggagagccatgaagataagaggtaaaaattaaaggcttgatggacacatgtttacatctccatcaagggggttgatgggaaagaatgatagacatagctccattactgctacctccttttaggaagttgcttctgaacatctaaagatatcagttttataatagaaatgagttatttttcagtgtctaaaacaccacatgagatacatacatacatgcatacatacataaatatgttcataaagttaaatgaaataggatataaaattgggcctagtgtttaaaaggtaaatatatttacatgaaggagaaaacaactcacctcccactcttagagcctctgccagtttatcatagcctagtttcttgagagaataagctacatgtcttcaccttttttcactgagctcattatactctggattctgccttcatcgttgcactaaaatttatctcctagttgtcaaatccagtggctcccctcttagtccccaaattgacccctctgcagtattttgatactgttgattgttcctttgttgaaacattcctccattcttaatgtccaccaataaagagttggttaaataaaaattatagtgtaccgttttataatattctgttgttctgttgtggaccaaaaaatgcagccagtctttccataagagcacgtgcaaacttctaagatatattaagtaaaaaagtaaggcataaaatattgtgtataatctgacccctttagtacacagtgtaaaaacatctgtgtctgtgcttctttatacttacttttttctcccctggtgaatacaggaaactgtgaatagtacaacacaattaaaaaaaaaaaaaactgtgtgtctgctgcaccaggacctgtgataattgggtataaaagacaaaaaagacatgtccctgtcctctgggaagggacatgataatcaaatgagacttctgtcggattcttttctcctgttttgatcttatcaccctttcttggtctcctccgatctcttcttccttgtcctacttcttctcttctcattctgtgctttctctgagtaatctttgactcccattacttaagtcatgacctgtgttccagggactcctaaatttgtattcatctccagagtttcaaacccatatatctgtctgtatatcatatatttagggaatctcacttggagtgacatgggtgttcaaaatgatgatatttaaattttcacgtatccatctcctagcactctatctagtcacatatgcctaaacctgggaactgtcttaatattcttttatatacacctgttctgacctcccccccaaactagtaaatttctaagacctgtccttctgaatgtctcttacaattttccctgtgatctcagtttcttcctcccatccctcaaatgctttgtgtgtgtgtgtgtggtgggggaagagagtaaaattgaaatttgtggaaaacgtactagcctgtctgtctgtctttcgaggtgaagtctccctcttgtccccctggctggagtgcaatggcacaatcttggcttactgcaacttccatctcctgggttcaagcaattctcctgcctcagcctcctgagtagctgggattacaggcacctgccaccatgcccagctaatttttgtgtttttagtagagatggggtttcatcatgttggccaggctggtctcgaactcctgacctcaggtgatccacccgccttggcctcccaaattgctgggattacaggtgtgagccaccatgcctggccactaccctgtcttgttgcttggtatgactccactaccctgctgcctctctccccgtacagcagcataatttaggaatcagagagactgaggaggatatatattatttaggtgcaccggcccagtcagattaacatctaaaggactgagccctgaacaaagagtcaggttaccttttaagcattttgtgtcggtcattatgccgacaaggtgtccgcactaagttcagtatcagtatggtgacctcctgggaacaggtcatcggcttgcctaaggatgggagaactggcccaggtcagaaagggagcaggtcagaattcctgcaccaatcggtagtgggactgtgcctgggcaatatagcaagatcttggttcttaaaattcaaaataaagaacagctcattcccctctggggaggggctggctcaaggttacacagtgagtgtgggggcagaggcgggcccactgtacctcccttgttgggttgtctgaggacccctctggccaccccccacaggagatggaggaggacatctggacagtgagcaggaggcgcttcggcccatgccgaacatcccaggggacctggagagccgggaggccatggtgagcctgactttccctgcccctactttgccaccttcctctgtggtccctccgaaacccccttatgttcttggtttccccgccttctgacttctgtggactttctctgcttctgggagccagtggtcagacaccatttcacctgtgaccaacaggtgcactctgtgaggcccgaaaggaaggggctatgctccatctgcctgccccagttgttatgtgtatacccctacaagaatactcacctcttgtcttcaggtggcatttttcaactccgctggagccaatgcccaggaggaacaaagggtgtgctgccagcccctggctcacccagtggcctcgtcccagaaaaagccagaggtagcggccccagccccagagagtgggggtgagtctgtgtttggggagacccaccgggccctgcagggggccatggagaagctgcaggtgagtaggtcctggcatcggccaacaaggggggcgggggggcaggacaaggcaggtgactcctgacatgtgaccccattattttggctccacagcgactttatggaaggagaaggtggacctgaaggagcgggtagagaaactagagcttcaattcatccacctctcaggacagacagacaccatagggagtgagaggctagggcaccgctggggggagctgccaggccgtccgaggggccccagcatctgagccatgtcctcctgcaggaaagtacatcagccagggggcagtgtcagagacgcagcactgggagaggaggacatcgtcaggctggcccaggaccaggaggagatgaaggtagggtgtgcaacatctcggtgggggagggtgggggtgggtgtgaacgtgcgtgctggcaccggcatggcagctaacaccccttcctccaggtgaacctgcaggagctgcggggcaggtgttgcagcttgtgggagaccacaaggaggggcatggcaaattctgaccattgcccagaaccctgctgatgagcccactctaggagccccaatagcccaggagcttgggtgtgctgacgagcagggtggtgagtagagccctcaggcggggtgggcaggcaggagcaggggaggctcacactgtgctcagattcccaccccccctccctctctctgaagatctttgtgaggtgagcctcactgatagcgtggaggctgcaccaggagaggacagggagggttctccccacgacaaccccactgcacagcagatccagcagctgcttcctgtaatgcaggactccccaggagcacccaggcatgggcagcaacccctgcatgccattctttttgggctcccaagaacagggagataaacaccaccatcatctgagagccgggaaggggaaggcgtaggtgtgggcgtggcaaggttcctggaaaagaggggctggaagggaaaggggaggaagatggagagagaagctagagcttcataggtagtgcctgggggctgtggcggtcctccccaccccacacacactggcctctctcatggcacccaggcagtccacccacagttcagaccaatgctcaactcccccggcttccctcttctgtggtcaccccatcttccaacccactggcccagggccacctcttgcttggggagccccacccaacagccaccaagcctgacagaaggaacactgcttgaaccaaaatggtgaagctgtaagggatggcgggctggagtgagcgccagaggcccctctctgggcagtcagaaagcccagggtccactgaagggaccctggggaaggcagggagggcaggtagctagatgccactgcccatagacttataagtctaagaggggaacctcaactggttggcggggggctgcaggttgcataggtgaggctgggcccttcctgctgggaaaagcagaagagggagactccgtggcaggaaaggcaggtgggctcgctaggcggagctcagctgggccagcaagcactgtggtctccttggctgaatagcacaggtgacccctaggagcaacaggccaaggtccgtgagcctgctggctggcagtagtgcttcagtagtgctggccagggacccagccttcagtcacatgctagcagctgtgatggtacctgggagggagggaagggggctgtgtgtccttgcatggcctatgaagtgtgttgtgggataaccgtgtgtataggactctcaggcttttatcctagatcaccactggattgctgacagatagaggacgtgggaccgtgactatcacccctaatctgcagtggatttggctctcggcactcccaggctgggagctggatacctgccctggcagcatgactcagactgcatgacaggtacggcgtgcccaggatgatgtgcccaggcctctggccgcctgagtccagccccccacacaaccccctccaagctcccagcccctacaccataaaccatgagctctgtgccctctctgatggttccacatctgccaccttcggcatggagcctgttgtaagagcccccaggctcagccatggagaccttgagcagtggcactgagtcctgtggctggcagggagggaagtgagacagccagcagcacaaggacagaaagaggaaagagcaagtctgcagctctagaagggaggggcaggcagcctggctctgaggctccaggtatgccccctgtgtggagctggggcagcggggcgggcagaccattcatgcagcaggcagtgaggcatgtacctaccatggctgatgctcctcaggggccactgatagtgattctgaaagacagcatcaaatcacatggcaggtcccatgcatgggtggggcaggcctgggggtggcagacacacgcacatgccagattgtgcacacacatgctgtgaggccccacggcccgcatgcacactctaacacatgcccacaaacaacacgcatacgtcgccctctccgccacctcccggtgcccaacaccctcaccagccggcacgtgccgcatggatctggggcgtgcagccactcggcacactgaagcacatgcgtgggcagagtcacaacacagatgctcacctgcacacagaggcatttgcaccagctccctgcacactcgtgcctggcgtgctcagaggaccacccatcctgctcagggagacagggcttgctcactaatgtccggctgtcatttctccacctaagagccttccatggctccctactgcctacagcgttgaatcccaacaagtcatactctttggactttgaaggttctccaccctgtgccccaccctccccacagagctcttcctcattctgtctctgttccctgctttggccagtggctatcctcaatgtgacccacactacacctctgcccacactgcagctctttacccagttaccctccagttcctcacaacgtatgcctatctcagtcatgccccggactgcattgaagccagactgcccttttccccaaggcagggtcatgatttgccaaaggtttcgtgtgtgtgttagcaagactggagtcagagcaggcatcaaactttacatcccatatgtcacacctcaccatagacctgggtgccaaatagcctgaagagtctgaactcacgttggcagttagcaaagtgctcctacagccgcatctgcggttaacatagcatccctatggccactgtctcccttgatccccacagccatcctaggagaaaggcagaatgtcataatttgctaaaagggatgctgaggctctgggagggaaagggacttgcctaaagccccagggtgaagcagcatctctggactcccagtccagtgatcttgcccaatactttgctgcttgcctatacccctctaacttggtcaacagcacatcacagggcaagccccaatccctgcttcatttttatatatgggcgctggtcccacagccccactctccagccatttggaaacaaaaacagatgctattgttcttccttagagaacgtggccagtggagacggcacactggaaatcagagtgaatgttcttgaaagagggtcacgggtcaacaaggcccagccaaaggatgcagtagaaccattttccttagaaatctttgggagtgaagtaggcttcagccactcccatccctgccctcgcagctaccactaccccattagtttagacagggtcgggcggggaggggtgtggagaagaaatgagcttgcctgtggcccccaggctccctctgtcctagctcaggtctgggtgccattctttacactcgtgtgctcgctcacgcacacatcacacaccttgctggtcacacagtcacagactcgcctctgctcctgtggtccagtggccggacaccccctgggatggctcaaaggagtcaggacttggaagtggggacatcagggtagctgaaggaaatccacacacccagagcatctcggagttcagactctcagacctgaagtaggcgcccccgggactgggctaggagttggacggaatggaggatggaggacagcgagaagaaaggaagagaaatgcaaagtgtgggcagccgccaagagtgaaaatagagggaagtgtcatgcaagtgctggacagaaggcggcaggtgggacgagccccacagccccctcctcaaaaacgaccacctccaggactcagtgatccctggggggcaggctctgccagccctcggccacacgtggctccggcacccatggtcccagtgccttggatggagacggccagttctggcggccagatgtggtgctctggaatccagtcccatttccttcctggccacgcctgtccagcggcctcttcagccgcattcagcccctacttacctggggaccccggctggggcacgagagtaccaggggggtagggcccaaagggatcaggggaagcctctggcctggagggtatggggcacgcttccccaagggcggacccggcaggaggaagcccaggagctgggtcctgccgcccaggagctgggccctgccacccaggccgggctagggacatggcagggcctgggcatcctgacgctggacttgggcgacctgggaggcacagggaggggagagatgggcgaccccgccccagcgcagtgccggccacaccccaaggcggttgccagagcttaagccccgcccccagcagcgagaacatcccagctccacaccccccccccgcagccagtgctccttgtcaagctccccccgtcactccaggtgggagccaccccggtgagggggtgtgccacttgcccccagggcactcctctgggcatcccgggtgggggattttggggccgtggggggcagtctttggtacctgtgttcgtcagggatgctctgacaaccaggtgtcgtccacgggcgggggcatgggcatggtgacagtggtcctgttgatgtcaccgatgatgctgagcgcctccttcagcgcgtggtgcatgtgcagcatctcgtcgtgctgctgtgcctgctctgccaactcctccatcagtgtgttctggttcccacatgagtacatattggccagcggctccgagatgatgaactccggggtctgagagtgggcaaacagggaagaaggttgggacctggtgcctgtgccgccctggctgccttgctgggcccttctgggactgtgcgctggacttggagccccttggagtatggcttttcacacgggcttctataccgcttcgactggaagatccacctccccactgccttttctcactcagatggggacaccgaggtccagaggaaaagacacctgtcaaatgtcacagatctgggaggggacttaagacttatcatgccaagaggacacctgtctactcagtttttttttggtggggcggggggcggtgatagggtctcgctctgtcaccaggctggagtacagtgatgactgctcactgcagcctccacctcctgggctcaaagtgatcctccaacgtcagcctctcgagtagctaggactacaggcacatgccaccaccaagcccagctatttttaaaatttttgtgtggagacaaggtctcactatgtggcccaggctggtctcgaactcctgggctcaagtgatcctcctgcctcggcctccaggagtgggagttggagttgatgcctggatacaggagctctgtgggtgggagtgagacaaaacacagggtcctgagctctggggaccaagcaatgtcctctggtgaaaaaaatcctggacttgctggcagaagatttgcctcttactcgccatgtgctctgaatacatttacctgccctctgggagcttcagttttcttatctgaaaaatgaggacacctgaccccttccctgcccagttcagtgttgtgggacagggttgctgtcaagacaatacccagtcctgccctcctccctgagtgggccaggtagcccatgtagcctcttcccagctttcctgggtggcactgccagcctggtgcccattcaatctagtccttcatcttgctggagcatggggaagctctgagtaacatgggactatagagtgcaagagggttgctgatggtctgggtcctgtgccctcctcattcctgggcattcttgacaaaggctcccagcaactgagggtacgcagcagctgtagacaccagcctgatgaatatctcattgtgggaagggcaccatagcaggagtggagctccagggaaatacagaaccgaggtctgggaggtgctgatgtgagaggcccaagaaacctcggctttgcacttgctgagtaccatctgcacctctcaggagggagagcgccaggctcaggaggtccttgccgaagcaagggagcttgaaaagggggctggggtgggctctgccattttcaagggctgacagggatcccctctggaggtacttggggcagtgctgcgtgccgtggctcctgagtgacagagtcagctctgcgccccacaagaccgctccctgccgagaactcactgtgatcatgtgctgggtccagatgctcacgcagcctcctgatgggagcatcaggtgtgctgcctgcccagggcggcccacaagagtctgccctgccctgccctgctctgctatggaacaactcccattctgcctttggggagaggtgttcatttaaaccatgagtgggctggcccccatggcacagttaccacagagagtctgccactacccatggctgagagctctagttcttctctgaagccaccaggacagatgaacagtggcttcccccttttggccgactcagctgcctttcatcagctcatctgctcctaggatccactcttcctctggctggcacctgatctgagcccgaggctcacacctctgcccacaggccccagcagctgcttcacctccgactccatcccccaccaagcactgcccctcaccagctgctggggtgccactagtgcccctacatggttctccctctccagacccttgggtccagctctagcttccttcgggaagccacaccccaagaccccagccctgctctggggccctgtatccccgacttcctgcattcttctccctccttctgggaacatgaacttgccctgccagcctgatgactcctagagggcaggacaccaggtcctggaccatggcaggcctgggagtgtctgctgccggtgatgctggagctggtgcccatgtccacatgatgtccatggcacagtggccacctgaggctgggcgcatctgagtggtggctgcagagtggggcccttacctctgcctgagtgaagttcaccaggtcctcccctgtgctgtcatgctgggcgtggaagagccggcctagctggaggccccgcaccacatggtagagcaggagctgggggtcggtgcctgctggctctgaggctctggctgctgagtggctggacggactctgccagaggcaaaaggggccatcagcctttgtgatccaggccgaggcctgtggctgcagagaggcagtgtgaccctggcatgccaccctcagctctgccccagccccccgcacccaggaacgcccacaatcagcacacccacctgggcagtcagtgtccggctgccctccagcgagtgaagcacttgcttctgggccgtcactcagaagctaagtgtctggaggaagtatgttcaccgtcagagaggccaaagtggatgcctccgtccagggcccctggggacaagggtgttgggtccagctggcctgaactggctccccacctcagggtgcccccgtgggcagcagaaacctggggctcggccctcagcacccacctctgtgtgagaacagcacgagcccaccatccagctgggtctgcatgaagctgcgcacctcagtgcccggcaccgcccactgcactacccacccattgctgggctgcttaatggtgtacaccaggtccttgggcccagagtaaccatccatgctcctcagagcctctgtagggatgggcacggtggccccctcccacatctggggacacaggcctgtgaaggttctgccctgccacacttacccaccccttcctccccggccctgggctgccaccagggctccaaccccactgaggctcaggccctcaggtggcatcaaggctggcgctgctgcggctcccctgcacaaatggcctccctgcattcaccttccctgtcaccccagggaaggccaccctccaggcccagcatccctgctcttcatctgtcctagtcctgtgtgtccctcaagaccagcttgtgtacccaacccaggaaggccctagctcttaccgtcaccaagttctcacccccagaaacccccagcgctgaccaacagtgctccttaatctagctcactggtggggcagcagtctcctttcagaccctccatgtgtgcctggcaggggctgggcacaggtgggaacagtgattttagaaacgagcactccttccagctaagggaggggtgggaggcgcagagagctgaagcctgatggttggcactgtcctgcagcacagaagcagtgctgggatgggcccaggtgcttccagagcagttacgggccctcctcgtgttgggcaaagggggccccttttcaggcctcccactagcaagcagaacaggcacccgttcctgaggtcctggtaccactcttgctgggtcaattacttgtgggcagtgctgcagtgggactcacatgcccagaaaacagccctctggcattcctgggcttcctcccctggccgcagggagccctcaggccgagccttggcaagaggggccatactgtgggaggcagggccccatcactgggctcccagaacaaacacgggtagatggcaccacctggtggccgcactgccacacagccatcccagcctgtggttccagggtgctgtgtcccactcttctgtggcgtccgcaccatgaggccaccccctacaggcacatcctagaccaccaaagccccccggtgccccatgtcagagacagcccaagtcagccctcttgcggaaccttcagtggcttctgctgactggggaggacgcgccccagaagctggggttcaaagccctgccacgtgggcttagtaaagccatgccctttctgttccaccagaactacttttgcaatcatggagaagttccatcccatctctgggcctcaacttccacctttgccaaatgggggccctgctctgctgtggacaaggggcaggagtttgggaagccaagctgaggcctccacttgctggggtgaaggtgggaagcttaacggtcccaccctgacgccagcccttaagggcttgtaagtgattctttcaggtgttctggtcctaagccacaggagaaggaacagcagagccacccatggctgctcagaagtctgcctaccgtacttgcaaatgtccaataacaaaacctcccacctgtgttctatttcagcacaatctcacatctctccttccaacaactgcgtgaggcacacagtagtgtcctcattttgcagaggaggaaactgaggctcagagggggggagatctgtgccgggaagtaggggacattggcctctttctcaaagcagacatggggggtggtcccaggaatatgctcacctgcaggcctgagtttgtatgaggtcgggggttggccattgacaggcaggatggtgacagtgaaggccacaggatggctctggcggtccatctcagaggcattagccatcaggacaaaaccgtcagtgtcttgctcccatcgtgcaggtactggatcagatgctcttccacctaggggcaggcccagggctggcagtcaggccccagcagtacccttcatgttctgcctttgggtgcaggaagagactgacccttttagggcctcagcttccattggtggaaaatggggaccataagttctggttcccagaggagttgtgaggaagaaaggggatattttattttattttgagacagagtctctcgctctgttgcccaggctggagtgcagtggtgtgatctcggctcactgcaacctctgcctcccagattcaagcgattctcctgcctcagcctcctgagtagctgggactacaggtgcgggccaccacacccggctaattttttgtatttttagtagaaacagggtttcaccgtgttagccaggatggtcttgatctcctgacctcctgatctgcccacctcggcctcccaaagtcctggaattacaggcatgagccacagcgcccagcccgagatacagcatctaaagcataggtctttctgaaatgtgactccctgtctcctctctgtataacccctggactgggagtccccggggctccctccactctgcccccagagctgggctgcagcccctgggcctctctcacagccgtacctctctccagcagaaggtgctgagggtcctggcttgaggcccatcctccttctgcagggccccatgccggggtggctccagcacctgcaggccaaggcccgggagagtggggaagtaggacctggcaacgcggagcagtggaggggccagggtgcagctgcgactgtgccccctctactgctgaagttttgtgcccccagtggggatgacagcaggcagcacctccagctccacgtgacgtcctcaaggggagcacccaggccgaggccacatccagcgagaaggcatggctccgggcctcagggcgggagtgcaggtagaggatcctgcctgtgtccactgcctcttgggagaagctctgcacggggtccaggctgggtggctcatctgccaagatgccacgcagcaccatcaccaggtagccggcactcggtgggctcttcactgagaaaacgatgtctgctggcggcactgcctcctgggctacctggttaacagaggtcatgaggactcacaagggaatgcagaggggtctcagaggggcccactgtggccctaagcagccagaacagccttgatcttgctccacttatttccccagataccactgctcatttagtgacacacacacatgtgggttcacacacacagcagccagacatgcagctggtcacattttttgtttttttgagacagggtctcactctgtcacccaggctggagtgctgtggtgtgatcacagctccctgcagcctcaacgtcctaggctcaagggctcagcctcccaagtagctgggaccacagtcatgtgccaccatgcctggctaatttttaaatgttttgtgtagagatggggtttcactgggttgccccagctggtcacatgttaatacccaccccacacatggttacggggtgtcggtcaacagcttgagatgcactccctcagggaggtgcataatcacatgtccccagactcagtgacacagacatatgagttcatcagatgctgacgcagtcacacaggtacaggtacacatgcgtgtgtgcacacgcacacaggccccctgctcaggatctgttcaggcctgtggctggtttgctggcagcatcctccccaacccctgctattaccacccaggaccatcagagggtgccctgccccaccccaccccacccctcctagaggcacaggcacccccagcacaggccctacagagctcacaccccaaaggccacatgggctccctcacctgatgggccatccacaagaggctaaactgcctccaaactcacattcctgttttgtgccttcggccggaatgttccttttgcgtggaataccactccccattctctgctcctaatggcctgtactcttcagagcccggcccaaacactgcctcctcccatgaggccttcctgatgccagatctgctggctcaccatgggccccaagctccagatgcagaccagaagggtctccgaaataagcagtgtggaagagtaaggctgagagcgggcaaggactggcctgaggtcacagggcatgtcagatctctggaaggcccgtggctgctctgtggggttcctgggtgagcagaagcccttgacagaccctcctggtcctggtctgggctctgagaagagagcggggtacacaggggtctgagaggcagcggcctgtctccacggccagcaatcccaaaagttcaggacccgtgatgccctcccagggaactgactgcaatgcagattctcgggctccacttcagagattctgtagggctgggtggcgtccaggaatctgcatgctcagccatgccatggacatgagtggacaccagctctagaggcacacaccactcccaggaggatgggtgtacagcaagctccccagaaactcttgggaacacaacatatatgggagcacatctgaggcacgtgcacacacacaagctgggaccaccacaggtacagcccaagtcacatgtgttcccggcatggaggctgggaggaaggccctctacctggtccacaccccgctcaccacctccagctcctcacctccagctggtcccttctgatctcagctgcctctccctggaagatgtagatctccttgtgctaggccagcttcagtggggctactgggccctctagggcaatggtcacttgtagggtggcatctgtgtgcactggtcccacatccattgagaaggccagggtgttgcgggagctgaggctgccattgtggccatagaaaacagccccaaccagcaggtcctgctgagagaaggctgtggctggctgagtggcttggagcaactgtccccagtgagggctgtctgtgacgtggtagtgggcctcatccctactgcagatgttgaggttggtgcccaggtggagctcggccatgttgatggtaccctggcctccttgaggaaccatgaggccggagccattggccacacagaggtaaggctccaaggcctgcacctccagcaccgtgatggcctggtgctgcccatcggacacctgcagcgggatccagccgtggtcagcctgagtgtgtgaacaggactcgcctcttcctgaggcccctcctggatgaagcggcagatgggctgcatgggctcatccgtggccatgatactgccagagaggaggtcctggtgggtcagcaccagctgggcctcagcaaagcccgaatcagcattgctgaaggccatgttgtctgtagtcagcagccgccacctaccccaggccacgtggaagacgcagctgatggtctgcataggggcgtggtcattcacaggctggatggccactcagaagacaccccatacctcctcccaggccacgtcaccactgctctggtcctgatggcagcaggaaatgggatatcatcttctgtgatctcggagtcatcatgctgctagaccagctggccatgcatcaggtctccattggtgaaggatgtcaccatagtgatcttgtcctgtgtcccacgccaagtcaacctcccatggcggggctgctccatgacctcatagaggtacctggcactgttgagactcttgatgaagagctggtcagcagagaggacacacccaccaccctcgggcaccacgaggacaggcatgtctgggtcaccgccaatatggatggagaaggtacagagtggggagaaatatggtggagctgtgacatggaaacagaaggtgtcctccactgccactgaggcacgtgccatggccccataggtcacctctgcagcctgtacgtcatcctgggtgaagccctgaccgtctgacagcatcgtgccctgtagttgaaagttgcctttcctgggagcctgaaccacctcacagtggaaggttggggggcttgggcctgcctcctccagggtggcctccaggtgggctgtggtgagggcctcctgctgggtgttctgagtgtgcagtggctccagctgcagcatccacacagtggctctctggatggtcactaggaaggacagattgctcaggatttcccagctcacctgcacctgcagatccaggttctccacggtgtcctcggtgtagtgctgtgggtcagtgctcaggtacctcacgtggccctgctccacatcctgctggtggaacgcctgtgtgacccaccactcagcatcctccaccccaccagccccctgcttctgcagctccctgaacggcaggcctccggtgacacggaacagcacggtcacatcctgccccacggcgctggtctccaccaacaggttggtaggcaagatgggcatggcagagccctgggccagatgcagccctgtgctgcggtggatttgtatggccagctggacagccaccaccttcagcatggccggggggctggcctgcagtccattgctgacccggaatgtcaagtcctgtgtagggccaccacagtggacatagactaggctgccggcctccaactcccagcaggagaactcagtcaccggctccccaggctggtctcggtgctccacagggaggccagagggggtgccaaggagctggaaggcgaggccctcacaggcagagtccaggtcataggcctggagaacctcaggccccagaggcttctgtgtgtgttccaggatcaccataaggctgccatgtgggaagatgatgtggggtgggtcattgacagggttgacctggatgggcaggaggtctgtttggcccctccgcaggcatgagggcatgggcaaccaagccatcactgacacctccagcaccagctggtcagaggtgtcctcagggccatcgtggatgaagcgggccttgcagttcaccacgtccaggagggtgaacatttttcatgcctgggcacccaggacatccagctcgagctcgctgtagtgtgcccctcaggtcacgctgaacagcacctgggatttacgcagttcagcctccatcagtgccagcatgggctgcacatgccaccactcaagccaggctgtgccaccctcggtcaccaccactgcgctgatagcagctggatgaaattggcaaagacaggaggtagccctggctcaggcacgcatggctcagctagctccacggacagccaagccttgggagccagggtggagaaagcttcataatggccataggcattgtctacctcctccagtctgcagccagccaccatgttgtgcgtcagcaaggcttcccacagcccctgcctctagccattgacactgaggtcttccatgcagccagcccagcagggaggcattggcagcccctggtgtcaggcctgagcggtgttcctggaggtgatgagaggcctctgcaaccagctccccaagaaggagactgtcacgtggctccaggtagctgaggactcctcagttcgtgtggggtactggtccatggagatttctagctggtgaatgttgatgtggatgctgaccttgtggggctgtgcgtcagtcacaggcacactgttgaggagcaatacagtaccctggcccttctcaaccatggaccacaggtggccctcaaatatgtccacatggatgaagtccccatgccagcctgctgcctggaaggccaagggtgcctgccagctctgtgtggtgagtgtaaactccagggttccttcaccctgagtgccccaggcaggcaaggcagccagagagtgggacccagagaagcccagggccacatcatcattggcagaaaactcttcagcacagccctcatgcttattgggggtcagaggctggaggagtctgcggccattgagagcggctgcatggaggcaacccctcaggggatggctggttcccctcaggtacggcaggccaagtctcccagtgctcccaacaaagagcccataggggacttctaggggggctcccaggactacagaggaggcattcagaaacccattgactgacaatgtgggccagtcctctgagacagtcagaactgtggtgtgggggacggagccactcagtagaatttctgctggggtctgcagcctcagctcctcctggcccaggacaagcctgacctgaggagagacggggaatgggagatggggggcagcactttgaatccatcatttcccttataaaagcacagtgggttccccacagggggccccagagcagaaaacctaggacaagggcctctggtgccactcctcttgccttcctgccatctctttattcatcctccaaacactcaccaaaggaaactctgggccaggcctggatgggctctggggaccctggtgtgaatcagatgtggtccttgcccacaaggaactgacatatagcaagatgctcttctagaaacccaacctgtatttttaaattctcctcctctttccttgagtgaaaagcaccagaaatattgtcttggaatctagatttcacccctggaataatgggtaactgagaatccgttgatcagtccccctaagtttggcaaagtttctcgaggtcactgaaggaagccaggctaactgttcagggacagggagcccaggcagatgctctgtgttctgggaaaaaaaaaaaaaaaaaagctgcctgacctgtggtggaggaatatctcaaggagagatgaaggacatagttctgtcaccatgacattgacacaagaaatggctctggtatggtgctcccagatgctagaataggtgatggcagagtatgggaactgcagaggcagaacactaagaaccatgatcttggagtcctggtatggtgcatctctgtagggatgtggcatcactacctgcagagctcaacagccatcagcaccagactgcaccacataggtgttcaacagtgacaccttgtggcaatgagcagcaatgacagcagcagactgaccaagccctagtcctcttcccactggggtgtggaaagagatggctgccccaaatttgttaatttgttttttttttccttctaaaatagagatggggtctcattgtgtggctcaggccagtcttgaactcctaggctcaagtgatctttccaccttggtctcccaaagtggtgggattataggcataagccactgcacccagcctgccccaaatttggactaagaccctgggttcttaaactcttcctggtatggggtaagactcaagtaggagccacaagactccttgataataaagcttgtggtgtcttgaaggatgaaatggaaaaatgaagctgaggcagtactggtgctgttactctcatggacagacagtggtgctgcagataaattggtgcagtgccaccaggatgcgcaggggtcatgggggcccaggagggggtctcgccgaggaggaggggatgcccacactgaaacttcaaggagagactagagttcggcaggtacagggaatgggtgggtcacacacctggcaggaggagtgtgatgaccaaaggcctggcagcaagtgaccataagatggccaggaactgaaagcagttcagtgcagtcagagcacaaagggccagtgagggcttgtggtgggaaacatggttggaaggagccggtgggcagagccagttcatgaaggatttaccatttctgagctgctgctgcccatcccacagtggagaacttgagaccccaagaaaagtgacttacacaaggtcaacagccagctggggttcactcaaagctagacaaggaatctcgccccaatcccagggggacgtcactcacctgcaggtgtccagagtagagctgcagcaggaggtggtcagctgggcctgctgccaggagaaggagggcttcgggttgggacatggagaactgcagctgcaggtctatgtcagtcagagccatggccacagtcacctccgggtggttctaaccaaagaaggaagctgtgtgagagagggagctgtggtcaaggctcagattcttgcctggaggaggcgaggtgctgcagggagggatgggtgggttgcagaaaggggtccgtgctggtgcaccctcatggttctgccatacggtgctgcctctgagcactgcccagatcccagcatttccttggtcctggcaccagaaggcacagcctcaccttgtgtccagcccagaccttgacttggcaggaggtcagacccagaaattcccagcaactcaggtctcctccttggaggttcctggagccagaggcctctgccagctctgactcacctcccctgggccccagaggagtctccctcccaggtctggctccccgacctggcccaaagggaaacatcactggcctgatcacctggcttggtggtcacagccctgaggaatggagtttctggagaatcaccaccaggccagatcgatccctgctcagattccttctcctaagtgcccttgtgcttgggctcctgtgcagcacctgccgtgccatgccccacctccatgggttggctggggccacggctgggatctgggggtgatgtcagtgcagcccacctatccctgcttctccctcaggccattcttccagctgccattgagggtgggggcaggagcttattggcctgagtttgccaaggagtaaaggctctcaggccagatggggaccatatgcagtgtcaaaccaaagtgggcccacacttcctccactaccctgctgttgcttcctgctagagagctattcacagtccccgctgagcagtcagatccggccccattgtttccaccgtggccaaggaaccagggatgagaacagctcagctcccaacctctccaggccaccactcagtctgaggctgaagacagggcctagaaggggctgagggtctgctgagcaggccaaagagggcctccccaggcagaaggccatgtctgggcttgcctgggattagtggttcttatgcagggcctgttctgtcccacactgggactcctcctcttttgagttgctgcttcctccaggcagtttccccaaattagcctccctgacttccaacccgatgccataatttctggtctatgccttttgcggtgataagagccaaatataactttaactttgcctgcagatgtccagggctggggggcagacaaacacaggttaaaaactgtgattcatccctgttgggtttccctcaaaccccaagaacaagcacaggctgatggccttgatggggtgattcagcaccgacctcacatgcactggtccctagccagcctgagccagctgccatctgctcgaggaagtagcttcagccattggaggagttggaggtttgtataccctcagggcagccagtcccacctggagggatatccaggaaagatcccgtaagagcccctcgggttgagttaaatcccctctagttatcccctcctcctgccagcactgctggcaacaccagcaccttggctgggaagctaagggaatcaagcaagccccgcagaccatctgcacgggggtggcccagcagtctcagcaggcacagcacagcttggtgccagcaagagacagaccagggaactgcaggtggcggccagctactggggtgccttatctgcaaagacattgattcctaagagcaaaacacagcacactaaagtgagggaggccatagcacaaggggtgggggcacatggccctgcaggatggagccaccacagtcaccggctggaacggctcacagcagctgccaggagccaactgttgaattttcaggaattttgagaggcaggtgatactgcccacagtgggaatatttataccaggaaaagaggcaaatactgaaaatcagggttccctctccccaacaaagccctttgcgaaacatttacctacccagcacccacggggaagggggcacatctccctgtgcctacccacctgtgttaatcagggttccctagagggacagaactaataggagatatagacagatatagatatagatatagatatagatatagatatagatatagataatagatatagatatagatatagataatagatatagatatagatagatatataaaggggagtttatgaagtattaacttacacaatcacaaggtcccacaataggctgtctgcaagtttgaggagcaaggagagccaatccgagtctcaaaactgaagaacctggagtccgatgttagagggcaggaagtgtccagcatgggagaaagatgtaggctgggaagctaggccaatcttaccttttcatgtttttctgcctgctttatattcgctagcagctgattagaaagatggtacccaccagtattaaaggtgggtctgccttccccagcccactgactcaaatgtttatctccttttacaatgccctcacagacacttccagtaggtcaatactttgcagccttcaacccaatcaagttgacactcagtattaactgtcacaccacccttgcactaaaggtatacatacacccactagggcatggtcaaggtcagagatctgggccagacaggaactgaagtagatggttggccctaaccactgaaccacctgcctgcggcctcctcccatcagaagagagtagagcctgtttggccagagtggaatggtggcaggaagcagaggtactttccgggagcgctggggtctgaatgggtccattgaggctgggccctgctgcttcctgtagggctgagtgggagaggctcacagaggctgccttgtgcagctggagcgcatagccagggaggcccccactccaacagaggcctctgaggccttgctggccggggctttggaaactctgacagcgctgcttccctcacctcctgatctcctttttctgcccctcttacacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaagcccttagagacctttttgtactatccatgacaagctcttgatgttatctctgcacttttgacaaattcttagcagttaacttacaaggcagttaagatttttgttcaagcacaatatagctagaataggctcatacattcaataaaacaaatatttaccaagcatttattgagtggaagataaaaagcacaaagcataattataaaatattttcccctgccaccataaaaaaattaaacaggcttacagaatacagtgtaagaaaacatgaccaaagcaaaaatagtaaggactaaagaagggaggaaggggaaatatcaacatggactgaatatgacccagaagagccttgatggatggtcagacatgtaaaggcaaattggttagggttaaggggtggaggtcagggcacgttctatagggaaacggcagctgatacagaagcctgaaaggaaaagcgggcagggcacctggacaggactcttcaggaacgagcacgcacgtgcgtgaaaaacaacttagtgaggtaccgttcacccaaacattagagaaaccgcgtaaaaatgcttcttggtaagcatgaagaaggcagggctcggcctgtagaagaactcaataaacatttgaactgtctaaagagtaaaagttaatgaataggccaaactcactcctttctttgttttaagagctacaactttagagaataacaaatcacaaacccagtagacaggtcctggcatttgaaatccaaccccatttttcccttaatctttcccctctgagcaaatggtatcgacatgaacaagccatgttgatttgatcaagacactcatccatggttaaaagagtctttactttcaagagatacaaacagaaatatttacatgggctaatttactgggcaacaagagagaaactctgtctcaaaaaaaaaaaaggaaataaaagtatacaaagtgaaaacaaagaaattaaactgcccttatttgccagtgacattactgtctatgcacaaaattccaaaaatctacaaaaaagcttctagtactaaaaatgagtttagcaaggttgtagaatccaaggtcagcatataacataaaatcaccttcctatatactagcaatcaccaactggaaattgagaagtatcattcacaacagtaccacaaacatgaaataaatgtgtaagattacaaaatacaagcaagatccaactgctaaaaactacaaaacactgacgaaaaatctaagaaggtctaaataaatagatataccatgttcatggctcattattaaaatgtcagttgcctcctaactgatttccagtttcaatgcaatgtcaatcaaaaaccccagcaggctctcacgcctgtaagccctacactttgggagaccatggtgggaggattgcttcatcccgggagtttgagaccaggctgggcaacatagagagaccctgtctctacaaaaataaaaaaattagccaggcatggcggtgcatgcatgtgatcccagctacttgggaggctgaggtgggataatcgcttggttcaaggctgcagtgagcagtgatcctgccactgcgtttcagcctgggcaactgagtgggacacttttttttttttttttttttttgagacaaggtctcgctctgtcgaccaggctggagtgaagtggtgcaatctcggctcactgcaacctccatctcctgggttcaagtgattctcctgcctcagcctcccaagtagctgggattacaggtgcccgccaccatgcccagctaatttttctgtttttagtagaaacggggtttcaccatgttggccaggctggtcttgaactcctgaactcaagtgatccacccgcctcggcctcccaaagtgctgggattacaggcatgagccaccgcaccaggccatgaaacactttcttccacccacggctttctcttctctccccatttacagcagtaagacagcctaacctgggaaagagagagagagggaagctacttccaaatggatgcctgtccccatcagtaataaccaagtctattcaagtgctagatgttaactttaaaagaaggaaacatcaaaagtccaagtttcagccgggtgcagtggctcatgcctgtaatcccagcactttaggaggctgaggcgggtggatcacgaggtcaggagttcaagaccagcctggtcaatatggtgaaaccccgtctctactaaaaataaaaaattagtcaggcatggtggcgtgtgcctgtagtcccagctactcgggagaggcagaagattcgcttcaaccggggaagcagaggttgcagtgagccaagatcgtgctactgcactccagcctgggtgacagagcgagactccgtctcaaaaaaaaaaaaaagtccaagtgtcttcgcctagctttgtcaggaatgtttttaccctcagtctgtaagtgtgaccaaatatattttttaaaggtttaccctcaatctgttaagttcaaaggtttactataatctcttcataagaaaactattggaaagatggaataaaatacacagaaatgtccttaacaggtaaatatttatttttctttcttattattatactttaagttctggggtatatgtgcagaacgtgcaggtttgttgcataggtacacacgtgccatggtggtttgctgcacccatcaactcgtcatctacactaggtatttctcctaatgctatccctcccctagccccccaacccccaacaggccccagtgtgtgatgttcccccctccctgtgtccgtgtgttctcactgttcaactcccactacaggtaaatatttctagaatgtatctactccatcagctagtgtaagtattctaaactgtgctagtatagctgctttaaatcactgctttcttctgcaaatggtggcacctttaaagtgttatcttgaaggggaagtgagtgatttgctcatgtctctactgaactaacactgttaacacccagtccagttctaccttaaacaagtcggagaaatacagacataatccatacttgttatttgtcaagactaaggtaaaataaggaaagttggaactcactcatatcctcttatgactgatgtactgaaaacaatccatctctcaccatttcctaaatagcatagtcacaaagagctctaccctaccaagtactctgcaagtcccactctcaaaggaagactcacaggtgactgagaagataaatttgctattgtttccattatccttcagttcatctgacacctttgaagaaatgcatttggataagactcacaagtctcagggccccttctttatgaaagaaatagctaagcctccatactcagaagcatcagacttttcagaatgcttaagtcatgtaaaaacgtatcaaaattattatcattacagctaccaggaaatagctacctactccatgttagatactgcagttaagtatctcacacagtttcactgattcctaacaacactgcaaagcatgttactaacccttaaggagtaggaagctgaagctctgagaggctatgcaactactcaatggaaatgtggggatgtgaactctacctagctccaaagggcgtacttttttctaaaatttctaatttttttccaatttcacaatggaggcagagttttcactacaattttaataatttcaccagctgggtggggtggctcacgcctgtaattccagtactgtgggaggctgaggtgggaagacggcttgggtcccggggagacaactgggcaacagtgaagattctgactctaaaaaaaataagaatttcaccaaaagggggaacagatttctaaatcggaatctcttgttaaaatccttagagcactagttaagccccacttcttttcaaaaaataaccgacagattaaaaaaaaggttagaaatccttttaaagtaaatttcatcagagatctgcaagtgaattgtcattttggacaagtccccagagttggtggccctctcctgtgtacaccagctaccactaggcagtaaaagtaatttacccaattcaaacacataccgtgcctgcactatgttaagaccactggcaaagagggtacaaagttaaataaggtctatcacagccctcaaggagttaaaggactagaggaggagtccatttatagtatagtatgtgtgcagttaccatttagtcaaggcaaacgaactgtgagaaatcctacaacaatagtacctacagtataacatgccatcaccgcccacagaaggaaagcaactggtgccctcgtcacgttatgttgttagtacttgcttacatgatgtccctccctgacaatcccttccaacctctgtcagcctccttccccacaatcacacacacacacaaaaccacactgccaggaagggaagccattgagtgagtattgtgaatcctacaagtggctctgtagtttaaaagggcaatgcctgtgcctgaagaaaatttgtctttagcttcatcaggtgaagaaaattggttttataacacaaggcccaccaaaccagaaaagcccaggaacgcttctccacaggactcacttagcacgagaaatcactcagagcaaaatgacgcacacagtatttgtcaaatttttctttttcatttagcagaaggtaaggtaaaggactacaactgaagttaataaatgacactctagccattttgatcatttgtcactataaatgatagacatttaagctagttccatctggggaagtgaaacagaatcatgttcatataataagccagacgaaccaaattcagtggaatacgtgcacccaaaactggaccagacttgtacttaatgcagcctgcaaatccccaagagtccacgacagaatacaagaacagtaacactggtttatctcaactcatcttagctccctcacaaacttgccaataatgacctttcaagaactgcaccgttggtcctcatctgggcaatcccgtggcttagaaaaactgaataaagtgcttcttcgaaaaataaaacaatgcggggaggggggagtagtaacaaaaaaaaaggcacactggtttttactgtactgaagcaataaattctccaactaacttcattaatgagtatcagcaaagaatgaacaccaaaataccgctcaatccaactttcatcgtgaattcttgaattcacagtaggatcattaaatgtgacggtatcactctgctataaaaactatttccaaaacaaaacaaacctatctaccccctttcttgatttaaaaaaaaaaaaaagaagaaagaaggaaaatttgagggtttttgcttttttcaacttcacataccggtttgcctttgcaaaaaaaaaaaaaaaaaatgtttagtctcaaagtatagctgcaaggtggaccggctgcacgggtcccagagggccgctcgcctccgacggtcgcagtttcagccgggccgcgcccgcgagaaacagcggagaggccccagcaggcgggcgccgccggacaggtttaccgtccgcgtcggccccggggaaccgctccctcgcgcccgcagcacttgttcgcggcgcggactccacaccgcggccgcccgccccaggggaggagtgagtccgccccagcggcgccaacccggggacccggggcaagggttcggggccatccgccgccgggcgcgccccccatccggaaagcggcgacggcccccaagttgggctgcggagtgggaggcgcgccgagccccaagcagacaatgcgggagaagggtgatgcgcagggaggaggggtccgcaaagctgaggtccccgcgccgcccggctacccatccgtgccgcccgcccctgaagccccgcgcagcccccgaccctcctctggggcccgccccaccgagcggccgcaggggacgggccgcgctccgcaccccgacccctcctcaaatcacaaaacttcccccaactccgccaactaagttgcgctctcaccgtgcggctcccggggctcccccgcgggccgagccgagacagctcctcaccttcgccgcggagaaagacaataggctgcctctcccccggcggcggcagcagcggctgcggctaaagcggcggcaaccgaggcgagcaatgggcacggcggtctcggccgagccgaggggcttcaccgctgctgttccggctccgcgacagctctgcacgtagccccagccaccccgcgcaccggctacaagccgcccgggggtggccggggcacgcaagagggcagtaacgtctgcgagtcctcccgtgagtacacgcggagcaagggctgcgagctgggattgcacggcagagctgcccatcccgctccacgagaccaatagtaaggcacctgggcggggcgctcaggttgctaagggaggctgaggttgaccgccggggctgctctgtggcaaagtgatcacagcagggtggctggcagagactgctctgggaaatgcccactcacggtctcctctccgccctgtttctagaaactgccctttctctgtgtgctcgtggttacctgagctgtagcatttaaccacacatcgtgaaatgatttactcctctatttcccccacttcaactcaggaagtggggtttagtcttgtgtgtccacagcctaggacagtctaaggtattaggtattaaatataggtattaaacaagtgttggatggatgcacggcgctatggcggaatcacaattgtgacagtgcattccgtgaacttttggctactcgatcaccacagtcgttccgtgttcaagctgcaaaggacctcagaaatcatcggattgctttgagaaacaaaatgtggtccgtgtaccaacggcggccgaggagaatatattagctggtacacggagaaacttcttttttcaaatagttaagtgttttagtgctcattaggagggaaatgcctatcacgtcaaatcattgtttcattaatgttacttcttaggtcaaataaaaagtggcaaaaaacaagtgtatttcaagaaaagtgttaagtgaaacttgagacactttatatgcagttcaagaatgtaaaatactagttgacagtgattgaagtaagaacagttggttaggtaggaggagaagattattggctgggaaggaggaggagggaaccctctgtggtgctgattctgtattttgacctgggtgatggataacaaaagtatgtacatcaataaaaaatacatccagtgcactttagattagtgcactttacacattttatacatgtatttttaatgtcaattttttaaaaatctggtatggtatatacccccacaacccccccccccaaaaaaatgcaaagatgcaaatgactgccatttgggaaacactgatccaggcaggctcactagcagtgaccaaacacctgagaaagggtattgtgaatacctgatgtatgtgccaggaacttccatggttgaatagctccaaatctcagaaatgctcctaacctagtgttgagctctggtgcatagatatattttcttttctttctttcttttttttttttttttttgaggcagagtttcactcttgttgcccaggctggagtgcaatggcacgatatcagctcactgcaacctccgcctcccaggttcaagcgattctcctgcctcagctgcccgagtagctggaattacaggcacatgccaccaattccagctaattttttgtatttttagtagagacagggtttcaccatgttggccaggctggtctcaaactcctgacttcaggtgatccacccacctcggcctcccaaagtgctgggattacaggcttacaggtgtgagcctcagcatccaacccagaatagcttaaaaaaaaaaaaaagccaggcatgcccagttcttcatgtgaaattatttctgtatcacctcatcatgctgctcaccctcttccactgttctctaatttgtccttgttgatatttaaaagctggcacaaggccgggcgcagtggctcacacctgtaatcccagcactttgggaggctgaggagggtagatcactagagcccaggagttcgagaccagcctgggctacaggtgaaacccccatctgtactaaaagatacaaaaattagccaaacgtggtagcccaaatcccagctacttgggagaccgatgtagaaggatcgcttgagcccaggaggagaggttgcatgagccaaatcagcagggcagctgcagagtggggtgcaaggtcctcaacccagaggttccctaggccccacttgccccagctcatgagagcctggttctgagctctgccaggaccggggctcagcactgcccatgaaaacaggcgtggcagggaagaaaatcataaccaaatatttgtagtcattccagaacctcccttctggaaagggaggttcccaggtttgtgggctctttgcctcctggacattattgtgtagtgaagggagaaaggttgagatgcagagttggagaaactaagagaggccgaactggtccatttgaggaaagatgactgatcccagaaggggaggaggggacaccctggggaagcagggggcttcccagatggtccaagaaggggagggcgggatatagaaagtcagagcatggttttgagttttggagacaacaagagaaaagagggagggatttggacaactatggagaggactgggctgtggagagaaatgtttagagatttggaagatggtgtgtcatgcgatgtattgtgaaaaccccttcttcatatccctaaaagaccaccgctgatggtgattcatggtacaattgatgattgtatcatgatataattcagtgcttttgcagagggattggtgcctttttaaaataataatgatgctttggcttggctccatctgaattagtagagacagacatcttgagcaggttttatcagagttccattagctaaatattgggtttcctattttgtggcttgctttaaaccactttgtaggcccttccgcactgaaagccactacagaaatcacctctttggtctgcagctccacgtccccaagctctgggctttcctgaatgagtggcctcattcagaagataatacagcatccctcatccgaaaatccaaaatctgaaatgcttcaaaatccaaaactgtttgagtgccgacatgatgttcgaaggccagattcaaaggaaatgctcattggagcattttggatttcagattttcgaattccaaaatctgaaaaaaatccaaaatctgaaatacttctgtaatttaacctgtaatagacatttggtcctgaccttccagctgaggcagcaagcagtcaacagaggctcaccatgcatccctcctgctcctcaccctcccacgggcttgtgcctcaccccccagcctcccttgcacctgctggggaggggacaggatgctcctgctctgccttcttggatctcgggctactgtgataattgcaggattccagccagggaaaatgctacaggtagaagtacttggtactctccatagagaagtttccagcaatggcacatctgccccaggaagtgtgctgccacacccagctaattttaaaaactttctgtagaggtgtgaattcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngatcccacatatggcgtgttgtgtgtctatggagtgtcgtgtgtgtgtatggtgtgtagcgtgtggcgggactatatggagtatgtgtatggtgtgttgtgtgtgttgtgtgtgtatggtgtgtggcgtgtgtgtgactgcccctactcaggtccctatgtgaagttatgagcagggcacggcctgggcctggacctccctcctgcgtgtggatctgatgggagcagcggtggggaggactgcagctggtcgggctgcctagggctccccttcctctgcctcgtgtccttcccgctcgcccatcccttcgaccactcacagtttcactaagccctgtctgcggagcccagggcctgctcaccctggagtggcgcaggggaaacaggaggatctgggggcacaggagtgggcgaggggctgagtctgggggtgaggggagcagggcccggcgaccaggcggtgggcacggagtctggggtgagctcgagctgcgaaggtggagaggctgggccaggggacccgcgtgggcagcagcatggaccggggcgtcagagtgcaagatgtgagacctatgtgcgcgcggggcggcggcagccggtcaaggggcagcaggaaatcagacctcaaaggtggccggggacagattccaaggacccttgcttgaaggctggtcactgtttcctttgggcctccaggagtgttaggtcgaggactggagaggggaggcagttctctccgcgcgccccctgtgctccccagacgccctttgcactgaaagccaagggccggaggctggagcgcagcggcccgggcagaagccctgcccagacggcgccggacctgggcccggactctgcgagcagcccagccctcacttggacaaaggtggaaacggaagccttctgggagggatgcgtattcccgcgaatccactacacttctctcgggatgcttttccttcttcaggccaggctagcaacgcaaacctcgactccagagaggccggtgtgcgtccaggggccaccccttcacaggccgcgcctgcacccagcgtctgttctcactgccggcctcgcgggcagccagtgggtccccgggtgagatggtgcgggcagcgctcccggaacgatcccgggcccctccttccccccgggctcttgcctgcgcctcttccacacaatttgcgatttccgtggcgtcagatggctgttctttgtcacctgcttgtaagagctggtcccatgatgtcaagcctcttctcctggtcaaatccagtttcccctcagtttccttcatcggaattccttggccttcgtcattcttggctgcatgaacctttgatttcctgtactctctggtcctggctctaggaatgatgttatatgtagcgcctggcggtgtgctgtgcgctcaccggaggaggtgtccctattttgcaggtgatggaactcagttctgggacctttctgaagtcccgcggatccataggcacagtccggccgcagaatatctggttcctccaatgtttttgtcttccagtctccgtcttgagtatcttttctgtaaattcatttgtttccgtgggtccgacttctgtctattttattttctgacatggtttaaaacacacccaagccctgatttcattctcggtggctccttgggcgccccctcttaggcatcctgctggggtctgaaactgagcccagagctcttctcaaacaggagctgctgcctggttctctgctaaccagctggttttatgtatggatggctccttttcgttctttctctacccgggggcacaagcccttcgtttttagcccctggctactgctgcaggtcgcccaccacgtcctgaccccacctgccgcccccttcacccttcagtccccccacctcatagatggctgccactgccacagctggttccttgttaccagattctctctcctattaatattattccttctgaatatggatgccaggaccaaggtaaaagaccacccggacttaccatgttaaggatttgtagcttgtggactaacttgcgcattcgtaattccacttctgtgcctgtgcaggctctgccactattctgcttggggtgcaatccgaactccgtcactaacagtgtgacttgggagaagttatccaactgcttcatgccttatggaatagaaatagtacctgtcttctagtcttgttgaaaatataaatgaggctgggcgcggtggttcacgcctgtaatcccagcactttgggtggccgaagctggcggatcacgaggtcaggagatcgacaccatcctggctaacagggtgaaaccccgtctctactaaaaatacaaaaaaagtagccgggcatggtggcactcgcctgtaatcccagctactcgggaggcggaggcaggagaatcgcttgaacccgggaggcggaggttgcagagagccaagatggcgccaccgcacactccagcctgggcgacagagcaagactccgtcaaaaaaaaaaaaaaaagaagaagaagaagaagaaaaagaaaatataagtgaaaagagtttttttcacagcacccagcccagagatactcatttagctcctgttggccatgctgggtacagagtctccccgagagctggaccagcctccccctgcctccatgcacagtggtccggatccccttccacccttccctgcaccctgtggtcgcacattcttcctccgggttatcagtgcccattgctcccacccttcagtcattcccttgctgggcaaccgctgaccgctcctttgcccgacatcatacagagtcttcgatgatttggaatgtattttcttcctttttaagggctctgaagtgtctttgtgtaagtgtgttcctgttgtctccaaagaaacaaacatttatcggtgtctctgcaaagtagccaaaaaaagctttacaaaagaggtgtatgaaatagcacataatttctctcagaaattcaaatgttttaaccctgctttaaaatctccctgaccaacaatcatgattcaactaatttgagtagatttcctcatggtctgtgtcagtctctctcccatcatttgtcaggccagaaacccagtgggtttcaattaattaaaggaaaattaattggatattactatgggctgaattctgttgcttccaaatttgtttttatttttctaggggaagaacaaataatgtttactagaaataaacagtcacaagactttctccatcttttaatttaaccaggtccatgtgttaagcaattactactttgtaataatttattatttcaatttatagtaccccaaaataggagttggtaggtttatttttacaatgagaagtgctagtgtgattatacacactggcctaaagatgttgagggagtatatgaaggaaaaaagaaattgcgtagtgatgagtgtgaattaaacatcagaaggacgctaatttaccacctggttaacccagtcatcaccaagttggcccaaggtgattgagcaagtatctatatcactgctccatttcctcgggtgatttatttttctatatcttttcaaaaagttttattatgtgaatttaagcagtgtaaattaatatgtagagaaaaaaatctctacatcttacagatgtagagaaaaaaatctctacatcttagagatgtagagaaaaaaatctctacatcttagagatgtagagatgtagatttttacatctctagatgtaaacacatttacaacacatttatgacagcacctatggaaagagaggtcccttcactgccattatagagaatacatgagcgtgaattttaaccagccaaagcagctatgtgacatgcctatgttgcttccaaattcttaagtcctaacctctcagttgtcagaatgcgactgcatttggcgaaggggttctaaagaagtaattaaatgaatttgaggtcattaggaagggccctcatccaatataactggatccttatacaatgaggagaagattagaacacgggcacccacagaaggaagaccatgcgaggacacagggagaggacagccatctgcaagccaagcacagaggcctcagaaagaaccatccctgccaacaccttgatctcagacttctacctccagaactgtgggaaaatacatgtctgtagtttaagccacccagcccgtggtactttgtaatggcagccccagcagactactacagaagctccagtgctgtgcaaatgaagagccctgactcggcagatacgctgcatcaacttcacactcaaggtgtcaatccatttctttacaaactcaacaggagtacaagttgccccttgataacacttaaagtttcaggattcaaatgtcttttaatcatagagagggtggaacaagatgcctctcgttactttccctgttacatgtcaattcctccatcacaagtctctgattctttgctgcactaacttaaaagaagtagaccagtcaacatcacatgtcgaacatcccctgtgtctcggggatgcaactgacccacggaggggctttttagtgcccattttatcacattgttttctaaaaaataatgcacctcttccaagttcatgacacttggggactggtaactcagagctcaataatttaaacgacagcaagaacaacctgcaacatttcctcattcacagaaactccagatattcccagaatatttgcctggccacttaggggtaatgatagactgacataaaatgagttgccgtggtagaaaatagagcattttgaaacgtgcactggaaagaagagatttagggttggatcactttcttagaaattgagaagaatgctactgattggcagataggtggaaaattgctgtcaagtttccaagtatggaaaaacaaatcctctgttcagtgagtcaaggcccatgggaaacgtaaaccaaatatttgcatagtggaggatgctgtacagctgtgctggtgaggctacctcaggtgggcttctgagtgtcactttatacatcaaatttctatccactcacccacacgcttcaacaagcaccctttctctccactccccagagaggggatgtggtgccatcatttgaaagagtctgcgttgttaaaacaaagtgcttaaatggcattataaatattagctcaaagtattcattggttatcagaggcattcagaattgtggaagaggagatccagcg
